United States Patent 7,365,185 (GENOMIC PLANT SEQUENCES AND USES THEREOF) - sequence listing, part 18

SEQ ID NO: 42894 - DNA, 1501 bp, Oryza sativa
taccaactttccccaaactttttcccaatttcaagaactaaacacagcgaaagttggaatatggaatccaatggtggataaatccacaagcgaaaatgataaattctgtagcgaagaagatacatgaacccgaagacgtcgtgatgctgaaacctcaaagcctgtactggccagtctactgaactgaaaccctgttcagttgtccactgacttgtagacttcagtgcacaaatacaacaccagtacagcacgcgtctgactggattgcaagactcataaaccgaaattttgcccttcgtgtggactggccaacgtcagcaagagcactaagtccagctccaaaatacataagataacaattgttggagttgcttaatcccaactattctgcgggtccaacggatacagtagtcagcagtagtagttcatggcttcatgggattgtgaagacgtttctttcttctctggttcgggaggtggtaggaacttaggatccttgtacgatggtcaccgtttggagcaggacccgcaatattgtcacttgccattatcgttgcctttgactgaacaggttcagtcaggcgatcgcaggatgaccttgactcgtcgaagcaaaacttccggatgcagcttcccggaattaagcacacattctatgtgagtagtagactgcaatagtttgggtagttttgtagaggatagatgtaaggttaaattataaaggacatactttatctgtaatcgtatacatgcaatttccaatttccaattagggccaaagtaaaacttttccttggtaaaacatcgtatacatgcaatcatttgaatcgttactctgatatgttaagaaaacattgatgttgtatgtttattttctgtgttatgtgaactccttgcgttgaaattttcttctggacttcactctgcaaatagccatagacaaaccccttttcagttcctcacgtttttcctttcacattcaaaacaggattggcaggaattcaggcactaatgttacacagtatgaatgacgggatttactgctagtatcacccattcaccatgtaagaaccttttggtggactgtggatgacgagcttttgaaccatcaatatttcatctgaacttggtcctttgatctagtatttattgctctgctttgcagtccagggaaatgatccatcagaattcagacgtggtacatgccgttggcgctgctgttcctgcagtacttggctttaagaaacagaaatttatgaaactctgttcaaacttttgtggtagtctcgccgacgcattctctgaactctcatggacagacgggcaaacacttgttcgagatctgcaggaaagaaagggtaagacgctttaagccttttatgctctgaatcgatgatgagactagttagtcaagcacatgcacaccattggatccattttggattatttttcttgtaatcacacttcactgattataactctgctgcttctatttcgaatg

SEQ ID NO: 42895 - DNA, 1501 bp, Oryza sativa
tagaactcattaatatcatatgcatgtcatatagagaccattccatatatcagctgagacgcaaaaaaaaaaactgtaaacattggtaattaactaaattgtttttcttatattatccttcctctctttcccctacccgtagtaaaatcactctcctttcatgtttctgtcttctcgctctcctccccacaccagtaaatttgtttagctgtcagttttacgggccacttattacatatttctctctcctcacttccttctttccacatcagtaaatttgtctagctctggtaattttatgggtcagccccaacccccaaatgacaagcggtaaatcatgaattacacacaggcacacagccatgcagtgcagaacgccgatttggtaagcatcacatgtgccagtctgccagacatagtggtgaaaaatcatgaaggaggtcaaaaccaataccctagcagaagggaaacgactcccagaattcatctttagctttggtttttcttatacagtttttttcatacttatacacaccttttacttctactatgtttaatgaaattggtacactctaagcgtcggtaattcgttagaaaaaaaacagatgttggcgtcgaaaatcgccaacacgcggttcgtcaagaacaaattttgataacaagataaccattacgctttcgcggcaatgagcgaccgattttcaagctaatcggcaaagaaaattgaattgatctacttctaagaagaaaaagcaaaaaagaagaacgtaaaaaagaactataatgaatttattgattgggttggagaggggaatctctccaatcggccttaaccatatgtagggcgcctggtctttggcatgttccacgtttactgggagtaaattaagcgtcattattttaaccgattgaaggtaggaaacacaattatctaatgacggtaggcaatccagcggatttctgttggaagcttttcttgcctgctgcattctgaatatagtgtgcaccgagatcttctgtgcctacttcgcatcatacctcgcccttttaaccttcactgctaccagataatccctaatatatatcttcaatattggttagcttcggctaaattgcttcatctaatttaattaatgacaaatataattagctctctatccaggtcaatactaactaattttctcctaccgctatttgcttgattaacagccgaatcataccatataaacttttattatcatatatgccaaatttgactatcaacaacaggtgccagacagaccgaccgtacatgcaacgaaagaactcctggaacggtttttgtacccttgtgccggccgagacggcaccacgcctttctcgtctcgtctcgtctcgtctcatctcataccgcaaccacctccaccactccacgcgcctatatcaccacacgtcacgcttccacctccacctccacctcactgtcgatctcctcccgcttcgatccatccatccatcgcca

SEQ ID NO: 42896 - DNA, 1501 bp, Oryza sativa
gacaagcgacgatatatattggacacaattgttcttttcatttatttattttcttgttgatttatactcgtgatatgatatacacggttggaaaatccgagttttttctctctttttttttttttgctctctacaagtttgcaactccacttgctaacagttatgcatttgaaaatataaatgaaatcgtgcagagacaagcgacgatatatattggatacaattgttcttttcatttatttattttcttgttgatttatactggtgatatgatatacactgttggaaaatccgagtttttttttttggtgaaagatagatcagtcgacaactcgacataaatacaagtccttttcgtattgagacgtatactggcccagcaatcagcaaatgggttgttgatggtccgtggcccgtggtcctcccttcccttacatcggccgcaccgacagcccagaataagttaagcccatttaaacattttctcgcccaaaaatttaattaaacttcggtggcatgtcatcatcttcaaactcatcttttttttgacacagtaatattctcgaattatctccccggatttattaaattaaaaataaaagtaatccattttttgagaagaaagtgaaataatttttttttcaatgatatgctcgaattacctccaccgattttttaaataaaaaataaaagtaatcacatttttttccgacgaaagtgaaataacatttttttttcaaagtgcatgccgtcctacgacaactacaagacaaccaatggcggagctagaaaattttcattgtccgggcaaatctaactacaagtatttactataaaaattttgtgttcaattctatattatatcaaattttggaataagatttcaaaattttacttatatcaaccccctcaatacggtattatttcggccaaattttttaattttttcatgaattttagtaatatttatttaaattagactaaattttgttcaaaattttgaaaataccgtcatatcagcccacttgatacaaatactgaaaacgaaagattgaacccctgaccggaccactgctactttggtatagggatgaaaacggtcgaaaatggtctgaaacgatattattattttattattttttcgaaaacaaatggaaatggccagaaaattttcatatttatgaattcatctatttaatgtaaacttcaatgccacgctaatagaaattaaaaaaaagtaaattttaaaaacagtaaccatcggtaaaaatattattgttatattagttttacgaaaacggtacagatgcggttctactttggtcgccgggcggtggctccgcgaccgaaggctacaacgaaacgttttggtttttagcttttagcctcatcaatcggatcgtggatgcgctcagctagttagataagcatattgagcttcgttcgcagccaagcaaacgctcgcgcgcgcagccggcaatggcgtcgttgtctgacccga

SEQ ID NO: 42897 - DNA, 1501 bp, Oryza sativa
ccactctcctcccccgcgcgcggcaatggccaccagcctcctcctcagcgacgccactagccaaattcgcgcagtcactactggcggcgttcgcgctgctgctggcgctgctcctcgcgctgtccaggggagcggccgcaggggtggtcgaggaggtgctgctcacctgggagctcggggtcactggcggcgatgacgacggcttcgggtttttcttctccccgcgactgctctgcgactcttctccccgcgactgctctgcgactctgccgctatcgcggctaaccagctccaccaccacctgctgccgagggagaagaggaatagagaaggagatatgagattgacgagtgggcccgacttataaaatgttaactaagaagttaatgacatcaattatacagatggcccgtgggcaaacttgtctgttatgaaagtttctctctctgtttccatcggaaataataaaataatacggtgggtgtccagtaactaattaccacatttttacaatatcaacaagaagatacacgttctttgggtgtcatatatcaaattttgcaaaaaaaaaaaaaagaagaggaatatatttttcatgcgagagactggaatggaggttttaggattgaaggattgaggataacaccaagtcaaggaaacaaaaggacattgttgcctttcctcgtataaattgttttgacagctaacatcatcccgtcatgcaaaatggtggagcagcaaatatctacaactataaaagcacaatcgtcgttgtccttaggggcggacattcgatctaaccgaaaattttggtttcagtctttgaaaagagtgaagaccgaatttcagcgaaaaaaatgttaggaccgacaaattcggtctcggtctcgaccgaaattcaacaacatttccatatatgcaaagaaataatggaaattttcaacacaaaaatcacaaaaaaaattcgtaagtacttatgagtaaagactcttattaggttgcatgcctagaagaagtaggtacgtgaaaattagagtttaatcctattaaacatagtggattgtaggttgcatttagacatttttttgataattcggtcttttctgtctatttggttaaccgaagagactaaccgaattgaccgaataaaatttcatctttcactatctatgaccgaattgatgaccgaatttctcggtctcggtctcttggttcggtctttttctatcaccctagctgtccttcccacttctccccctggcacgtagcgcacgctaagaaaaaaaaaacgaatggtgcgctccgaaaaaaaaatcgtgaaagaaaagcagaaaaagaaatgtctggataaaaaaaatcctctttttatgttaaatccacgtatcacccactctccttttaatgttattagcattgacccattgaccattgtaatgcaagtacatactcctcattatctaaaaaaagtacatactcctacttagtactctatgtcatatat

SEQ ID NO: 42898 - DNA, 1501 bp, Oryza sativa
gtatcctgctatgctattctaaattctagtactatatatgcaatagttcaatgccacatccgcttccaacctgaaattatcactcgagaaatgataaggaaaatgttctttgctgctgtagtcttttctgcattagaaatgtgctcttgaattaaacttaattttctactgcctccagaaaccggcaagtctggcaacatttacgattccatctctctaatagtaatatcaccccttaaatcattttcacttttacagtggatttccttcataatcttcaggagaaagagatgtcatactgccaggtacgtaagaggcttttatgacttctgtttcgcctgtttctttgtatacttcaggagaaagagtctgactgtcagtagcagtgtcggatgaacatcgtgagcttattatgcaaagcaaattttgtcaaatctcaggtttacgttcagcttgtcgactacgcttctctgcctgcttctactcgtcgacaaatccgtcccgctgcatcgacgacgacggccacaaatgtgacatgtattcctttaaaaaaaaacatatgtgacatgtacaactaatacacgacgcagttcaaacgaccaagttcagaaatcagaacatagcagttttctcaattgtaaagccaaactgatgaactcctgtaaaatttgataacttttacggtgcaattaactagactgataaattatagcgtaaaagttctcgtaccgtttctgtcttctagccaataatttactgctacctccacttcatgttataagttgttttacctttttctaagttaatgttttttactttggtaaaatttttaaaaatacaatattttttaacataaaataaagaaactattaaaatatattcaatgttaaatttaacaaaactatttgtgctataaatattactatttttttataaaattgatcaacctcaaaagtttaatttttataaaattgattaaccttaaagtttaattttaaaaagttaaagtgatttataatataaaatggatgaagtaataataggcctagtggcggaaacaggggtagggtagctagggctactgccctactcctaaacctaaatttccactaaaatttatattttaaaatctcaaaacatataagatgaagataaattatgtaaattatactagttgacttgagccttatgtttaagaaaattatctgaattaggcccgaacatagactcggtggatttgaaatgctagtacgtttgtacttactactgtcatagaaagatgagttaaaacttgcaaacccaaaaaaggattgaacagtactacccaccaaaattggcatttggctcggatggcgccacgtagcatttgcaggcacctgaaactgttcctactgttcgtgcggctgtgccgcggcgcaccacgacgcggcggacatcgtgacacgtgaagaacgctcacgctcacgtaaccaaatacaccaacgcgaaaagcacggatcaa

SEQ ID NO: 42899 - DNA, 286 bp, Oryza sativa
ccggggagggagagagagagagagagggaaatgggccggggggggagagatgggccgggggggcaaggtagactttgcggaggaattgattcggaagatctggattcggaatttgaactcgacgatagatcggggattgagatcttgagatggcacggacactagacaacaatcaaaggaacaaaatttcgcaattagggtttttgagagataattttcccgctaggcgccacgacggaacgggcgctacactttcactaactaccctaggccgacgaccgtaggg

SEQ ID NO: 42900 - DNA, 1501 bp, Oryza sativa
aatacaaaaaaaccaacatctgaattgacatttctttaaaaaaattagaacggtcctctagatagtagaatttaggcactaagacaaacttggaaataacaaatttggttgtaaagtaggtcatgcgtgtcctatagacacatgctaagatggaacgatacaacgcggattagagaagagaataggagtgaatacagataagtatcacattaaaactttgctatcttccaaaaccatgaactcactagcaaattaatttgtattagcaccattcagtacccttgttgcatatagtctagaactctagattagtactttattttgacacagtcgtaaattactggctatgaccatctgctttgtaagcatagaagaatcaccttattttattttcttgtggtaatataaacaagattttgttcctgtaagccaaacatagcaagaaatcagggaaaattgttggttttgcgtaggtattttgctagtcttggaaaaatgagactgttgttcaaccaggtgtatgggcggttttgcactgctatgagactgcactagacattactatgatgctcacatttaaggcaattcaaaaccaatgatggtatgtctcacaacgttcatgtattccacccagggcccagttaaaggcaaattttgccgatgattgtttgcttatgcatcgctacataatacatgaccaaaccatgaattggaagatttgatgcactgatactccatgaagagacatccatttggcaattggcatcactcaacagtaaaaagatgacggaggaaatagcaccatctaaaaatgtcactcgagaagccgtgcaatagatagaaccagtaatgacgatatgcaatatcaaattttcaattttcactgtaagacatgaattagagatcatgtagagcaaccgaccattgcaatcgcagaacagtccaataataacagtaatgagttcaccaacacagttccatcggtcgctccccaatcagcgagaagatacggcagtaaactagaaccattcactgtatcagactggttcctgaggaaggggttagttaccgagcacgaagaaagcgacaaagaaaacgtacgaaggcgcggttagccggagaggtctcttcgtcgtatccattgcgagaagctgcgccgcatccacctccggcggactggcggcgcgccgcccttcccgtccatcgccataggcggcggcggcggcggctaagtgggttttttcgcgttccgcgcggagaagaaaagctgaagagccgtttccccgtctcttcttcattacagcgacaccaacgttgatttccgctaacgacacaggaaggcgtattctggataatgggcccacttgtcagcctcccgtgaaccagatccaggttcccaccaaacagaaaaacagaagctccaccactgcatcgtagtcgtcttcttcacgcgcacggcgcacccagatccaagcgtccatcgccgcggccgcatccgcca

SEQ ID NO: 42901 - DNA, 1501 bp, Oryza sativa
cgttgccgggcgccgggcgccgcgcgcgtggtggctgcggatcacggattcacgggggggatttcgatcgctgcaggagcgatacgtgcgcgggcgcggcgcacggggagtgcaatgctagcgatgtctcgtgtacgtggtggtgcgggcttggtgagtgcgattgatttggataagagagggcgtgggtgtttaggtttcggtgagcgatgacacggagcgcgcggtttgacgttatctccgctaccggctggtcggccggtcgccactacgtgctacagtggttatgtttgtggtttggggtgctttttttttctcgttgatggccaacacgtgaatgtgtttaagtactttcactgccatcatcctttactaatataaaaaaaatacccatgcattgctacggaagaatgttattttaattttattattgttattatacgttttagttaagataaaatctactatgagaacttgtttggatatatatattttttagaaaattatgagctacaattaggagtccagttgtctcatgttagcatgtgagttttttaaaaatatttcttatatgattccttctgtattttcaaaagcgaacgaacttaaaaaccgactcaaatacatatttgtatttccaaaagcgaacaaacttaaaaactgactcatgcacggacgatgtaccaaagtactggtaaaaacattttcaattttataacagtataaagtagagataaggttggagtggtacgtcgtcctgccgttctgctcgtgcttgtttgttaggattttgcaatgcgcagctaaagctaaagattgaccagtactatctccgtttttaatatataacaactattgcattttttttaaaaaaataagactaattatcaaacatatctaaaaaatcacgcattaaaataaggaggttcactactccgtaataagcaatatgggttatttcggattgatgccaaatgtgtcggaccaattcattggtagtttggatagtactagtgaatgttttgtatcaaaaccaaattgttggcaatgcctttgaacagtttagcattattctaaaactttcttcactatatcatcaaattttggcttcacattggtaacaatccaaatatatgtatcataactttaccctaccaaaaaaattggtagagttaaaacttactaaattttggcaccaaagatttagcaaagtagagaaccaaacataccctataacattaatacatgttactaatgagtaaaaagggtcaacctagtctctgcccccctttagccagaggcacagagcatcaaaggtggctagtgtttcagggttgctaatccagtcaccctcccctgagattatagaacagaaattcgtcttaataggttagatcagcattgcatattctaacctaatatctatactattttgaaaaaagatagtggtgacagtaaatctttcaccccacctattcccattatatatttttcaaagatt

SEQ ID NO: 42902 - DNA, 1501 bp, Oryza sativa
acgacagaaacctgaaacagttttggttaaataaagacgtccaaatcgtggttgcttacgcgtccttttcgttgctggatctatagcccccctcctagaggcttccggcgtgttggattttctctagattatctaacctgatacagttcgttccggagcgtcaaccttagccactgtgacgacggtgccaagttgccagctgccgcgacgtcccttgccattcgcgacggggaaccgcatcgctgccgctgggaagttgcaccgctcgccatagagggcctcgcgcgcccgtcttctccaggttcgtcggcgccttccggtttcgtctagcaccgcgcggtcgcggaagcgcagggttggatcgaggtgaagaggaggcgcggggggctattcattgttcagcatccatgtttgagctcgtgatatcgatcccggcgatcctcctggttctcgtcatcgcgctggggtgctacctgctcggccggaaccgtggccgcgcggaggccgcatcgccgcagcagtttgcaccgcccgcgccgccgcagcagttcgcaccgcccaccccgcccaagtaggcaagtaacagggtgcgtcgtgttgttttggtttgtttcacactgttgaaacttccaatttctcctttgtttgtactactttagtaggaggattgttcctttttttttccccatgattgtcagtggtgaattgtgttgaactactcgttgttttgccataatctttctgttgaatcttcccctatttttttccttttacagatgaatgatgtcttagtgcaaaccgaatcaaaatccagacttacatttactcatgtatactgtcactgagctacttcgtttaattctatactccgtacgcacgctatacgttccagaaaggttttttttttaaaaaaaaaaacctctcccccacagaatcaatgggtgaaaggtgatcactgatcacacaagaaagccatcgtcttctagagcggagcaaccggcactccgggagttgcatgtctgcatcagccaccgacctgccatagtgccatgtcgtgtactatgcatactctcacccatttagaatatagtaatcgaaaaatacatgaataaaaaaaatataggaattgaatgtcatagcatatacaactctaacaaattgaaaacacaggaatttgtcaaataaaccgtttggatactccacacagaaacttcatatgaaaaacattatttaagaatagagttgagaggagagatgaagaaagatagggtattggactttccaaaggaaatcaagaccataaggtttgagctctttaaagtccaccaaaaagtgaaggaaatgatgcatttctatgggaaatttctagcccaatccttcaaatcaaagggcccaatatgaaaattttctatggggtttcaattctacaaacttcctatgaaaatcccttgttccaaaggagcgaaaataggataaagtccaaaggagcaaaaataggggg

SEQ ID NO: 42903 - DNA, 1501 bp, Oryza sativa
tacttggactaaatatttgcttaattgacttaataagctaggaactatttttttttcgttgcaatgcacgggctcttggctagttgttgttgttttttttttaaaaaaaatctgaaatgtgtggatgacatgcatatttgcatgaaagaaagcaagacatggaatgcgaaatgaacgtgaaacaccaacagattcttgaaagcacatagaactaagctagggaaactctcctttgacactacaaaacaatgtattttcttttctagcaaccttttgttctgtaaactgtatgctattttaattgtcctacaaccaagatttttctgcttctttaatctgtttttcttgcaaaacttctttcgtaatctggagtgatctttttactttattgcactatcaactattctgtgggagttgagctttgggatgttctttattcgtatttcttggaaagaatgtttgaaatatctcttattcgaaacaaaagaatgaaatatctgtacttatactatttggcaaaccacatggtttgtctctaatctcagcaaactgaaaagagctttgagttattagtatgtaatcacttgactataacagatatattgatgctttgccttctatggtacattctccggtatgtccttgggttctttcagaggtacaatcttcttccccgtgattcatttacctttcttgttggctggtaagaatgtgctgaaagtttcccggccctttttccctgaacattcctgtaaagccaatgttcagtagtatgatactttcaatctgtatttaatttgaatccaagcaaaatgcaatatcataaataatgacagtaggaaataccttaatagtatgccaatccaagtacggtatctccatttgacatgctggtttagtatgatatacccatcatgggaatccttcaatcaccttttttttttcttcaaattgaagcttccacttctacaagtttctttggaaactgtcgaggtatgagatatctcttctctggttcatccgagtgtaagacaatttcgttgtttatctatgccttgcagtaacctgaagaccattttgcaaggtgggaactatcttgtgcaaggcaggaaattgcagtaagcaagtgagatattttgaccagttttaacatgtaatttcacctgtttatttagttgtaaactgagcaaccagagaggaactgatgaggtatgtttattactgagaagcctttttctattccttctctagatgctgcctttggtggttgtgtacttgtgtatgtgaaaaatagatgtttgttgtaatttggacccatagtattgtccgtgattgctgtcacattgttttccgagaaaaccgcattagtatgccaagtatttgcaattctctaccctaaattttagattggattcgatcatttgacacaatgagatacactgatacaggtagtccgtagtcattatttgatacactgaattgttgtaccggtattcatatt

SEQ ID NO: 42904 - DNA, 1501 bp, Oryza sativa
gccgtgctggatgccggcgatcttgaacgcctccgcggcatccaccttcctgccatcgggcgtcaccgccacagagtttggtcggccggtgacgagtcccgcgatgtaggagagcgggacgaggtcgccggacgcggtgatcgtgccccggagcggcaagcacggcgtcacgttggcgttaagcagcgtggcgatcgtctcgaggatctcgaaccggatgccagagtacccctggagcagagtgttgatgcggacgagcatggctgcccgcgtcgccgcggccggcagcacgtggccgtcgtcgccgttgccgaacgccccggcattaagaaacctgtcatggcaaccattacaggaacacacgttaggcctctgatccacacaagctctcaccagacgaacagcaaactcttgcggcttcttaccggataagctctcgctggagcgcgccgccctccttggtcctccggtgggaggtggcgccgaagccggtggtgacgccgtagctgtcggtgccgttcatcatgctgttcatgacccagtcgctgctggccttgacgcggccgcgggcggactcgtcgagctccaccctggcggcgccggcggaggccaccgccgcgacctgcgcgatggtcaggctggcgccctcgatcgtcaccacgggcctgcggtactcctccaccatgcgcttcaccgcgtccagatggctcccggacagctcctccgccgccttcccccagttgagcgggtcggcacgcggcttagccacgcacaggctgctgccgttggcggcggcggcgacgtgcccgttctcgcactccatcggaacggcgaagcagaggggagatcgatgtgtagctgtaacgagtggtggttgctcgagcggtttgctcccgatggaggtggaggagttgtgtgtgcggaagagccggggatatggaagctgcagtggctttgctcttggaggggaatggagggagttgtggggagtttaaataggaggcgcaggatgggtgggagtggggagtgtgggttcggtgtggccggttgggttgaccacgggattggtgtgccggcgcgagcgagtttgggagcgcaactacgggccgggtgggcgtgtggctacgtagaggtttcgtggtggtcgtggcgtgccctgtgccggttgggctcggggaaccgaagcggccgatgcggccgccagtgccgggagtgcatgcgggggaagagagagagagttgcacgcggcagcggcggcgcgggggaatacggggcgtgaaacacctcgcgtcgtcacgccacgaagccacgtttggcttgggggcgtctctcgccgtttctgcggctgctgacggtcctcgactcgtcgtctttcgtttcgtccgggcgtccgtttatctggaagggctgtgaactcatatccagatatcatttccttggtcccccggcttatctttctctatcgctttctacttcgtgcaacacgtttgtttaggttttg

SEQ ID NO: 42905 - DNA, 1354 bp, Oryza sativa
ctttagaattgatcaagattggcacccggccaacaactttcaaacggccacccgggccaacaactttcagacggccacccgggcctagctgatcccgtcagctgctgatttttcaaacatcgaacccctttccacaacagcaatttcacaagcagtagtcaaacaaaactacgctaggaatcacctcacatccgcccgtgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcaaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgtggttttggaaattcatttagttcgcaagcaccgacccaggtgtcggggtttccaagtcttttgtaaaacccaagttttacccaagttgtttttcagattttaagtttgaaggcgtccgtcgatactcgcacagggtgcacgaatatcgagacgcatctagatggttacaaggggacatgatataacaattaacaaagggaggatcaatgcaacaaattaggtatgtccgccaaactgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcactgcgggtcttccggctccgaaactacacgcgaaacggaacaactcaacaaacggcgaaaataaagccctattaatgacctctaagcgtgccattagatagatctcgagacttgaggaattttggaagttgaacggagtcaaacggatttacggttgggaaggtattggatttctaagattattggatttttggtctaaaggaaaaggatttaattaaatcctttttggaaaagaaaagaaaagaaaagaaaagaaaagagggagggaaaatagacttttctcgggcggctagggcgcagcccaagagaattggggcggtccggccgagctaaa

SEQ ID NO: 42906 - DNA, 1501 bp, Oryza sativa
agaaacagcatttgatatttgaaaaaaatattgaacgtatgatttgtagcgtctatttaaaaatatttcaacataattaagtatttgtgcaaaaatctaatggtataattgaaacttagatcagatatataattttggagaaaaatatttaaaatttgaggaaaaaattaggcacatgtaataggagggagagggagagggagagggagagggagtatgcaagcagcaacgcaagcaacacatgcaggacaggcaagcaacgcggcacgggagcaacgcgggcgcacgacagtgcgggggagagcgttgaccaacaagtgaaatattaagttatatatggtgaaacaaaaaaaacagcaattgaaacatttaaatattttatgaaacatggtgaagatacacattgtaacatgtcgctgtcacatgtgaaacaataagtattaacagattgaaacatatgtttttcttttatcaaaatataatcatgcgatatcttgttgtaaagatttaattacaacgaatacaacggtgtgatcggatcatagatttgtcgacgggtgatacccgtagaccggatatagagggtattggggtacgttgatacaaggatctacgtagtacgacatcaagcaaacaaaagacaagaattatactggttcagaccccttgataggtaatagccctagtccagttgatgtggaattatatggtagaaaacacaggttacaaagagaacaagggaacttgtcggatccggcgagattgtagtcgagttgattcgactagctctcgatgacttggctcctcgtaagctccggcttcgtaggctgtggaggttgtgttggctctgagattcgatgtctaaaccctccccggggggccccttttatatcgcagatgtggagatttcctcatagaactcggaggtatcagaccctatacgatacgccaacgacctggttctgcccgagtaggattcttcccatctgtagattctgtgaaaggtttccttagaatatacaggaaatatctacatgcgcgtgggtatgccatatcgatatgtaacgtatatcgaagggtaaagggtatgcctaacccgtaaccctgatagtagcccccgacttctgcttaaaatgaactcgtgtaaccatttgcgacttcgggtgtcgagactgttgtccttcccggtgcgaggaccgcggagatagaccatagtcgagcacgccatttgaagcccaacggtcacgagcgaattttaaactgaagtccaaaaaaccgtcgcgcgtaacgggaccagaaatttccggcgggcatctctctgttccctggaattcgcaccgtcggtagtgcgcctatttaaaggaattttgggagtctattttgaagtcagccaaacctgttaaacacacaccacctccatgcactctttgccttctctgccgccgcaagaaaccctagttcatcaacctaggctcgttttccggcgaccttcgatcagcaa

SEQ ID NO: 42907 - DNA, 1068 bp, Oryza sativa
aagggggccgcatgaaaaattccatgccccctcgccgcccatttgcaggcggccccccgcacagtgcaaaatcgccctagcggagggcggcaagggggccgcctgcaaaattccatgccccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctctgggagggcggtaggcgactatttccgttaattttcaaaatgaaaaattatttttgtaaaacttttaataaaaaaaattataaataaaaaaaattcgtgtttggatgatggtcaagtgagatggaatatgatcacccatatactagtaaaaatgttggtacgttgcactagatgaagtataaaaaaaagtagtagtgaatgtgtggaagcgtaagattaccaggttaagtgaagtccttataggcaaatcaaatatttccagtgccagaaagacactcacatgggtgtcctttttcttaaaaaaagaggaaagacactcacataacataattatttgttgctctagatccactgacatggatgattataaaaaaactattaataccaccttaaaataaaattatgtattacaaactaaaatttgaaaccataataaacatttacttttgtcatgtattattattagattcagttgcaatgaatggttattttttccggtacttgatattgataaaaaaaattcactagcaaagaagagccatagtagaagaaatgttttttggctagctatcatatcaagttcactacactccaatcgtaaaatcatttcactctacaaaaatcagaaggaaatcgtgcaatgaatggaaagaaaaaaaaactgatgatgtggttaggttatgtaaacacgattcaattaaaaaaaaggcatgtgattgtttttattataactttaaaaatgtgttattttttcttcgatccttgtttgtgtaag

SEQ ID NO: 42908 - DNA, 179 bp, Oryza sativa
ccacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacaga

SEQ ID NO: 42909 - DNA, 1501 bp, Oryza sativa
tcagagatgacgccacctgatggtccgcgagcggtccgatgatatcagtcaaaggaagggcttacgctcaatcaagtcataaagtgatttcgaaaggagaatgcgggatgttcatcaaatatacttacattgatggcttcatcacgttccgccgcccccttttcacaaaggggcatagggatgtcactcgccgtggtcgggccactgatcatcacttggccgacgcggcgctccacggtttcgccgctcaaacctgttaatcgagaaccaaccttcgataagtcaagaggaatgcgagcacaagtatgtcaagataaatgcgagaaagataccccgaggagaaacccgggtcgcgtcctctggcctggaatagttataagctggatgggcccgagcctgaagcggctggatccgcctaccaacgaagtctgcaacgacttcatatcccgacaaaccccgtactcggagatcgtcgatgatgtcgataaacgattgaagagagggggtcaaggggggctttgcggtccaagacggaatcttgtccggttgatcttcaggaaccacgaagacagggttcgagttcttgatctcaagataaaaccacctattcctccacttgctgcgagaagaagggcactggaagggaacgtaacgcaacttcaggccatcccgaagtcggaacccgacgcaaccagataccctgttggattccatccaacgcagttcatagtaaaagcgaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcactggtggaagctgatttgccgaggtccattgctgatcgaaggtcgccggaaaacgagcctaggttgatgaactagggtttcttgcggcggcagagaaggcaaagagtgcatggaggtggtgtgtgtttaacaggtttggctgacttcaaaatagactcccaaaattcctttaaataggcgcactaccgacggtgcgaattccagggaacagagagatgcccgccggaaatttctggtcccgttacgcgcgacggttttttggacttcagtttaaaattcgctcgtgaccgttgggcttcaaatggcgtgctcgactatggtctatctccgcggtcctcgcaccgggaaggacaacagtctcgacacccgaagtcgcaaatggttacacgagttcattttaagcagaagtcgggggctactatcagggttacgggttaggcataccctttacccttcgatatacgttacatatcgata

SEQ ID NO: 42910 - DNA, 1501 bp, Oryza sativa
ttttcatggcagcatcacaggcctgttgatccatgcatatactgtactacgcagtagtgctcatcgaataaagacggagtttttaggtttgatctattgcccggtctacggaagtgaaaagagtactggtacaaatacaagtgggtttctcttttattgttttctggcatgatcgtgcattcgtgcgtgctcacactgtcacacatcagctatatattctcctcgaaaggcaggcatcggctatattctcgaattatcaaattctaagacccacacttgttctctaaactaacaataaacactacgaggtcttatgcttattaactgctagtcctagttggttgttttagccgagataatgagatttagagagagagagagagagggagagagagagagagagagagagagagagagtataaaaggtgtggcgtgtacacgaccgattccttttcgcttcgagggtaggcagctagcagcacatggccggcaaaacagttttgcagcaggagagattcatccgttcaattcgctgcaccctctcattacctttctgaaactttttcttaagtccagatgatgacggtaatgacgtgtggattccctgaaaagagggaggggtacatgatgatgatgatgatgatgggcaataggaatacgagttgctatctcacaagcgaactcgtcgccgcgagcaacggccgatcgagcagggcaaggcatgcggagggagtggaggagaggacccttggcaagctcgatcgggcgcttcttccgctccaaaatccacgaggttcaggccgtccggcaacagggatggctcctccgttcgttattcccctcctgcaagggccgcatctaattgatctgaccaacttgcaaggatagtcattagtcattgattactcgttaggtgctcaggtatctgtatatatttcggcttcgttgcaaagagacagctgacagccgtcggcccaagagcccacactttgagtggcgatataaagcaaatatttcagggtgggaattgtcctgattcatgtgagattgcatttcgttttgtttatgtgaaaaacctgaaatatacttgtgaatagtactttaaatctaatagattgtgcccccctttttttaatatgcagattttacctaggtttccgttagtatatatgtttttcaaactgctaaacggtacacttttacaaaatctttttatatagaagttgatttaaaatataaaatattttttaaagtttgtaacaattaaaacttaattaattatacgctaatgtcttctcgttttatatgcgctaactttgacatctatctcagtagtccaatatttatgttgagaaatttcttacatcctcccgaattttcgctcgatccttccattccatgcctatgaactttagcttatcccctacatatttttcattttgattccctgttgtgataattatatatcaaaacctttgtttttatgaaatttaatctttga

SEQ ID NO: 42911 - DNA, 1501 bp, Oryza sativa
aacgtttggtccgcgaagcgtgcactgcgcgcggcctgtacggcagatcgggcaatgattgtttacgctgtcttgcgcgaaacctgggaataaagcggcgcagggagctggaatctttggacgtgagatccaaggcaagctcgcgtgagggagggaccactgttcgtgttgggtgattgggtcggccgctttgtaagatcgaaacaaatctgcaaaccagggcccgggggattgtgggcttgtgatattattgtgtacatgggtgggtacaaacgaaaacaaaaatataaatgagaaaaaaaatgaaattgaaaatgattttgcttcaaactaaccatatccgacttttattcttatggtaattaccatatttcatattatgataattatcgtatttctaaatatgcatttatgatctattttcttatttgacatagtttagaggtctatcaacttcacaaccaaatccttaactcgagtacaagattaaaagaagataatttataatttacatagcataaccttgaatttattttaacatattatatagttatgcaaagttaaatgtgtgattttatagttcaatatttccaatatttgttatggcttcctattgatactgatatgtttctgttcgtatagttcatttctggttttttaattgtttttgtttccgcttttaccattttttattcagtttttgggaaaaaaacatggctatggaaataatcgagatattttccaaccgttttcatccctaattgtgcagcagcaaactaggtgatcaaatctgcaagggagaaatggattcacatgaattgaagagtgtacttcctttaataagaaaaagaaaagcaaacatgcatctgatgtccacattgttttggtgttggcgcatctcattgtttactgtttaaagtgattatagctggtcattttctgaagagaatagtgatctctgaattctgggccgaactgtcatatgttgcatattatggccgagaacatgatgagtttgaactacagaaacagagcataaggatcacatcttttgcctataacgtatatgccaatgttaaaatttaaattttaaaacttactagttgattttgagatattttattatatttcatttttcagcattgatgtttaagttatttgtaaaagttttaattataaattattttttcgctaatacactctttggtgtattatccgtaattggccaatcgatggcataggatgaagaaaatcttctagcgttgcgctgctccgggcccaatacagaatggggctcaaaatggatcgcgttatcagcctccatatacttaaaatgggccttctgcaaatgggcgtctgactttctgacttgtaaactcatagatcgttttttgttccattttctcatgtagtagaacccgttcatgattacaggctttcagcgttgatcaacaaaacgttcttgccctcttgataaatgataatcgaccgacttgccgca

SEQ ID NO: 42912 - DNA, 1501 bp, Oryza sativa
tttgttttgaacaaagtattattattgttttatcaagtaaacgtgcattattcaaagagatatagtagtaacgaattattaatctgtagatttttggaacttaactataactccaaaatcttgtatgatattattatatatgtcctatgttctataaagaaacaatttttaaagatgatataatctttagagtctgtttgacatgactccatctccaactccaccttttcttggaattggaccaaacagtttcaactccacctaaaatggaagtaaagctaggtggagcgttctcacaaaatgaactgagaagtagagctgggtttagactgttgcacgattctactctgtacataactcctacaattaaatttaggaggtgaaactctacaaaacggacccttagaattagttttcattttttcttggaataaagagggtattgtataaactctgcctcacagacttgaatttcctatagcaatcgattatttcttctcactaattaggattttaaaaaaaaatcattgcttagtacaacatccagtatcttttttttaaaaaaataagaaaataataagtgcaagagagaatttcgcgcctacttcttcctagtcctaaggaagaggagctaatatacagcacagtggccatcagaggggtagccacgtaattttgacaggctgctcttgcagttagtggtgggccacccacctcacaaggaatccgtattcctctcgagctttgcgttcttgcaagcaggtactccgtatacacagaatctttcatcaggctaatcatcatagcgattaccaagcttggtttacatctcagtaatgtgtggtgtctccaattttttgtttctatcttttggacaggaagatttcagcatgtcgttggagtcgttgtacaggctgaatatctttactgatgagaaacttctgatcagcttgtgccagtaagaagtgtatgcatgtgtagataaatagagattgacttttatcagtttaagataagataacatctgttctagaagaagactactagtagaacatattacaggggcagacggtggcattattgtatcattattgccaagacatgtagtactaatgacttttactagtacaacaggtatgccatgttgcaaggcagcattctgaatacctgaagtaaggctttgtcattagtagtaatagagattatcttttctctactcaattcctagctcaaagcagttaatagtaatagttagtaaacagtaactccactgatttctgagcaccatgtactagaaaagaaaaggagagcctttactacaaagctccagaaaatggagagagcctttgggaaagtgagaaggaatcagggagaggaggctattccaaagaaagaaagaaacatgcaaaagagcagtatcagtgaagttgttgtttggtgatacttattcccctctctctttctttgcctctcttctaatttaaatttgagggaagaagga

SEQ ID NO: 42913 - DNA, 1501 bp, Oryza sativa
tgtttgccaatccatcgtgctgctcgtcaatattgtgtgtaggtacactgtgcagcgtgtaattctcgcttgataccgataggtgccaagtctgatactcgtggtatcatggctggtatgcacagatatcaggcatggtacctcgggcaccgataccatcttataaccattggtgcctgatcagtaggacactcgccatcgctgcttggctggctggcgaaccgtttcccactaatgtcttttctccattcaacgcctctccttggctctggtctttccttccctagtgttgctgtggctagcgttgccatgtgtgtcgacacctcctagcatcctaggcattggcgccgatgcattcgcctcaccatgctcctccgtcgaccaatggttctgctcaaggtgtgagccatgagcacgtggcgtggggtgggacggagtcgtagacttgcgaggataaagcggaggtgcggatgacatcaccttcgtaaagtatcatgtcgaatgggcggaatgccgtcccctagcaatcatcatttattaaggcataacaaacaaggcaaatttgttctaattttatcaaaacatttatagttattgagcaagtacatcgaggaacctatatttatctaaaatatggagaaaaattaattaattaagaaattaagatgtgctacctactctgcacatagctgctgcttacctgcactgcacctgattgtcaactgaatacccacgttagtcatgtactcacagtgccgtgtatattctataggtcttctaacgtaagccgtttgaaaatcggcctatatcaacacggcaacctgcaacattaagcaagttgccgtgtacggattgtacaacaatggtcgttttcaactagatttgtaaccagcaagtcaagcagttcgtcaccatggaccgggatggttcagagttcaggcattttcaggtggccaaacagcagcataattcataaacatctcgcggtgaaacacgtgttgcccgcaatgactctgctgtttgcacacctgtttgccggtgcatatacgcagctaggcagctagcgattaggtgatcactgatctctctctgaacaatcctcggaattcccaactaactgaaccataacacgaaggaacagatagagatcaggagagttcgaacacgcattcaggaaaccagaaggatcagagatgtgtgatgcagcagcagttcacctgccatgtaccaaacaacacgtacgcatcaagatctggggcatgttcactttgatgccattttcaaccttacctaattttggtattatcaaaattttggtgtagttaccaaaattttggcgacttgctaaaattttggtaggatttcttatatagttaccaaaatttgacagcaaactaaatgtagccattttttttgggtaactttaccaaaattcggtaaggttgaaaatggcaacggacccctggttagatatgatatgatatcatctgcacttcactgt

SEQ ID NO: 42914 - DNA, 801 bp, Oryza sativa
ggaggggttaagggaagcaagagatggagtggagggggatgtaacaatggaggccaagccaaggaagaacactctagctcacctcaccttcaactcctcctccttcttccctcaaatttaaattagaagagaggcaaagaaagagagaggggaataagtatcaccaaacaacaacttcactgatactgctcttttgcatgtttctttctttctttggaatagcctcctctccctgattccttctcactttcccaaaggctctctccattttctggagctttgtagtaaaggctctccttttcttttctagtacatggtgctcagaaatcagtggagttactgtttactaactattactattaactgctttgagctaggaattgagtagagaaaagataatctctattactactaatgacaaagccttacttcaggtattcagaatgctgccttgcaacatggcatacctgttgtactagtaaaagtcattagtactacatgtcttggcaataatgatacaataatgccaccgtctgcccctgtaatatgttctactagtagtcttcttctagaacagatgttatcttatcttaaactgataaaagtcaatctctatttatctacacatgcatacacttcttactggcacaagctgatcagaagtttctcatcagtaaagatattcagcctgtacaacgactccaacgacatgctgaaatcttcctgtccaaaagatagaaacaaaaaattggagacaccacacattactgagatgtaaaccaagcttggtaatcgctatga

SEQ ID NO: 42915 - DNA, 1501 bp, Oryza sativa
atgatcatgtaaactgtggtgtttgctaggaatgtgtgagtgatgcttgatgtttcagccatccagttgttcttgttcttggaggatgtacttgcgtgtgctacgcttatatctatgcacacatcatctacccatgtaccatatatgcttcattaatttatgtttgaattatgtttctagtattatataaatcagtaaatagttatttgcctacaatttatttgcagactgcataatatgcttcaggaaaaatagttgtttttagtttcttaaaaaaatgattgaaaatgcacagtaacaataggtctttgtgtgtaagaatgaattatgcatattatgcactcactatgcacactaactaacaaatatcataaaaaattctagaaaaataatgtgtatatactttcattagtgttatacctatgcgcaaagcttatgtgcataggacatttttttcagttactataacactgtgggccaacaacttctactttaccatatataggaatttgaatatgaacaagagatgtgtgaaactgaattcttcaacgacttaattaattacgagtaagaatggtttttttttaccttccctgagaagatatctaaatatataccgtgcttttaagttaacggtagaaaatgcagcacatctcccgtactttgtcaattaaggatcaaaaataaaactttgagtaatcaagcaggcccaacgaaacatatactccctacaatcataaatgtttgatatttaacatagatttgactaaactttaccgggtttaatattaaatttagatttcaatattggcatgcatgactaataacgcataatttttcatcgactcaacatatagaacacattaatacttatacacatacaatttaaagtttatgttttagttttcaaatttaaatctaaattgttctcacatgtatgccatatgtagtagcggtttaaaagcagtatattcatatcttttcttacaactggaaaagctaagcattaatttgtcagcattggctgtacgatgtatagctaatatatatgctactctcttttttattttttttggaaagataatatatacttcatctatcttatctcgtacgagtttggtttactttgcgacgtaggaattatatgcatgtagtactctgtccttgtcatgcacgattcacttacttcccactaccctcatatcatgtggccacacaagtacccacaaggacaccgtccgttctaggtttctatagcattcaccaaccaaatttcttgggtctcaatttttcccaactaattaatcaaaccatgcatacacaatcaaagataaggggagatcacacactgagtcactgactgactaaatcgaaacaagtcaaacaaccaaaaaggggtgcagatcacctacgtacctaccagtaattaatcagcaggctcactgtaatcaaatataatcatgcattagtagcttaactgcttaagtaaggtgcagtttag

SEQ ID NO: 42916 - DNA, 1501 bp, Oryza sativa
ttaaatttaaatattttttatatagaatatatatatatatatatatattttatacgtacgaaatttacggtatatatttataagttctatgcacgtgtataagggtattattatttttattttattttctaacttgttttttattaatttatggtgcatgaggaggaggagcgtgggggttagggaagggaggggggagggggagggggagggatcgctgtgggtgatcatccgcctattagccctctcccgtacgtgaggcgtggactagtctcagcccgcgcgctcgtctccacgagtgtttcggcagctctaatgtaacagtctatactatagtaatggtggtgtctattctcacatcattcctaccattaacatttggctcccataatatatattattacaccctttgaacaagtcctctctcatttcattataggctcctcaaattttaaaattatctacttgtataataagaaaaatcatagtactactaagactaaataagtaagctagaaacttaatttgttttctgttgcaactcacggactctaggcttactagctaattaacgtacccttacgtcacgtaggatcaagttatagtgctttcacagcctactatatagtccttagtttttttaaaaaaatgtgtattaaaacttagtccatcctatctaacccttgaattttcactaaaatttgagacctatttccacaccctaagtacagtatgcacgcttgtccattctccctactcatgagggagggacacagtagataacggtatccatgtcgacccggtttaagacttaattgtttgacttatgcttgtgcttttaagctaaattttgaattttacaacttaattttaaatttattcattttcttatcatagtttattttacaatatttatttttgagtcattaagaacacgtacacaaaagtattactcgcaaatacttttttatttgctaataagctgtttagagcatcaccaaccgtatctctatattctatccccaaataatttttatgggaatcctaaataaaatttaagatataaaaatagtgttccctcaaacagacttgctaaaactgacctcctaagaactaaaaagtggacccatgaaaaattaccaactgaaattggcttctctctccctcccatgagatcataccagccacgcgtccactgatcgtgctagatcaccgatcggtgtcggccctctctatatgatatagcatgatcgatcccatccagtggcgtagctacctaggtggcactgtggtccatggaccacctaaaaattttatcgagattaaaactatagtatatgtgctagttaatataataaaaattatatagtgtactacctattaaattgacctattacatatagatggaccacctttactctaaattctagctacgccactattcccaactccagttcccctgtagcttcccttgttctctgcatgtcttgtgtcttctgct

SEQ ID NO: 42917 - DNA, 1501 bp, Oryza sativa
gataaaaacattatactgcaggaggcaggcatcctgtatccacagtatgtctactatcctggtaatgggagacatacggtatatggaagcgaacgccaaaatacattacatcctacatatattcacatgcatatacatgatggctacgttacttacgctggatagatcattcatgaagcagctagcttgggattgcatcgactgttcttctgttgaatggagaaacagcaattaatcagagatgagaacgcacagcagatgtcacacactcgtgtctgccacatgatctgaatctcatcacggattcaatccaatcagcccccatgaatgtctccaaaggaagaggtctagaggccccaggatggctgcaggtcaaaccctgcattatgtagtatctgaacaatcgatactgttctctttaatttagtttttactgcaggtcaacgtccagtatcatttgcagcagttggtttggcaaactagcatcaagttttttctgattttacaagggtcaacgaggactcgcaaattcatactggaactccactgttcgcctgccagatgccagatcgatcggctaatgaattgcctgtggaatcagaaaacgataatctaatcctgatttaagtaaagctatggactttatttctagatatattgtgcttgctggactctgcccgcttgattatttggcctcacgatcttgatccaacggtttccgtgagcccaacaggggtcggagaataactctccgaacccccgcgtggcctccgcctccgacccatcttgaccgcacgttcttgatccaacggttcctgtcaactcagcagggtacggggcattattctccgaagtccgaaccgggcacaatttttgacaatttgaccctttgaaaaaaataattttacaaatgaactaccgcaaaaacttatttcaaaaatgatcctccaaatcatgtggcgttgaaattagacacccgttgatgcgaaaaacacacaatggcctagaagatcttcttaactcctgtgcaggttcaaaatcttgcttttaagtccaaaatcttacttttaggttcgagagtgtgctagttgatttgatcctacaatcaataagaaagaaagacaagaaaaccgcagttaaatctataaacgatagccgatcggctaattgccgatgtcatattataatcgatcggcgataatgactgaataaaatagaactaaatctacttgatcggctgtaaatattaacaacatataatctttacttcgatacatatttaaactaagtgattgggatagatcggtcgtcatgccgagacagtataaatcacttaagtcaaaatatatactaaagtaataattatataaacgtttatagcatagccgatcagataaatccagcatgtatcggttaatactccgatacaactttataccaagatattaaaacaagcaaaatatattaaacgagaagcctaatatactctaatgcgataaga

SEQ ID NO: 42918 - DNA, 1501 bp, Oryza sativa
acagcatcgttttctacttgtatcagcggctgaaaggcggtaggagaggaggttacaccagcagaaagtacaaagccgttagttagagcacacacttaccccgttcgtgcgcggcattggagacgtgccaagcgaccgagcacctgacgatgacggctacgttatccaccatcacgtatacagtttgtgaaagcaaacagcgtagagcaacctgtcgcaagtctcaaaacagcctgaacctgactgaatacttaagtgttagtgtattgtgtatagtggttagagcccgttggatgcatgatcggacggctcacaccccatgcaatttctgcatgtgaaacctacctagaacgcctattcgggaaactcttctcatcacggtaaattcagcaagttcaggcaacaattgagcatttgggccagtgacagcacaccattcgcctgcgtgctagtattagccagtcaatgtacagcgatggccaaaaaaaagaaagaaacgggagagatttttttttctttttagcaactgctgtgtgctgcttaaaaatggggctgcgaaaaacctctcgcggttagcagcagcacgcacgattcaggaaggaaacggccgcgtttgctttgctgctccccataactccctgcagtttaagcccctccaaaacggcgctttcctgctcctttttcttcttgtttcttctccttctcctcgtcggcatcctggtcatcgtcctccttttgctttggagactcctccccctttccttgttgtctctcttgcgggatctctacgtcagagctctcgcacctctctcttaagcttttcttctctggccgatccttgaagcaagacgccggtccatggtcggataaggatttcagactgctgccctggtgccgcgatcctacaagcttgtgtgagttatctttcagtggcatctttcatgtgcatgttttttttttaatcttctttgtttcgatttcatcttttggtttcttgtttcctacagtatgtttttttgtgtttgatggattgaatagttttttagtttatttcgttgaattatttggtgtttgaatatgttccgttcagatgaaaagtactgaattgtgcagtgttgatgaagttttgttttgctgattcgatgcttctcggttcacaccaaaatgttcctaaaatggttggaggctggaagaaacagatggaaacaacaactgtaaaatgttcagaaatgtataaaatttactttctgcatttattaccttatatttttggtgtcatcatcaaaccacaatcaagttcgtgttcatacgccgatcaaagcactttggatgaaaatttcgcacgtttgacatcagtttcttccctttttttttatccttgtcaggaaaggaattcaatccgtgccatccaaagaagcagaggaagaaagaagcaatcaagaagagcgcgcgcacttgatccatcgtcctatcggcaggcaaggctgatcgccgataggga

SEQ ID NO: 42919 - DNA, 1501 bp, Oryza sativa
acgagttcagaacatacggcaacgctgatgcccgatcgaccgctttatagttgcattctggctggcatcttgcgaaccatgcggttcatgcattcgcgttatattaccagcgtaatatcatcatcctgtgtctctgctgccttcgtactcggtgaacggcccgagctgcgtcacatatgttcgtctctacacgagtgtgactcctcattagtcatttacacgatcctttcaaatggaaacgatccaagggatttataaaagtcgacttgtcctttgtgttcggtgagcagctagctggttgtggtggtgcctctttatagctgaccgtcccaaacgctagctcagaaacagtttaacaaaagcaaaggaatatatcttacgcatctcctttttaattagtcgacactagacagcttatctcctatcgtttctctcctaacccgaccaaatcagcaaaagtcatgcgcatcaccatgggggataaaatataaacaaaacgagatatcataaatcagatgcccagtcgttttctgaactctcctccctgctccgcttcttccattgcattgcatcttaattctgactcgaacttgtttcgtggctcgtaatcacaagcaagatgtctcggaagcaagaaggcgtcgtagagagaggaggagatggcaaggtggtatgggacatggggagctcgctgtacgactcctacgagctggcctcgctgtgccgaatcctggacaggcacatcggcaccgacctgccgtcgttgcacggcgagccacggcaggaggggctcgccgccggagcgccgccgccgccgcctacggagaggaacgggcagcaggtcgtggtgctcagggacgaccgccgaggcaggaccgggaccggcaggaaggtgacgctgcgaacgctgttcagggcagcggcgtcatgggcgatcaggcagaggaaggcgcatgactgtgcctgtgttggcgcagctaccactggagcaatccaaccggttgtctctccgggccggccggtaaaactttgatgttcgccgttcgcgtcagttttttttttctttttttctgctggcatttctatatgtttagtcagtttgtttctatatgtttagtcggtttgttgcaatctgtgcagcttgtaatgtatcttattctcttctaaatggttgttgatcatggagcaacaatatctagtccaacggtgcacatcaccatccgagctagcattgtgcaccacgtgttatccttgttagataatgttagttagtttgttatagagatagattagttctgttaccgcatgtactttcttgtatctatctctatatccaggattgtctcaggttgttgagattaatcctatcctttgtacacgccacggtagaggctctttctgcctatatcaacaaaggtgcggccccgtacaggggttcaacgcttctcattccgttttacatggtatcagagccataccgatccaatccaatctcttgagc

SEQ ID NO: 42920 - DNA, 1501 bp, Oryza sativa
tggtttatcctcttcgcgtgcagatactccatcccgcgcgcgatctgcagcataatgtcgacggcgacgacgagcgggaacgggatccgccgccgcgggcagctcacctccttgacgtagctcccgaggtccttggccatgagctggtccatgaccacgaagtactctttcttctcctcgtcgtggaagcagtacgcggcgtgcgcgacgttcgggtgcgccaccgaacacaggagcgcgacctcggcgccggcggcatcggtgtccccgatgaaatgcttcatcgcaaagctctcccccatccaatgcacctccttgagccggccgccgagccgcctccggacgctgtagtcgctgccaagaaggacagatgccgggtgcagcttccccatcgccgcggcgaggagctcggcgaggcggtgctcgtttttgctcagaggtttcgacgccgcagggcctttcatttcgtcgaacatttgcgatatcacccatctgtcctccttccacgccatgtccatccttgcaacgagctcttgggagaccagatatagcttgccgaacgcgtgctcgaacagcttgggatcgagcatgtccctgtcgtacttcctggcgagcaccagccgccccctggcgagctcgtccgggtcggagccggcgatctcgccggcggcgtcgatggcctcgagcgcgacggcgacgcaccacaggacattgtggaggtgctgctccacgcactcggtgccgtgcgccatggccgcggcgcgcgcccaccagctgccgcgggggtccaggcactgcctgacgtacgcctcggcgtcgcggaaggcgcggtggagctcgcggagcggcgcctcgatggcgcgccacttggcgccgcgctcgtcgaagcggagctgggcgcgaacctgccccgtgacggcggcgagcgcgcgcgcgcaggcgtcggcgaggaggcggcactgccgcgggttgatgtggaggtcgtcctcgaacgccatgagcgcgttgatgctacccaccgcctcgccgagttgccggagctgctccatccctatcggcgatcagccttgcctgccgataggacgatggatcaagtgcgcgcgctcttcttgattgcttctttcttcctctgcttctttggatggcacggattgaattcctttcctgacaaggataaaaaaaaagggaagaaactgatgtcaaacgtgcgaaattttcatccaaagtgctttgatcggcgtatgaacacgaacttgattgtggtttgatgatgacaccaaaaatataaggtaataaatgcagaaagtaaattttatacatttctgaacattttacagttgttgtttccatctgtttcttccagcctccaaccattttaggaacattttggtgtgaaccgagaagcatcgaatcagcaaaacaaaacttcatcaacactgcacaattcagtacttttcatctgaacggaacatattcaaacaccaaataattcaacgaaata

SEQ ID NO: 42921 - DNA, 241 bp, Oryza sativa
  unsure (1)..(241): unsure at all n locations
agcgcatagaaacatatcaacttcacaaaaatggaaaattatggtcacttgttttagatcgtgttcgtacggagaagattagtatttaggaaagagacagcatttgaggactttattgaggaccttacttgatgaggggccgaggcctgctccggcgcggctccgagtaagagtccggcggagctccggcagagctccggcaagtatgcgtcagatcgncggcagcaggaggnagaaggca

SEQ ID NO: 42922 - DNA, 295 bp, Oryza sativa
  unsure (1)..(295): unsure at all n locations
agggagtaaaannagttaaggnanggttagttagggagggnaattnggtaaggttagtanaattaagttaaggtcacgttggtgacgtngggttctnataccctcagattnnnaaaatgggatagtacccnnnaaaanaannnnnnnnnntcaggcggcgcannggaannnnnnnnnngnnnnnnnnnnnnnnnngttgttctcgtaaagttcacgttggttcactatcgaaacaaacacctcatagccggggggggggggccccccgccaccaaaaaaaatttttataaacaga

SEQ ID NO: 42923 - DNA, 469 bp, Oryza sativa
  unsure (1)..(469): unsure at all n locations
ccgtctctctgagcaaggcaagtcacatcatccttgagcatatgaatcccagtttataaaatattttaattaaattaatgcatanccgctttatttaatttcccgcgttatcactgttttatttagccatgcctatttacctttgttatgacattattattgctattgttattattaccttgttcaccctaggataacaaaaaccccaactagtgggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 42924 - DNA, 332 bp, Oryza sativa
agggtacattgctcggcttgcccataaccgaggggccgctatttgaataggttttactctgatcaagggtgtacatctttacccacaaaacacatcttcctcaggtgtaaccacgtgccacataccaccacgggtatacggacggaagacgttacatagttcccaacccatcctagccataaacaagagtgccgacccaaccccacctacggcggaaacccccgggacaggcaggcaggattgagccccctagcagcaggacaccagccctgtgccatgacatctcgactaccgggccgcagctcgtgtagccttcatttgccctggagaat

SEQ ID NO: 42925 - DNA, 255 bp, Oryza sativa
tgcacagtgcacctatgtgtggatgaaaatggaaaactgggagaaataaaaattggatggtgactcatttttgtatgaccctcctccttttactttattttggaaaacatggctttttcctatatttatctttttttttcatgctcgagaatactttatctcattcccttttgagcgttgttttcatttttctcctttttagctcatttctcattggcatcaaccattggaggagataccataaatgtatggagt

SEQ ID NO: 42926 - DNA, 1501 bp, Oryza sativa
gagtatttatgcaccattgctggaaattatatttctagtaatgtcgttaagaaataacaacaaacatagcggtcctcgtaccacaacttctaatgatcgaggtacgactacgactagtctttcaaccagcaacgtagcggtcctcgcacctctatttcaaacggtcgagagatactcacttctggttatcaactaagaggatgtagcgacctctcgcaccttaaactccagtggtcgagttatgactataactggccttcgaccagcggtgtagcaattctcccactacctctacgatttgttgagtacaactatacacctcgtcttcacccggtgtagaaatcgtctcatcacttcatatacgtcaacttctgtaagtgtttatatgtgcaatatttgtccggtgatcctcttttcttatatcgccttgtcatgaaggcggtcctattgtccctttacgctgatctgacaagcctccgagaaaccatgtaaaacctaaggtaagagtgctaaacggatgtgtaaggtcttgtcagattctaagagccgaaggaccatgtaaaacctggtcatgtaagtgttctcactcgatgcgtattaatcaagccgtgtaatcggaaattaagttttccaactttatagctgggggctaggatttgtcagcttcagcatggtttgttataagattcaagctgtctttgtgaaaaatggcttttccataaaaacagcttggggctaggaagggtaccaaactctgtttgctgagggcaactctagcgagcgtactgcacacagattttcaatttttccacacatattgccctttgagcattcgctcgaggtctatttctatttaatattatgttttgagtattgattttaggaaagtcagacattagaatagtcaagtcagattttcaaggctttgtcgcagactttgcaccttctagattactcgagaatggttgatggagctcgagaaggaatatggaataaagtgatggtgtacccaccgagacgaaatttcttgacttcaatccaaattcttgatacagcaagacgggagacttagtcgcatgctccataccttctcggtcgacatcgggacctagacaaactcaatatggagcctacaaaggccgataaggggaatctagcactatctctgatctcaccgagaacggtccaatgagcacgacaatagttgttccaagctcttcggtcaagaacatcaactcgttcatttgcattgaagttgggggctactgtcagggttatggataccacatacctaatagtagttggctaaatctcggcagggtccaccacatatcatatcttatacggaaacaaacctcaaatataaaaggagtttcggataaggaatgacaaaaagagttctatatgaaaatgacaaggactactcggatcgtttccatatttatctccttagttcaacttggacaagggggcatctatgggtataaatacaatcccctac

SEQ ID NO: 42927 - DNA, 592 bp, Oryza sativa
gctcattgagcggtgagtcttttgtttttgttgtggctttgtggaatgggagatcgccattccctgattcattgttgtcataatgtgcatgtacaactcacccatggaacctcgtaggtcgtttgcagcaaattttaaggcctgaattgcgtctttagtgacacgactagtttactagatatgcacgcctttcattcttctgatgcttagtgggtaacatagatacgatgtaacgttttgttttataaaggccatggatccattgcacttacggtttctctgatgtaacatatctcagatgctttatcaacattgcatacataatttataatatgtagttagtgcataaaactaaaagatgccttacagattgtgtataacattcaggaacttaagttttttttcttgcagctgtaagaacgttattattgtcaatgaattgtgcagaatattgtcaaatgatatacgatagcattttcatgtattatgctctaagtgcttgcattttgtttttgtctatatgttgcctatactgtggtcactactgctacagatttcacattgaaaatgattttatctgttgaaatcagga

SEQ ID NO: 42928 - DNA, 224 bp, Oryza sativa
caaatgtccagaaaagatccctcctttttccccttttactgagccgatagttcacctgaaacaacaagagaaaatgtgtgaattcgtagcggatatgacgtagctttcagcaagcaacttctcgagtcgccccctgatctcgatgggaatatatatgcacaaaaaagcatatcggggcatagccatagcccacaggtagtctgggcccaattcccatccctagc

SEQ ID NO: 42929 - DNA, 171 bp, Oryza sativa
aaaatggagagagcctttgggaaagtgagaaggaatcagggagaggaggcttttccaaagaaagaaagtaacatgcaaaagagcagtatcagtgaagttgttgtttggtgatacttattcccctctctctttctttgcctctcttctaatttaaatttgagggaagaagga

SEQ ID NO: 42930 - DNA, 1501 bp, Oryza sativa
gcgcgcccggagtccccttccgcgtcctcgctcgtgtcggctcctccgacacgcgcgacgacaaacggtgacggcgaacagagcacgggaggcggcgacaatggagtggaggcgatgggacaacgagaggagaagagagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaaagggaaaaggagggagagaaagggggcttgcccgttgcctctttgagaaaaggaggaggggagcgggggcgacgcggcagagggagaaggagctctgcctccgtcccttggaggctagcgcgtggagtggcgggggccgggcgatgacgacggcgatgacggcgggggcggtgtggagcgaagcggcgacacgggcgacaggcgcgggcaggcgcggcagggctgcggggccggatgacgcagacggcgtaggcgtggcacgggcggcgaccacgcgggcgcgcgcgcgaacaacggcgcgcgggggccgatttcgcgggcggggtgctcgccagggatggaggcggggaggggggagcgaggggagggaggaggcgctcggcgcggctcacgcgcacgcccgcgcgagcggagagagagagggagatagagagaggagatgggagatgggccgagagggattcggcccatcgaacccgagggaggcgaaatagacttttgcggagggattgatttggaaggatttggattcgggattgaattcgacgatagatcggggatttgagatctgagatggcacggacactagatcacaagcaaagaaacagctttcgcaaatagggtttttaagagatagttttcccgctaggcgccatgacggaacgggcgctacatgttgcatgagttgaaccaattcaagttaatattgattggctacacgcatatagttgcacgcatgcatggtattccacgatgcacatttataaataaacataaggtattttgttaaaataataatttttttgagaatatctctaaaatcttatgtgatgaataaattgtgatggatgaagtactagtttacaaaaagtttccacatataagagcaacacatggagtatgttgctagagttgtgggtgtccaatgccacgtaataaaagtccaaaaaagggtcaaattttggcaacaaaatggattagggccaatgtaaaaagggaccttattcgaaatgtttgtaatacaaaataaataaaggcttgaaatgagtttttttttctcttcgtactagccacggtggcatgccaggtccttccccgttggcccacgaggccacgagggcgcggaggcggaatccgcaccagcagttgctccttctccacccaaacccaaactcccgaccccaagcaggattagataagcaaaacagccacctaa

SEQ ID NO: 42931 - DNA, 1501 bp, Oryza sativa
ccttgtacccctcgccgccgtcctcccggagcggcgaggcggcggtgacggaggcagtgtggatgacgcgcttcaccgtctttgatcgctcgcattgcttcaagatgatgcgcatcgcgtccacggccgcctcggcggtgttcttgtactgcaaaatcaacaaattacccacgttacacatgatgacatgacattgatatctttttcctgcgtgttccgatcgagcttgtgactacgtataccttgctgctgggttcatgctgaaacggggtggcgaggaggaagacgaactcgcagccggcgatggccggctcgaaggtgtcggcgtcgtacatgtccgcctcgaacagcaccagccgctccgccgcgccggggagctctctcaacggcgccgccttcttctcatctcctgtcagatatattatctccatatctccaacaattggaaacagggagtgattgggagaggtctctagctggctagctagagatggatcggagtacgttgtacgtaccaagatttctcaatgttccatggacgatgcagcctcgttccaagagcttcttgacgaggcaggtcgcgatgtagccgctggccccggtgacacacaccctgcagcttaccatagctcctatttcccttctttctgttcctctcgatcgggctctagtcaagtggaatatttagttccatggccctctctaccatcgctcaaatagtcgaagggactatctatttatgtcgttatattttttattgtaagaaatgtcttttttattttccactgtatagtggagtacatacgtttacaccataaaggttaaacttgctctgtaatttctctaatgcgcaccatttcttttacttccgccaaccataaatatttgactagataagttcttaccaaactttttaaactttgaccataaattttatattaaagtaaacttataaaactaatactttatgatattacaagtaccttctgttttcgagggattacatcaaaagttattatggcgaggtattactagctggtaacaaacagggcggaaaataccacatggtgaggtggacagatttggctttcccaaaagactttgggggtattggcttgactaaaactagaatgctgaacactgttctatcggccaaatgagttatgaaaattgagtcctcatacaatagtctgtgtgttgagttgttgagaaaaaaaatatctttaggatagaggagtttcccaatgtaatggtcaaaagggatcacaattcgagaaagaattctgaataccagaaaatggatgaaactagggtcatagtggcttctagaggatggaagacatatatggttctggcatgatccttgcccccttaagaccacatacccaaagattttttagatttgtaaccaacgagacatcacaatctcaaagttggtaacaaagagtgctagttgtttatcttttataagatcttttgaagacatagaaagtatgatgtc

SEQ ID NO: 42932 - DNA, 1501 bp, Oryza sativa
aaaacttaatgcagtattttcttacagaagaaaaaaatcctttgagaaaacatttgaattgcataacatttatagacagatgcattcgaattgtgttattaaaataatagattttctcgatttttatagacatacagaggcaagggcggagccaccgcctggctagcccaggtggccgcgcatgctcaccgacaaaaactccactaaatttatatgttattgaatgaattgatgatgaaatttatacaacaattactagaagtgaagtttgcttagggttaaaaatctttctagctccgccactgtgaggagagataaaatgggaataagccgtttcattactttggttcataggaatttggaatttttgcgcatatattcgacttccaacttatgtccatgaattcaatgtcttgctgctttaaattaatatatgaataaaagggtaaagtttcatcatttgaggcattaaataaataaagaaattaggtgtacgtatcagactccctacattccatattgattattatataacttttttcacctagaccaacaaaaagtattaactttcctatatttcattttaatgtaagtatgtgatagggaaaaatcaagaaacacgcacactttaactccttctgagccccatatataagaaatgatagctttactacctcaaattcctacattcatgcgcaaactcaattttgatgcttaaatgcaataatattacatgtctaacgaagggggtgatgatcaatttgaaaattttaatttgtgttaaacgttgatcaatatgaaacagatggattattttatactggttggtccattatgcggcaaagccacgtctattttctagtatattactaaattaaagaaatcttttctttagaaaaaaacattagtttgggctatagcctccatctatgactaacaacaatttttcctttccaaataaacagattcctcataaacttaacatttttgtgctggaccaaattgctagactatcatcagcaagctagcaattaaaggccttgttgaccatgcagaaaaggaatgatcgattctctgagctcatgaccaaaaataaaacatgcatgcatacaaaataaatggtaagtgtcaatcttaagtgtaatgaacaccctgcacatctggtacttagagtaaattcaaaattcagttggatgattggtgtactcagaaaatcttaggcggctgaaaaatataagtccatattaactattttgcatatgttttagtcccctatctttacaatattttttgatggtgaggagtttacaggtttatcgacacagttcggtatgaaatctgaaactgtggcacaaatttatcaatagacatggtaccttgtcactgacctcatcattcagagattgagtacaccgtgtattgtttcctttaaaaaaaatctgaaattgatcaaaggaaaatgtaaacattacactgcaaagctagataaaggctttcagcc

SEQ ID NO: 42933 - DNA, 1501 bp, Oryza sativa
ttgaaaaggttgttattattcagattacttgcaaatggaaggaaatacacgtcgttttctggatccatccacttgcatttttcattttacaatcgcaatcattttcgtctataacagtagagccagaatggcaattaggcattccatggctatcatcaactcagatcgtcaacccatgtacgttattgcctgatcgattggtgaattgttgattcagctttcatagcacagagttctgcatatctgatgtaatagtgttgcttgtcacgctttcaaaagagtacatccatcaagaattcaagacataacaaagcaacgttacaactgaataacctatctggcaaagtagactatcacccgaagagaactagggtaaaggggatacacactgggatggcaaagttagggagaaaaagagagagcatacatatatgtttcagctatgcgagaaagcaacggtcgtgatgcaggaactatccacgatggggtacgtttggacatggtcgatgtacttgaacaccgcagtatcactggcctgcgcaccttcggagcccatagcactgagctttctctggttgaagctctctacctcctggaccaactcatccttggttctgctacatgatgtgatgacctaaacacatgtgaaagtagcatcagaggcttgacacattctttgtcctaagccatcttcacatacatggctttcaaatagttactgtaatggtgaaaccatgtagattacacaggattattaaaagttaaacagaacatcatatgtagatattaaattggtaatttccgtaggtagaatatgtaaagcaaatagtttcaccacagtaaactgttcgaattttgttgcaagtgagccaccatgcaacacaaagatatttgggttgaatgtggtggaagtactgaccagtatgccaccaggagaaaccagccctgcaaccgactgccaatacatcattctgaaatggagtaaattgaaaatagtttaacacatggaaaccaacaagcagtgtgatccatgccagtttaaacaacctaagcaattgagagtaccaagtcactcctaaatattatgcggtgtatcaaaatttatgataatttaccatgagggattaaagcatacatcaacagcttcgcacgcattacctctttacaggtccatcggggtgcaacccaatcgtgtccagagttccttcatccatcacaagttcaaatctcctctccaactttgactctaacacatcatcaacctgcaagagcaagattcatgtaagctgaatcagctctttcctcctctttccgctttaaagctctttgttcaagggagttgataattagctgtacaaccttgaaagatgttgttttggtatctaagatacaaccagaaggtcatggatgtgcacattatacgttaaagcaaaataagaacatgaaattgtgaagcatacagatacaggcatatgcaccaaatggtccagtgctcaactca

SEQ ID NO: 42934 - DNA, 1501 bp, Oryza sativa
gtagtgccaaaacttgcctgtattttggcactacaaaaaaattggtaggtaaccgtccaaataggcccaaaattttacatagttctaaaaaaaaacacgcatgaatcaacagatctgtgtaaaatttgtgagaattatgtaaaagaaaacacatgaatcagagtattgagcagagctctctaaacacaaatgaatcaccaacgcaattttacatagttctacaaaaacacacacacacaattttacatgttattacgtaatacttcaatcatcaaatccatccaacgctctatatttatctacatcggatcaaacgatcctggtcgactcgacctcacgtgcctcgtcgcgtcgtctcgctggtctcctcccccagctccccccgccccgaccagtgtttctacttttttttttaattcaaattcaaatttaaatgggtatataaacatttgagttataaactttggttctataaacttaaggtatataaactttatatgtatagaaaatactatatataaaaaaatatttgaatttaaatttaaatttaaatcgaatatataaatttgaatcggatatataaacttttgacttataaactttgggtctatagacttgaggtgtataaactttagatgtatagaaaatactatatataaaaaatatttgaattcaaattcaaatttgaataggatatataaacttttaacttataaattttgggtttctaaacttgatgtgtaaatttgaggtgtacaaattttaaatgcataaatttactaaaataggaaaataatgcggtgccaaaaaaagaaaaccatgaggaggggtgatcgctcggggcgatcgatcgcccattaggaatctcgcgtccaaagctgcgtttgggttcgggaaatagaggagataatacaaagtagttcatacaaaattttgaatgtttgaatccctggtaatttgtggtgaacgaagtaaaaaaggaaagaaaacgtttcaaactctaaaggacagaatgggtgttccaaagacagcaaacccaaccgagccaaattataagtaagaattttattttaaaagtaaagtaaattcatttttcaaattttataatgattaataattaattaatcattcgctaatgacattttctaatctgacccgagttgctcaaacgaatgggaatacgactttggttgcaaaacgaatgaagacctagccaatttttctttttatttttgcaatgaccaatgtttgccattaccgaaaaaaatggcaaggctatgtatggcaatgaaccagcatgccttaattctcaaaagtaatgcagcaggaacagacaggaaaatgaaatgcatgtgatgagcaccagttttatatttttgacagtccaattaagctaaataaacaccacattacgtgctgtgaacatataggacatgacaggagattggtgtctcggttacaattaggggaagcagggatgaggcatcaatgataaaggaga

SEQ ID NO: 42935 - DNA, 1501 bp, Oryza sativa
tgtttgagagctgacatgtttgtgttagcaaaaaagaaaataaagatgtaggagtattttataacttaaacacagtgcattttttactattattctgctgctctaggcaagcaaaagattaaacaaacaaatagattatacagcattaagatgtgcgtgttgctaagagaatacgacgacggatccagcttgcattcaaccaacctaactaaaatctgaggatctggcatttggcccctccatatattcccaaatctctgcctcttgtgttcagtgcttgtgacggcaatcaaggagatggaatcctaagagaaatgttaatttatctgtttatttattcgctcttcagcaatgcaagagttcttttttgcttttgaagcaatgcaagaggtcagtatctcaaatctactcatcattctgaaaatcttgataggtgttaaaaaaaaacattttgactgacttaagtacactagtataaagtatgcaaaactggctcatgtgcattctaactcagccacatgacgaaacatgtcgaaaaatttaaattataaaaaatagttttgaattaatccagttatttttcatagttttctatttaacccgctaagagtagaaataagaaggtgctgcccaaaatcattttaggttttcgtttatttttgtatagcttattatcgtagcttaaccaattgagcactaaataaacacgatattatcatgttttttttctttttacaggagatgagcctaactttctttgagtgctcaggttcattttatagtctagcaaaatttcctctctttttttttggtcttttatttgttgttaggaaaaggcccatcaagatttcttgggcttgtagacgactagtactattgaaagtaggcccattaagtggccgaacttgtcgaactgggccaagcttgtcctcgtgtgcaggcgaaaaaaataaggaaacccgaaggactcctcccacgagatcggacggccagaagaggcccaaccccacaaaccgacggctagagatcactccacgtcgtcaggaataacccccggaagcgggccgcgtcgtatttcacttggaccctcgcaaccctaataaacccctcacccccgcgccgccgccgcctccactctcctacgcttccaccccccattcccatcccctccacccagatcgccgccgccgccttcgcctcggacggccgtacggcgccgtccaccgcgcacgtctccggcgatctacaggtatcgtcgccacctcctagcccccggtctctcatcatacggtggcttccccccgtggtggattcctcggtcggttccgatctgttcgggaggtgggggtggggggtcgttgttctgtaggttatggagcgttggtggtgttgttttttgtgggtggttcgaggtgaatcggtgggttgattcctgattttgctgtttgttttggctgtgatgaaggtgtagatcgcttccggagacatccaaccgcggcca

SEQ ID NO: 42936 - DNA, 1501 bp, Oryza sativa
ctactctacctggcaaccaccgggtttgccccatggaaactttgtacttgcaacaaacatgggacaggactcccctccttgctttttcagcaaccgatctaaattaaaacctgtttcctattggctatttctgcaggtacatagggtccggcatcatctcactgtccaggctaaaatttctttgctctgaacccatgtgctttcttaatttttttttaagcggtaagtcatggactttgaattagttgaatatatgtgtccgactgtcccgttggactttttggtaggactccaattcaataatgcaacatgcgctcactggtggatccgtttcttaggctagatgaacggctgaccgggctctaaccatgtttcatcgtcggaaattaactgccgtgaaaacatgggttgtagtgctagttgtttgttgcctgggctttttaccaaatacctgacttttctattagtacgtagaatacacaatatatagagccgagtgtcctttaaaatggaggatttttatagaaatcttaactaatcatgcaagttaaggcaaataccaaagcaaataaagattgtacgagcaaacaccatgatctcgtgcatacccatctacgctatttcttgaacgtggttaggtgcgccgcatcatagttacatgacatcaagaggctaggctgatggtggaaaagagatgaaatgggagctagaagggcatcatagctaaaagggagaaaagatgaaaccaaggatgggacaatctagtctttcatttaactgttcgttgctctagtcatctgttgtgttgttcagtgtatataaacattgaaatgcgtagaaattgaacaaaatgttgtttatgttatttcagttgtttcttttaggtttcttttcgctgtggtagctgctgctctaaaccagttcatttcagaaataaaatggtgaacaatactctttttcttcttgtaatatgcagtagccacgaccagcactacctagaaaagccattgttttagagtttatatttttcctcaaaatacgaattaacattaagaggtttggtaccagatcacatacatttttaaatcaacgtttgaaaggaggccccgtactcttttacactcactgtgctaacatagttaaaacctctgttacgaggtataagtactgtcatggactaatctccagcagccccttgacagctctccctcgccgtgcttgtaccctgcagcttgtagtttactccaacccaagaactagtactaccactgcactgctacagccaagtggcccaaacgcccaggacacattgctcctccctcctcagaacaagtactatggacctcatacctcttgtttgatatagtacttcctccgttttatattagaagactttctaacattatccgttcatatatatatatatatatatatatatatatatatatatatatatatatatatatatatatatatatatatatatatatatatatatata

SEQ ID NO: 42937 - DNA, 1501 bp, Oryza sativa
tataatttgtgcatatatgctggaagaaaagtagtgcaagcaaagcgaagatagctagctgcatgctgcagggagcagaagaccagggagttaaggaaacgcgtttcgtgtggagccaatcgccggccgcttgcttaattacaacttgacccactattgatgaacagcactggctaggatattcacacaatgatgcatgataggatcagtacaagcaagcaacagcatgatatggtacagcaatttccaacgaatttcgatccactcgatctctcaacgcgtatatatatcggccgaccggcgtcacatcgatctatcgtccaaatccaaccgtgtcgcacttaatttcctatatccgcctacgttaatccgcaatataaaataatgattaaacatgttttaggctcatttggaagaaaagaactgtttagtttttcctgaagcatttgaatcctggaaataaaattcatatgaagttatctggaataaagagcatgtccttaaaagttttctatgaacatcctaaggaataaagcattccattacaattttagactaaaacaaacatgagaaagtccaactcatggttttctcttcctgtacatgtctacaatttctttttttttttgcgtgtgtaatccaaacgactgttttgaaatactcttgtgcagttgtgcttctaatttatgtaggaatttataaggcatgtgacccgtgttctttatatttttgtgctttcaaattcgtgtgtttcaaaggactcttagtctcttgggtgcgtttgagacgaggggaaatgaattgtttacagcaacttttttagagattatttttaccaaaagcgtacttcctccgggttgataatacttgtcgtttcgataagggcacggtttccaaaaaaaactactttaaccattattttttattataatatgtacaaaagtgttaataaatatatgattttattaaagtaccttttaagactaatctatacatatagtaaccatattgaaagacaaatattttaaaaataatttataatcaaatattctaaagtttgacttcactcttatctaaaacgataagtattatcagcccagagggaatatcatttaacagcttgaaacgaacatagccacgtcgacgtgtttcaaattcctatgcttgaaagcactttcctgtaaaaccttttttttaataaaaaatacgttgtttagaaatttgaaaagcgtacgcgcgaaaaataagaggtacaagttataaaaagggataaaagaacacacatttaggctctgttcgtaattcccaactccttccgcctcgtttttcatgcgcacgcttcccaaactgctgaacagtgtgttttcttaaaaacaattatatatggaagttgcttaaaaaatcatattgatctatttttaaaaaaaaatagctaatacctaattagttatgtgctaatggaccactccatttttcgtatgcaggagatttaagttttaat

SEQ ID NO: 42938 - DNA, 1501 bp, Oryza sativa
agcatgagatcgcgcaaatcggtccattagtgattagctcaggttcagagccccttcacaaagttaggtgcgtatccagtcagaggctacacatttgcggcacaccagattaccaggtggaatcgaaaaaaacggggacaaaacaaaattgcttcgagaaaatttgcaacgaaaatagtcctcttgaaagatactgaacacatagtgtcgtcttgaagtactgaatacagtgtaggggacaagatattaattgtatcattgtatgttcagaaatcaaggattcaggatggatatagctgtaaggtaacggagaactattgtttcttgatccatagctgagcccattgagccagctatatgatctggaggcctttgggcctcttattgggctacctggctttcttgcttctcatttctcttcgttgattttcgtttgttttcctcgttgctgaattctgaagacctggggtctgagaaagtgcagcaagcaaacctgaaagactgaaacgtcaggatgacctgtgaagaggaaggaactagtgaatttctacatttggataggacaacgaggaagaataacttatcagaggttttttttttctttttgcccatgtcttcgtcagtatggcttgaaagatcaaatatttgatcatttatttctcagtcttgctgtaatagtaatcttgaaataaccatctgcatttcagttcatcaatagggttatgacactgcaaacattagcctttgctataatgacactggacccacatttcatagacatagatgggcccatttatcatccactcggagtctcaaaacagcgaagcccccatgtttgtagtccgaatattgcaattttctcatgaaaatgcgagctgggagtaaaacgaaatgcagtcaggtagaccagtgagccagggatggtagtactctgcagtctgcaagaacagcattaacctttcctctgcatctcaactactgcctacttgtgatttttcatccacaacgctaacttcaggctccagattacgaacgtcttgatcttttcgcgaacgcacgaacgtcttgatcgaacaaacagcaactgtttacactgccactgaaccgctgaaccgcaggtcgcctgtagcgaaacaatacaattaccagatcaaaattgctagcagaggcatgctctcactgctccatgccaccaggatgtcgcgcaatattgttcagttccgatttcccgtgaaaccaattgaatgcaggcaaatcctcagttcatttactccatttctcccccatatcccgtgaccaccatttactcgtctctcgccgcattcacccgccacgaacactgcggcctccgcgagtcggcggcctcggcgcgcgcgcctctgacactataaaacctgcgccttctgccaccctcttccctccaaattcccaacggtcgtgacccttccgagcgcatcgcgtcgcacgagcgtgcaaggtgatatggtggcctctgcgctct

SEQ ID NO: 42939 - DNA, 1501 bp, Oryza sativa
acacagcaatggctgcactgacaaagacagtaggagttttcccgaaagagcgggctatagttgacagagaacgggccaaaggttcctatgcactaggaccatacctttcttctaagttgttggctgaaattcctattggggctgcattcccattgatatttggatccattctttatccaatgtctaaacttcatcctacattttctaggtaagtattatcctccctctaatttagaaatgaatctgaggcactttattacatgccacgcagaaatagtagaatatcgatagttcgatactattttgtttatgctccatcaaacaacattccatgctacactttcagatttgccaagttctgtggcatcgtgactgttgaatcatttgctgcatcagccatgggccttactgttggagctatggctcctacaacagaagccgccatggcccttggaccatcccttatgacagttttcattgtatttggaggatactatgttaaccctgataatacccccgtcatttttcgctggatcccaaaagtatccctaattagatggtaaccctcttccttatatcatattttggctcctaagctaggtgggaccgtgggatagttaatgaccctatatttcaactttgtttgccattgatttcagggccttccaagggctttgcattaatgagttcaaaggtttgcaatttgagcaacagcattcctatgacattcaaactggtgaacaggtacggttgttcatgtggacctgcaaaaggcagttttacatttttactgttacaaaaatgcagacacacacttggttaagtgccagtgagatattgctcgacctaagttaatgtttgaatgataatgcactcaaacagaaaattggcccagacactattcatgtgttatcatcacattcaattaaaaatctgaattgaaaattttccttgaattgtaactggggcctgggtaaaaaggtgaacctttggcatatctttcttctatggaggggaagtgatctgcttttgacacattacttctatggcaggccctggagaggttttcattaggaggaatccgcattgcagacacgcttgtggcacagggtagaattctgatgttctggtactggttaacctaccttcttctgaagaaaaacaggccaaagtatcagcagcttctaccaccatctgaggaagatcaaaataagcagcaagttaaggaagtgaaatgaagtgctgccagcaacattttgccagcaaaggtaaaagagacattagcattaaccacgtttcacacaatggtcctaatctcctgaaatattttttgtcaggatgtactgcaattagaaaacgtaactgttgtatcatattgagcattagttgtatggccctttttgtagttaatattctttttgtagcatctgaatgggaaattatggcctaaataattttgggggtagcaagcattccttcattctatagtcttgcatctata

SEQ ID NO: 42940 - DNA, 1501 bp, Oryza sativa
aggacaccataaagcctctgaataaagtaaatttaagaatatgcccatgaccacattacattgcacaatctaagaacaggtatataatattgctagaggacaataacaccgtgtggctcctacgtgcaatgcagattaatacatttgacaatttgaggaggggaaatcaagggaggatgactttggaaacaaagaagaaagataaggtttctacactcccactgacttgtgtactttacaccaactagactgcaatgcatgcaccctgtatcatggtaattatttgcatatgcgaagcaactgaaaaatagatgagacagcaaggatgcaaagataacagtatcagagcctcaaatggtatattcaagataaacctacacaagactacagtgcattctcacagtgatacataatgttaacttccaattgatctatcccttccccaccttctcactctcttgtagcgcccattcattcagttgtttgtaacaagccacacaataaaataaaacagaatgccgaaaccaactttgtctaatcttaatggtataaaagtgaggacttaaaaattaagatcttggtatacagatagtggttattcagatgtaagatgatcgcatgaatgctgtgcaatttccataacataaaacaattccccaactttctatcagtaatttggtcctggtttatcaatatgccaggttgtaatgagttgtgtcagaaaaaacaatcaagacaaaaatgagcggtcatatgagtatcacaaacaatcacagatagagtcgcatagctcaagactgacagtaatggccatggttcatgtgtcatgattgagttgaggaacttcactatgaaaagagaaaataataagtcattgagtggttgagttagatgacacctagaaactgaaaacatgccaattgagtattgtggtattagatttccacctaggacagcttttggtacaagtgtccaaaagaagtactccaaacaaagaggttcttccaaattgtccaaacctagcagcaccaccaagctgcttcctagtgcattggtcctttcaaggtatattattatgcatataagtgtacaatgtgacgagaaacattaactaccacttaagccaagttcacctcatatattgtgtaaaggaaaacaattattttttcctagctccagcaactcctatagtactaaactagcaaagatgctcctattgctaattttcatcgatgacatcattgatcccaaattcagagaaaagaaaagcttccgatcgaaatgcaattctggggtagctgtaacgaccaaaagtaaaagcgtgggattagtactagatccgggcaaggccgtgcagaaaccagcatgttccgaagcaaatcatgctaatcggaggcacgaattgtgaaccttaccgtcctgggtgacaagggggtagtcggcggcgttgagcgtgacgaaccagtcccactcggaatccaggcgcagcagcgcggccgcg

SEQ ID NO: 42941 - DNA, 1501 bp, Oryza sativa
ggtataatgcctttaatagttgatacttgatagaagtgagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgacttatatattcgatgttacatagattttgccaattccctcctcctatttactttacaaataaacgaaacagtgttatatacaagtatttgatataagtcgtaatgttttgttactgatattcacaatatgcttttttttgcaggatattgttggtacttgcattcctccgtctgttattcaagaaagccagtttacactgagagaaccttgctttatttggtaccactcacctttcctatcttctattttctgcccagagtagctacaattttcttcattggaccattggtactcacatcgttaatcatggtttcacgttatatgcaacgacacactaatctcagttctttgtgctttcaataacaagaaaatgtgttcatagtcgcggttaaagttgccaagagtaataacttgatatggtacccatagtcagggttaaaattgcgaagctgttaggtttagctacctgttaagtaagtgaaaccattcaattcagtccagatggcatctaccaatggagcccaactttgagcattagcatgtccataatattgtatgcatgaaaatgataccgatatagaagtatacattataaaagaatatcatcaatcatagtatttgaaactttcaatcttttgttaacatatgcatgtaaccactaatggttaaagttaattgtggagacactaatgtccgaaatgattcacttacagacgaatgcagtatatttgagtaacggaatgttgtacatacacaaggatttgctttaaagatatgcaaacattgaattgaatccaaattaaactgtaaagaccatttaccatgtgatctactagtgttgatcatgtcaaaagtccactgaattttttaaatagattttggtttccctttgttcttcaactgtcatgatccttcactattatggccctctgtagacattattttcaaagcattgcacaggatgagattcttgactgtggcttaactttttaattagcaggttcattggccttttgttttgcctgagtgaatgcaattggaaccttctgggtagaagctgaagcttagtttggaacttcatcatactgatttcatactcagaaagtggcgagaaatggatcgtgatgatatagctggtttcgtaagtggaggttgcaaggccttctgagttttctgacgaagcagatgataatagagttatgatatacagaagtcaggcaactggttcttttcatttactatttggttgacgtttgaagtttgttaactggaa

SEQ ID NO: 42942 - DNA, 1501 bp, Oryza sativa
tatagcacttatggctaatcattgactaattaggttcagaagatccgtctcgtgattttcatgcaaactgtgtaattagtttttgtttttatctgtatttaacgctccatatatatgttcaaagatttcatgtgatgtttttgggaaaaaaattttggaaacaaactgggccagtctcccggaataatgtatactgtgcaacagtgcaagtgtaatgtaattaagatgcatggatggaaatggcacaatagtcaacgtagacaggggttccaggagggagcagaggaacagatatacgacaaggactacctaccctgttagtagtaagcagccactgcaagatttatggtaagataatatgccaaaatgatcatctactggaccatacagtatgccaatgttggtgagagcggtcagaaacctgcgttaaatccttactggatacacgccctgcaataaatccttgtttgtcttgttcggcaacatgcatttgcaaaatgaagtacagtatatacattgatgcaggaccgtccagtgtgaaactacatcatcatgatcagttagcttcgggaaattaaatactgactacaatacatgtactcctccgtaaaaaaaaaagacaaactctatgttttcgtgtccaatgtttaactgtccgtcttatatgaaatttttttataattagtattttcattgttgttagatgataaaacatgattaatactttatgcgtgagttatctttttaattttttcataattttttcaaataagacggacggttaaatattggacatggaaacccacggtttatttttttagacgcagggagtaggacagtagaaaaaaaattataatctgttatatccaagttattttgggtgctgctctcagctagtgagaaagttggacgcagatactcagtagttagcgagaaatcagttcgaagcagataaaaacacacacaacgtgcgtgctaacctcgtccaagtagcttagcttaactccttaagcaagttaggctctgtttagttcatggaaagaaaatttttgggtgttacatcggatgtttgacttgatatcgcaagaagatttcggacacaaatgaaaaataatttcataactcgcttggaaaccgcgagacgaatcttttgagcctaattaagacatcattagcacatgtaggttactgtagcacttatggctaatcatggactaattaggttcaaaagattcgtctcgcgatttccgtgcaaactgtgcaattaatttttgcttttatctatatttaatgctctatgcatattgtcgacgtttgatatcgcgactacggtatttgtatagtatgtggatcgttggtactagggtatatgcgagattgaggtaaaagagatgaaaacaagggtttttatacaggttcgggcctttatttgacaggtaatagccctactcctattggccgaagccggtgttgctcctttattcatattaatcacacaaat

SEQ ID NO: 42943 - DNA, 1501 bp, Oryza sativa
atattgagtttgtctaggtcccgatgtcgaccgagaaggtatggagcatgcgactaagtctcccgtcttgctgtatcaagaatttggattgaagtcaagaaatttcgtctcggtgggtacaccatcactttattccatattccttctcgagctccatcaaccattctcgagtaatctagaaggtgcaaagtctgcgacaaagccttgaaaatctgacttgactattctaatgtctgactttcctaaaatcaatactcaaaacataatattaaatagaaatagacctcgagcgaatgctcaaagggcaatatgtgtggaaaaattgaaaatctgtgtgcagtacgctcgctagagttgccctcagcaaacagagtttggtacccttcctagccccaagctgtttttatggaaaagccatttttcacaaagacagcttgaatcttataacaaaccatgctgaagctgacaaatcctagcccccagctataaagttggaaaacttaatttccgattacacggcttgattaatacgcatcgagtgagaacacttacatgaccaggttttacatggtccttcggctcttagaatctgacaagaccttacacatccgtttagcactcttaccttaggttttacatggtttctcggaggcttgtcagatcagcgtaaagggacaataggaccgccttcatgacaaggcgatataagaaaagaggatcaccggacaaatattgcacatataaacacttacagaagttgacgtatatgaagtgatgagacgatttctacaccgggtgaagacgaggtgtatagttgtactcaacaaatcgtagaggtagtgggagaattgctacaccgctggtcgaaggccagttatagtcataactcgaccactggagtttaaggtgcgagaggtcgctacatcctcttagttgataaccagaagtgagtatctctcgaccgtttgaaatagaggtgcgaggaccgctacgttgctggttgaaagactagtcgtagtcgtacctcgatcattagaagttgtggtacgaggaccgctatgtttgttgttatttcttaacgacattactagaaatataatttccagcaatggtgcataaatactccttgtataagggtgaaatgctataatggtttatccatgccttgcggatgaactctgtaaccataatataccaggagtatttttacgccattgccgggaattatatttctagtaatatcgttaaaaaataccaacaagcatttctggtgccgttgccggggattatatttctagtaatgttgttaagaaataccaacaagcatttctggcgccgttgccagggaagattcataaaagagattacctgaactaatattttatatttacctctttataatcactgccctttgcaggctaaccttggctgttttcacttttgttgtggaaacagggtagtgcatgactggtttcaacttgccagaaaatttcaaagaaaa

SEQ ID NO: 42944 - DNA, 1501 bp, Oryza sativa
accgcgtcgcctcccgcgccatcggcggcggtggacgccccgtgtgcgctcggtgaggagaggaggggtggagaggaaagagggagagagagaggatagagagagggaaggggaggagaggagtaaatagggaaaatgaagagatagtgtgtaaaaaatttgaagtgggtgagagggaaaataggaagggatattatatttttgtgagcggtccacttaaaaagctcgcacgtgaaaatcaatttttctgtgcggtccacttaagtcgaccgcacgggataatgaggattatcccatatggttggattaggatgcccgcacggaataatcgattttcccgtgctggcgtccacccggcaccagtcgctcgattatcccgtgcggttccattcacaggctgcctacaactaaaagagggtggcgtataggaaaatcttttatgtagtagtgccaccggatatcaacatcagagataagactagacatacctcatccggtacctacggaagccggcaacagagatctagcgccatttctgatctcgacgagttcgtacttgaggaggtagactaccctgacgtcgactacgagttggttatccagtcgccatgtcgatgacggcaagataggttatcccaaatattctacttgtgtgattaagataaataaatgagcaacaccggcttcggtaaacaggagtagggctattacctgtcaaataaagggcccgaacctgtataaaaatccttgttttcatctcttttaccataatctcgcatataccctggtaccaacgatcctcataccatacaaataccgtagtcgtgatatcaaatgtcgacagtggcgcgccacgtaggggaatttggtgctttaagatttcgacgagatgggtccaagagatagattttccaacaacaagctactcgatgacttcgactatagggagatctaacccgatcggagtatatcttccgacaagatcgaaatcatccccatcaacaattcaatctatcgagattgatcgaacttcaagacgtcgactgcccggtaagtgacatcgtcaattgattttggtaacctcggtgattgccgctaactgtttaggacgccggccttcgaggaaccgaaatcaacatcgcacactccgactaggatccaaattttggaccctgatgcatagtgagaacatccatcctgacggcacgtggcaagaaagcacatgatagttcacctttttcaggttgaatatatcactgtccaagatcaccacgcactgcttgctcgtgagatatacacatgcatgcgaatgtgccgaatcagtacgtactcagggatgcatgtattggtttgtcgacgcgtgcctgcaaataagaccgatcaggtaattaggagattaattttttaaattaatctactaatttcgtagatacatccggcatgtacctacaaaggtacgcaatattctatatgtgatttatcgtacctattcttcatatca

SEQ ID NO: 42945 - DNA, 1501 bp, Oryza sativa
gagttttcgacaacgacagatggagttcaacggtccacaagtgaatttaagttgataggggtactagagttggttattacatgtgcatctcatgtggccagcatgactcacatacccaacttatggcatatccggatgtctattcgcaatcatgtcgggtgatcaagccgacaatgcttgcgaggaattatccgttaacaatctttcctcaaatagaccagccgtagccggcgctatacatgagataagtcatcagtctttgttggtaggttgggtgcgacaactcagcattttccgagaacgttctcgataatggggtgtactcaaccacaacttactcgagtgctcgattgttcctgaaaacattttctagaagacaagatatatagcagagaatatcgagcatgtactgaaaagactgcatgtaacttctaatattatcaggatataacaagcagattaaatatcaggcaatatgtaaaccgtaaataagcatgatttatacataaggaaatagagcgagcccctagcattaaaccgtagtcagcctaacaccggaaacactcgtacaatagatatcatataaaaaacatgctctaggtaaacttaataaagtatggatctgacaatattgtattgatatgaagaataggtacgataaatcacatatagaatattgcgtacctttgtaggtacatgccggatgtatctacgaaattagtagattaatttaaaaaattaatctcctaattacctgatcggtcttatttgcaggcacgcgtcgacaaaccaatacatgcatccctgagtacgtactgattcggcacattcgcatgcatgtgtatatctcacgagcaagcagtgcgtggtgatcttggacagtgatatattcaacctgaaaaaggtgaactatcatgtgctttcttgccacgtgccgtcaggatggatgttctcactatgcatcagggtccaaaatttggatcctagtcggagtgtgcgatgttgatttcggttcctcgaaggccggcgtcctaaacagttagcggcaatcaccgaggttaccaaaatcaattgacgatgtcacttaccgggcagtcgacgtcttgaagttcgatcaatctcgatagattgaattgttgatggggatgatttcgatcttgtcggaagatatactccgatcgggttagatctccctatagtcgaagtcatcgagtagcttgttgttggaaaatctatctcttggacccatctcgtcgaaatcttaaagcaccaaattcccctacgtggcgcgccactgtcgacatttgatatcacgactacggtatttgtatggtatgaggatcgttggtaccagggtatatgcgagattatggtaaaagagatgaaaacaaggatttttatacaggttcgggccctttatttgacaggtaatagccctactcctgtttaccgaagccggtgttgctcatttatttatcttaatcacacaagtagaatattt

SEQ ID NO: 42946 - DNA, 1501 bp, Oryza sativa
ttcaggacacgcttttcgaggaccgcgggcaagagtttcctgccccagcagtgtaggaatgatgtcttatatgtctcagatccatgcgagcatcttgatcaaggggatgaaggtgacttgggtttcttccgtggtatcttcatgtcgttcgccacctcaaaggttaagaagatgttgattgagaagcgggcaaggttccatccaagcgagtcatgtccctactgtaaggctaagctgtggagcatgttggaagcaaatatgtcgccggggagttcttctgccaggcttggtgcttacgaggattctgtggagtattttgtatgcctgaacggacatgtcattggaattggtacccttctacctctgtctgattctgaggaagtaccagaggagtagtaatcaggaacttgaatcaggtgatcatattttacattttctcttttgctgtcttgcaaagtataactttgtttatatttactgaattgaaactgcaaagcctgactttttattgactactggtcaagataaatatataggtatcttcattatgaatatacaaaccgaagaatatccagacattttttatgtccattcgttgtcagcacatttcttcattctgaatgccaatatcacttttcatggttggatatctagaatgactaatgttcaacagtagattgtgtatgtcaaactgttacatgcttaagccttttgtattcaactcatgaatatatgtggcttgctccatatgtgataactgatattactcctagtagctccaaaagaattaactaacatttgttggaaactatactatagttactttcatgtctgaaaagcttggttgatgatctgggaatatagaagttgtttgtttatggtctgtttaagggttgggttatggggcgctgatagcctgatactgcttttgatgttgcctccctgtgtagagaacgggtcctgaactggttagctggaatccccatcctttttttacctgttttcagtagctagttgtccctgttgtttagttttcgtttcttttgtataagaccttgttatgttttggctttcttcaaagggccaggtaatgaaatttgcctattgtctaaaaaaaagcttggtagacattactaattatacttattctcatttgtttacatggttgtgttatgcagtattcatgatccctggaccgactctacctaatcagttgccactcttattgcattcttttaagggttaattagatccatgccactgtaactttgccaaatcaaaaaaataccaccactattcgtcatatcggctacatgccactgaaaatttctaaaattggaacaatgccactgccgtccctttttccatccacctctctcacgccatcctcatcccgtcctcatccccttcctcctttgttccatcgtccatctatccatggccgctggaggttgacgcgagggaggttgcgaggaggtcggcgcgatggtggcggtggagg

SEQ ID NO: 42947 - DNA, 1501 bp, Oryza sativa
gtgattctcaaacgacacggatgaggcagtgcgtctcgtccggccggagtatgtgcgatgtatcagtctttgaattgattcaaggttggcacccggccacaactttcaaacggccacccgggcctagctgatcccatcagccgcagattttccaaacatcgatcccattccacaacagcaatttcacaaagcagtagtcaaacaaaactacgctaggaatcacctcacatccgcccatgaccgtgggcatggctgttcgaacagtttaataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaagggtcctccccgacaccaccccggcgaatccacttgtctctcggcatcaaggctcccctgattagctaattactcagccaggggtgccccattccacccatgtggtcgcactattgtatgctcggatgtaattccaaaggaaaacggtccttaagtgcaagagcgggaaaccgtactcccggtacatttcccgatccgcgattttggaaattcatttagttcgcaagcaccgacccaggtgtcgggttttccaagtcttttgtaaaacccaagttttacccatcgttagatattttaaatttgaggggaggtgttccgatgcgcgtgcccgagggcccgtgcatcgaagcacaacaggtgacaaagaaggtttaagtgttcaacaattcaaggagggtaattgcagcaattaggattgggggccggcaggctatctcgcaagccgcggccgaattacttgtgtaaatcctattcatgcaatatttgcggaaaagaaatacttagatttaaattatcggtgcaagatgatcaaaggtgacttgccttgctcgagatcttgagcttgatcctcgaaatcctcgcactgcgggtcttcgggctccgaaactacacgcaaaacgggacaactcaacaaacaacgaaaataaagctctattattgacctctaaacgtgccattaaatagatctcgagatttgaagaattttagaagttgaacagagtcaaaccgacatacgattaagaagatattgaatttctaagattattggatttttggtctaaaggaaaaaggatttaattaaacccttttgaaaaagagaaaagaaagagggaggggaaacagacttccctcgggcggctagggtgcgacccgagagaaaagggcggctcggctgagcttaatgggccggccggcccgagaaggcggcccaaggcacgcgcgggaggggaggagagggggagccagtgggccgggctcacctcgcgtggtcccgagcgggacccgcttgtcggtggcacggttcac

SEQ ID NO: 42948 - DNA, 1501 bp, Oryza sativa
gtgtttttgtagaactatgtaaaattgcgttggtgattcatttgtgtttagagagctctgctcaatactctgattcatgtgttttcttttacataattctcacaaattttacacagatctgttgattcatgcgtgtttttttttagaactatgtaaaattttgggcctatttggacggttacctaccaatttttttgtagtgccaaaatacaggcaagttttggcactaccaaatttttggtaaggtaatattgtttttgatcatatttggtttgctaccaacctagagccaaaatgtgaaaattatagtgaagaatattctagatgatgccaaatctagattaggtattaccaatgaatgtgcttcaattcaaatcaaacacatgtactattcaaattaccaaaatattggtagggcatgtttttggtagcaattcaaatagggcatttgtgtgtaagaactctgtagctcttcccctcccgtccacgccctccgagagaattttgcatatgtacctcagttaaaaaccggcttcgctacaatgccatcgtttaaatgggattcgctcaaacgccatcctcaagatgtgggtgttcgctacaatgccattttcaccattggttgcaattccaaaccattttctactaaaataattttttcgcggaccgttttgcccctagatctagttgaactgaaccacacataggggacgctaccactgctgcctagacgcgccgctctcctctcagcgcgacgacgcgacctcctctaccgccatccatgccgtagccttccccacctcgcaccgtcttccctcagctcgccgctgccttccctcacctcgtcgacgccttccccacctcgccgccgcccaaaccgtagggtgcaccgggcgcctcttccctgtggtagcagtcgccgccgcccaaacagagtatgtccattgagacactttgtgcaatgcatcgggggaggtggcgtgctagcaggatggagacggtgttgacgaggaccaggatgaagacgacgccgacgaggaccaggatggagacggcgtggttggggtagctgcgccgccgcgcagggaatcggctctaggaggagaagcagctcagctggggagagaggagctggcgccgcgacctagcttttggaggggtgagttgttccaggggcaaaacggtccgcgaaaatattattttggtggaaaatggtttggaattgtaacaaatggtgaaaatgacattatagcgaatgctcacatctcgaggataacgttgaagcgaattccatttaagtgacggtatcgtagcgtagccggttttttaaccgtggtacatgtgcaaatttcttgccctccgacgaccaaaccaaaagcccgcccatttcccgaacgccaaaccctcctcccgaatcctcatgaatccgcacactctagggtagtgtaggaggtgtagtagggtagtgtaggaggtgtagtggagtactagttgtagccca

SEQ ID NO: 42949 - DNA, 1501 bp, Oryza sativa
agacagagttgggcgttggtggtggcggcgctggcggcggcattccgtgacccgccgcagccttgtcgcatcggggcgcagcggatggcgagcaccacctcgtcgccgtcttctccttcttccccgccaccggcgtcgagctgccgccacaaggattacggcgtcgagcgcggcctcatcggagacacggctgctgccacaaggattacggccgcgaggcagctgtcgccgccgcctccgcagtcgacgtcgtcgcccatgcagctactcccagtgaactggaacgcgtcccagatgttggggtcgaagttggcggcgaggaagatgaccgtgaggagcgccgccgtgatcgcgccgaacctccggttgtcgcagcctcgcaggagaggggcctcgctgaggggaagaggaggccgtccatgttgaatcgcagcgcgtggaacacgatggggaagacgagcatgtcgtccagcgtcgcctcgccgaagaggaggaagtcgaagaagctggtggtggtgtacacgaccaagcagagcagcagtgacgcccgcactattggcctgatctgggagtggtccttgagctcgttgtgaattgtgtgcactgaatgcagtggcaagttaatcacattcccacagaaaaatgcaaacttagctggtaattaaaatgtaccgttgtaatggcaaatgtaggcggtcacaactcacaagaactggagctgcagtgtgaagtctccaggtggagctccagtcatgaacatcagggaacagcttaggcatcggaatctgccctctcatcagcttgatggtggcgattccgacattgatcaccacgaacacgatggccagagcaaccgacacggccggcgtgtatttcagtggatctgaactcatcccagggaaaaagaacacaagccattagagtcacaatgaaatgttcagtgaatctgaccatcacgccgacgttgttcagttgttgacgacgacgcagagctagaggatccccctgccgaaagcaccgaaggcgtcgcccatggcctcgccgtacgaggtggcgcccacagcgcggctgaactggacgaggagctcgatggaggcgtccgtgagcaccgcggcgagcatcaccaggatgaggcccagcacgagactgagcaccttcatggtggccgggagcgccatgatgcccgcgccgatgatggtggtggacaggttgaacaccgcgccggagaaggacgcgcgcggctccttgccccgccgcctgccgaccgtgcagctgctcccccgccggtgcccgtgaagaagagaggagagaggaagagaggtggagaggggagggggaagaagaggctgacgcgtgggtcccacgctgagtcagctgccacatcagacaaaaccggagttaaaaccatcaagagaccaagagacctagtttgtactggttttataagatgggatgctttatatccggttttacggttcaaggacgattttgtaattcgatg

SEQ ID NO: 42950 - DNA, 1501 bp, Oryza sativa
atgtcatgattaacaatactattaatctttattgaggaaagaaaacataatctagtttaagctgcaggcttgctaaagcaacaagaggaggggttgagagagaaaatgacaccggaatggtagagtgagaagacttgtcctggttgctctggtggacaagtgaacaaccccagaagcattgataccacatgccatcacacacacacacacatgcatgcttagtacctgcttcttcatagagacttgttgttagttgttacactgtactcaccaatcattttcatcactagtctgcagcttctctctgcttccatcactctctactcaccttgctgcttgcacaatgctttcttgattctttatcagcatttgcattcttgtgttctctgtcacagatagagataatgtactggttcttgggggtccaatgctattgttgcttgcttctctgctgcacaatgttcactcacagccacaccaaccaatggcatgacagtactgatgtactaagcatgcagcaactgaagcaagtggttactttgaggcaaccaagctgttgctggctttgctgctgcctgcctcccccaaggcagatctcggattagtgcagcaaaagtaggagcagagcaaaggttagcattgacccagaaattcacgggggattcagttagtatactgacacagggatagttgctaaaagcaagcagataacagagttaaaaacagttgctttgagctaatcttaagctattaataactgaatcagttcagatgctgtgagctcttatcatcataggcttattgtgatttagccccttcaaagaagttcaaaggagagaaaactaaataaaggaaatgttaaaaaaaaaagaagaagaagaaacaaaaatgaagaaaactttggaataacctgagaaaactctgatcacttgtcgatttttttttcctcaatgatcttggaaagcttggagctcgagattggaatgaatggaatgaattgaatctgtacagttccccattgatcgcctcgattttcggatcaagaaatctttggctccgtgcagctgctgacgcggccaattctgcttcagttcacgccaacctccgatgaggccggcgggaagttgagatcaagaaaccccgcggccgccgccggcgagcgctgctccagctccagctcggcgtagagctcgtcggaggagcacgcgccgccgaacttctcctcctccgctgacgacttgttgttggccttgcggtcgccaatgccggcggccgccgagcccggcgacgccgagggggagagggtgctcagcgaggcgtacgtctccgagctcggctccggcgcgggcgccgccgccgcggcggtggcgggggagaccttgggggcgctgcagctagtgttgatccgcttgtggctcgcgcggtggccgccaagcgcctggtaggaggcgaacaccttgccgcaccccgggcactcgtaccgtgtccgcttcgccggcgc

SEQ ID NO: 42951 - DNA, 733 bp, Oryza sativa
tggcgacagcttagcaagtccgtggatatttgcaagcatttcttgaaatatcactccgagaattcggtgactcgataaagatagtctctccacacacaaacgatgaaccctagtcccatttggattactttcgtcgggagtttgttgggtgaaccctagttctaaatgtttaaagtccctaaaactggtaaatccaaatcgacttgttctcatgtctacttgtacccatcaacgggctttcccctttcacatacttgaccaattatctcgatatatagatgcattatgcacttaaacatgttcacaggcagcatatgtagtcgaacactgaaagcgttacttactggcttctagcaaggccattaaaatatacacctaagttttatgggtaattaaggccttattggtgccatttgagtctttattatgaataacagaaatttatgcgtcttctttatttctattcgatcttttttcaataataatgaccatgccactaatttttctgagcaagatgaagagccttcaaactcaatggttataagcacaaaatggggatgcattatgatgtgagcgatattacaattcagagctatttttttctaggtgtaaagtaatgagtagatttcaagcataaaagaacaaatatttactgttctatttaacctattttgattggctttctgggatgttatgttcttgatctagaattaaaactgatccttcccctgta

SEQ ID NO: 42952 - DNA, 1501 bp, Oryza sativa
cggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcgaaatttgagattttttagaattttttcgaaatttttatgaattttttagcctcccaacggttattttcaaatttgaacggtcaaatagccgttagtgtgccacgtggcgccttcccattcgaccgccgcccgcccacgtggcgctttcggcctgacgggccgccggcgaaacgggtcgtgccgtgccgcgggccgtgccgggccgtgccgctacagtagccgtgccgtgccgtgccggcccgcgggctcggccagcggcccaagcacggcacggctactcgggccgtgccggcacggcccgttactgtagcaggccgtgccgggccgtgcctgctacaggttcggccgtgccccgggccgcccgtttggcccggcccgtttggccacctctaccattactgctccctacagatagctatatacagttgctcgagaaaatctatatacggtggtatatatccatatcaccatgatcagggttcacaaagccgtctccttggtgggtttccaagttttcacgaaaagtgattaaattttattgaaaaaataaaattcagtttgactttctttaaaaaaaaatcattgatttaccgagtggtttgtcaactccagccaacttaaaaactgtaaattccgtgagagaaaaagagagatgatttttatagattgtgtgaacacttaccaaggtatcatttcatattattctcgtgaagtaagcataactcaattgattagattccttatgataaaaccagtccacttaaatcgaagtcctaacttaacatgagtgttgttatttacgactaattattctgtcgacagcgaggcgtccaaatttgataaaagatatgggcaggttatgtttctaaaaaaagaaaaaaatgtcctcgtagacttgacacgtcatcaaagcagcctccacagcggaccagctttctctctccaatgtaacccccttctttctctctcctcttcggcccatgtgactctctcttctccgtctgtttttaactttgcttccatgcatggatttctcctcccccctctccctcaacctcaaccgcaccccccgctcgatcgcgtcgcccctcgccatctctgcagcttaaccacaccaccaccccaccccaccctaccctacctttcctcccctctactcctccacctccacttcgatcgaatgctcgctgccgcctcagatcttcccgcgcgatcgcgcccagctgggtcaggttcgttcgttcttgatccccggatcctgaattccggggtttcttggaattctttcttgggttcgccatggatgcggggg

SEQ ID NO: 42953 - DNA, 1501 bp, Oryza sativa
ttcttctaatgactcagcctttgtgtatggtggcttctctcttgccgctttacactcggtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgatcaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcac

SEQ ID NO: 42954 - DNA, 1501 bp, Oryza sativa
ctaggattggattttttttgggacggagtgagtacatcttagtactatcaatctaaataatggtctgtttagacttatagttttaggatatatcatattttcgtattagattcttttcttaaggaacggagagggaatacgcgggacgtgagtgaggcgtgccactgctgcgtgcggtcagtgtggtgcaagtgcaactagcttacatgcatgatccatccatccatgcacatgcgacgcaagaacaacgagacgagctaaggaccacatgtggcggcatgtgacgccccaagattcggatctttgctctgccagtacgtcgtccggccttgatttttttttctctttcgctgagggaaaaaatatattaaaggttcagagttcagaagagccaccacgttgtagtagtagaaattcagagagctgagctgagctatttttttctctatattaatttatctcaaggcaagtacactaatgtgacatgccggctgtatattgtttttacaagtagctcgggctaggaaaagtacagtaattaattactgcccctattttttaatatttgaagacgtacgtttgaccattcttttttaaaagattatacaaatatgaaaaaaattgattaaagtatatttaatagtaaagcaaataacaataaaaaaataataattatatactacctccgtcccaaaatataataacttttggcttatccagatttatagtaaaaaaaatacttatattgtactctagtaacttttgggatggagggagtaacttcttttaagaagagaaattgttaattttttattgaaaagttaatgatgtcaaacgttaaagaagcaacggagggagtattgttttgctgaatgttctgaaacgagtcgagagtgttaggccggtcgggcttggaatttctagatacgccttgaccaaaatttcttgcatcgccttcatttttccacctgttttgtatgtctaaatggttgttcatgactttgaaactgagcacacccagtaatgttggattgtacatttcgtacaacttatttaattttcttttgttagtctaagcgctagaagatgaatagagcattagacaaattaactggtaaattgatctagctagcatgttcgtgtcgtgtgatctgtgtatgccatgcggtttgaacttctctcgctagctactctctccgtaaaaaaaataaaaaaaaaactaggattggatgtgacatatcctagtgcaacgaattcaagacatatttctgtccagatttattgtactagaatgtctagattcgttttattaaaatatatcacatctagtcatagatttgttttcgtgtgataaagagagtacagctgcgggcggtttcgacttccaaccagctgcacgtacccttctttgctgtagcctgtaagcacatcgcatcgactagtcaggacattgaagagaggattacttctaagggcctccttataatgtagtactctccta

SEQ ID NO: 42955 - DNA, 1501 bp, Oryza sativa
gctagctaaatgggtggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgca

SEQ ID NO: 42956 - DNA, 1501 bp, Oryza sativa
ggggcggacctagctagggtgttcagagtggtcatcggtacccaaaacaattagggaacgaagagtaagtaattatgtaattagtattaaatataagtttagcataacaaagcatcaaggttccaatagggacatcaaaagcaaggtttcggtatagatgattttagttttgtagctaagtttcttgcttttgttctttagccaaattatttcttaaggagtgtgcacatccactgaattctttcctctaaccttaatattatgtttatattttaaaatggaggggggtaattattagactaggtagccttatttctcgtaagtcgttctagaatcgctgaactattaaagcaaggctagtaatacagccgatttgttggctataaggttatttacaattaatatagacccacttgtctctcttacagagtttcttggttcttgtgtctaaaccgcctctaagtttacagtccgtttcttctctctctcctctcttatctcctccatctcagcaacttgctcttagagccatgttacctcccatcagcaagcacttctcctccccacattaatgagatattttcttccacgcctgagagcttctctcctactttgattgtaaccttatcctctctagcgtatttcttccatgctcataggcacatatcttgaattcttgatcatggttggaacttatagcaatagttaaaagtagcccgagctcatgcagtagtcctattcttttctccaacaaaagttagatgaagattaagattcttgtggcacgcttttttaaactactaaacggtgtgtttcgtgcaaaaattttctatatgaaagttactctaaaatattatattaatctatttatcaagtttgtaataactaaaacacaatcaatgatatgttaatatcacatcattttgcgtaaaaaacttaatcttaatcttcatcttcattttcaggagaaaagaacacgatatattgtaaaatcaaaggtgtttttgattattattctgtgatgaacaattggacattggagattattggttttgttatttggaatttattcacgaagtggttttggagacgattggattcacaggtgatcgcaggattatattattttatgtgattggttagatcgggctctgatagccggtcagaccggcggtatgcgcgcggttagacctgccagcccgcggtctgaccggccgacgctgtgtcggtttcagtttcgggttgtttgtttggatatccgtgattatttcataattatgacttctagatggatactatacgtatgtaatactgttgtttgctactaatgagtcaagttggagatagcttggtctcggaatatggtttcattgtttatttcatgtgtaggtgacttgatgcctcgggagagtatttgcggtgatggatcgggagtcggcttggggataagacgacgtccgtggtggttagagatcatgcgggatacttaggctagagttga

SEQ ID NO: 42957 - DNA, 175 bp, Oryza sativa
gttcggcatataaatttggtaaatgtcacgttatttgataatccgtgacagtcaccaggggcataaacacttaccgtcaaatggatttacctcgtctgtgtgtagatctgtagctagagcaattaatttaattttttatactgcgatggcattggcagcagtacctaacacgttc

SEQ ID NO: 42958 - DNA, 1501 bp, Oryza sativa
ctctttggttaatcgcttgattttcttttccatcatcaggttggttattaactcgaggttagaacatggttcctctgaaatgagaccctaggtctcctttgacagtaaacaattatacacataatcccatatcagcatcttccgaaataatcctcatagaacttgtttttattacacatgtctcccttattacatgaatgcaaggccttgccttaaacaaaaagggaaggtgcttaacatcagtacattgcatcctcaacatgaatcttccataaacataacaaactcattgtttataatcatgaatgtatttatttattacatgattgctgcaaactcccgattacacaatgataagtagcgaactaaaaaccacaaacgtggctactcattttgattctggagagatatagctggcattgtcctagtgactgcatccttgattggttctgtgatgatgtgttaggactgcatattgctatcattcacaggagaagcttccttctgattgctatttgaagcagataacggtcttctgcttggtatcgcactcctgagattgattgcccttcgctcggcctggagtaggtcggggagagacacaacttcttccatcgacgacaattctttgctgaggccgtcggtgcagagaatggttggtgttgaaggtattattgctatgatttactgcagagtcaggtgcagcaggaggagcattggtgctggggatgatatcgtcgatgttgatgttggagctgactagctgatgagacaatcgtagggttgttcgttggatttctgcagtcttggtcaacaacacactgagttggcaatccttgggcacatggtttgtaccttcgcatagaaaacatgtgaccttgcgggtgggacatccacctggtggatggtcttcctcacaatgagggcaaagtgtgagacacatgctagcaacgtgtccaatttctccacaacgggggcatgcttttgattccatctcttcctcgccgagatgtcggagagactcatcttcataatccgaggagacttgatctgacccttcactatcagatactctgccgccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgattcttactcttcttgcctttggcttgcttagtacgtgaccccacgtggtacgaaaggctaggaggaaagcattttccgggattcaatggattctctctaatgggctctcttctttgtacactaggctgcaagcttgacttggtgcgaggaggctggtttagcgatgtctgccctgctaaaccaaaggaaggggcttctttggcatatacccatggacaattaagggcatagtgtccttgttctctacaatcatgacaaaaggg

SEQ ID NO: 42959 - DNA, 1501 bp, Oryza sativa
ggatataaatcaattgccaaactttaaaataatgttgattataattaatagatttgtcatcaatcatcaaaaaatgagagattataagttcaagtgtttaagattgttggtttaggtatcttaatttgatgattaatgataaatctaactatatgaggctaatgtttttgtgaacttttcttttactagtcccatttgaatatgaaaatggcatgtaataaactttccatattctaaattggtctcactcgtggatccaaaacgtagggtggacacattcatttacttatttgattatgtgcatacatgttcctttatattcttatgtttgcacatcttgaggggagctcattctatatattgatctctaccatgatttgaaattatgtcacctcatttatatattgtttacatcgggttatcatccatcaccaagaagagaaaagattaaaagatcgtacattaaataatttgcgtaattatggctttggtgatttatagtaaactaacttctatcggaagaatgtattgacgatagaagcattctatatggaatgttattagttaagtctggtgttattagtgtttataatgagcagcactttagcaggccggtgtccaaaacttgtagcttgaagatgtcaaaaagataagagaaacccactatgatatagccgtgtagccctaggaagggctctctgccgtgctgccttattatgggcgttcatattcattatcatggagtttgattcctccatgtagtatgtcacgtcctgataaattcattccgaaataaaattcattttctaaaaggaataatagaattaattaaaatttgaaaagaaattggcaaacactaaaatacgtacaagaaaaattcgaatgtggtccggagaatttttgttaaattctccttggtctaaaaggagccctcaaattttacttgaattttcagagcaccggaaataattattaagcaacaaaaacaattatcaaagtttaataaaaagaaaatctaaaaataatcctccttttcctttgggccaagtctagcccaaagcctccctcactctccctcggcccgcggccgaagtccttccctcctccctctctttttccttccctctctctctcttgggccgccctccctccttccccggcccactccctcctctccttcccggcccaccttctcccgcctcctcccgcctgggccgccgcccggcccaagccgccccacccagcctaccgagccgctcccctcccgcgtgcgcacgcgcgctgacgcgcgctgcgcgcgcccgaccgcgtggggcccacgcgccaggccggtcgcctcctttctcccggccggcctccttcctctctctctctctcccgtgcaaacctagagccgttcctcctccaaatccgcgcaaatcaaaccatggattccaaaattaattggggggttttaaatcccattgattcctcttcaattccccccaatttcccccttgga

SEQ ID NO: 42960 - DNA, 1501 bp, Oryza sativa
gccggctcgtcgtctcgcggcgccgcctccgtcgtcggcatcgcagcggcgtgttccacgccagcctcgcctccgtgcagccgctgccggctgccctcgtcgccttctcgccggccccggtcgtcgtcgtcgtcgtcgtcctctcgtcgtcctcatcgtcgtggcgttcgtccctccgtcaagccgttctcgttcgtcgtcctcgcttcgtcaagtgctgcagccccgtcgtcgtcttcgtcctcggctccgcgtcgtcaagcctcgtgccggccgcgtctcgccttcgtccaaggatcgccgccgaagccgtcccctcgccgttcgtctccgttgtgcccgtctgtctccaccgcgcccgttcgtcgttgtcgttcccacgcctcgtcgcgtggtggtaaggatccgtcctctcgctgccccgtcctcgtcctttcggtgtcgccccgtacccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgttggccactcgcctcggttgacacacggggtccgcttccgtcgacccgtggaccgtctctgtgtacccgatctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagctttcgtcgtttcggaggttcccgaagcgtggttcgtggtcgtcgccgaaggttcggaaggccgttctctctgagcaaggcaagtcacatcatccttgagcatattgaatcccagtttataaaattattttaatttaaattaatgcattaccgctttatttaaattcccgcgttatcactgttttatttagccatgcctatttacctttgttatgacattattattgctattgttattattaccttgttcaccctaggataaacaaaaccccaactagtgggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 42961 - DNA, 410 bp, Oryza sativa
  unsure (1)..(410): unsure at all n locations
cctgcgcccacctttgacattcgtattagcacatggtcgcatgccngcatgtcgactctagaggatccccgttaatcgcttgattttcttttccatcatcaggttggttattaactcgaggttagaacatggttcctctgaaatgagaccctaggtctcctttgacagtaaacaattatacacataatcccatatcagcatcttccgaaataatcctcatagaacttgtttttattacacatgtctcccttattacatgaatgcaaggccttgccttaaacaaaaagggaaggtgcttaacactgatgaatcccctaatgatttttatcaaaatcattaagttaaggtagatacacatcttgtcatatgatcaaatggtttcgccaaaaatcaataatcagacaacaaaa

SEQ ID NO: 42962 - DNA, 193 bp, Oryza sativa
cattattggaaaccaattttatttaaaaatgttttatcaaataaaacttgctttatgctaaaaagaacatactatccttcctttgtttatatgcctgccagtagggtgttaggcttgtcttggcacttgccagtacattatttttaataatgtactgactcttgctgttgaattaacttttgcttgcatgttt

SEQ ID NO: 42963 - DNA, 535 bp, Oryza sativa
tttccgggatattaaatcacggtatattatttccaacccaaagcctaatattctttaatgaaataagatcttggcataaagggcggatttaacatgtcactgaagcatatagagcgaatatggttaaatcagataagaccgactgaagctccgatactaccctaatcggcaatcagaaggcaggctagagattgatattctaagcacgacttgatagatcaaactcaactaatgcagcattaagtataaaaaaatgaataatatctagacaatcaagccgctggaagtttcatagagtggtagatatcttatataatctaaatcaacatcaaaatctaacctaatcggctgccctctactaacagatgttagccgattataggttagatagcgatcttgccagagattatgtacgatatatgataccttgatgaattacgtaaacacgattagagtatcataaagatggaagctctaatcccgagaacacaagccgtcataccaagttttacctcttattgaagatcgaaaccga

SEQ ID NO: 42964 - DNA, 1501 bp, Oryza sativa
atataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcgg

SEQ ID NO: 42965 - DNA, 283 bp, Oryza sativa
aatttcttactatacttgtcattcccggccgaattgaatccttgtataaccgacaaggcctacacaaggattcaatttgggcctctaggatacaccggtacatgcatacccaaagtataccatgttcaccactagtccactacattgtcttataaaatctccaacattgtccccgtctgtgagaatgtgagatcatgatctaaaactaattttagtcctactgcactaagactagcattagttacaagcattgtactgtagcatcgtaacactaactactaat

SEQ ID NO: 42966 - DNA, 1501 bp, Oryza sativa
ctaggattggattttttttgggacggagtgagtacatcttagtactatcaatctaaataatggtctgtttagatttatagttttaggatatatcatattttcgtattagattcttttcttaaggaacggagagggaatacgcgggacgtgagtgaggcgtgccactgctgcgtgcggtcagtgtggtgcaagtgcaactagcttacatgcatgatccatccatccatgcacatgcgacgcaagaacaacgagacgagctaaggaccacatgtggcggcatgtgacgccccaagattcggatctttgctctgccagtacgtcgtccggccttgatttttttttctctttcgctgagggaaaaaatatattaaaggttcagagttcagaagagccaccacgttgtagtagtagaaattcagagagctgagctgagctatttttttctctatattaatttatctcaaggcaagtacactaatgtgacatgccggctgtatattgtttttacaagtagctcgggctaggaaaagtacagtaattaattactgcccctattttttaatatttgaagacgtacgtttgaccattcttttttaaaagattatacaaatatgaaaaaaattgattaaagtatatttaatagtaaagcaaataacaataaaaaaataataattatatactacctccgtcccaaaatataataacttttggcttatccagatttatagtaaaaaaaatacttatattgtactctagtaacttttgggatggagggagtaacttcttttaagaagagaaattgttaattttttattgaaaagttaatgatgtcaaacgttaaagaagcaacggagggagtattgttttgctgaatgttctgaaacgagtcgagagtgttaggccggtcgggcttggaatttctagatacgccttgaccaaaatttcttgcatcgccttcatttttccacctgttttgtatgtctaaatggttgttcatgactttgaaactgagcacacccagtaatgttggattgtacatttcgtacaacttatttaattttcttttgttagtctaagcgctagaagatgaatagagcattagacaaattaactggtaaattgatctagctagcatgttcgtgtcgtgtgatctgtgtatgccatgcggtttgaacttctctcgctagctactctctccgtaaaaaaaataaaaaaaaaactaggattggatgtgacatatcctagtgcaacgaattcaagacatatttctgtccagatttattgtactagaatgtctagattcgttttattaaaatatatcacatctagtcatagatttgttttcgtgtgataaagagagtacagctgcgggcggtttcgacttccaaccagctgcacgtacccttctttgctgtagcctgtaagcacatcgcatcgactagtcaggacattgaagagaggattacttctaagggcctccttataatgtagtactctccta

SEQ ID NO: 42967 - DNA, 299 bp, Oryza sativa
ccgtcatgtcgacaacagttagataggctactccaaatattgtactggtgtgattatcatgaataagagcaataccggcttcggccaacaggatgtagggttattacctgacaattcaggggcccgaacctgtataaaaatcctcgtctccatctattttacctcagtctcgcatatatcctagcactgacaatccacataccatgtaataccagaattgcgacatcaaacgccgacagtggcgcgccaggtagggggattttggtgcttcaggatttcgacaagatgggttcaaaaga

SEQ ID NO: 42968 - DNA, 1501 bp, Oryza sativa
ttccctaattgttttgggtaccgatgaccactctgaacaccctagctaggtccgccccaaaagaaaaaaaagatctcactttactcacctcaatggttaaaatttaaattttgaattacttgtactttcgtcctaagcacttgattgactaaatatttacggattttatgccctagaatcaacgcctcaaaaatatttatgttgtattatttattttcaaattaaaaaaataccatatcacgcgacttaaagtaataaaacctaccctaaaatgccattagaagaacaaagggccatcgacccatcgtagggagagaaaaaaaacagtttgctactcataatttgatactaacaaggatactttggccgagattagtttcaaaatttttcttcaaacttctaatttttttatcacatcaaaactttcttacacatataaacttttaaatttttcatcgcatcgtttcaatttcaaccgaactttcagttttagttttagtgtaaattaaacacaccctttttacttacgtgcggcctctattccctcccgctttatcgcacgtcctgtttcccggcctgcttcctcgcgcgcgcgcggtcggtgagcgaccagaagaggttttgatgccatggctgaaactgaaagcgtgacctgacctcccaccaactccccccaaggcggggctagtcgatcgagccatccgattcattcccatgacccacgcgcggcgacaagtcggccggtgatttcaccgtaccagctgcccccccttgtagtatcacgttcgaacggtgcgcccgccgatcgagcttgcgctcggtgcgccagcgcgcaagaaaatcgccgcgcgacgaggcggcacgcacgggatactgcgccgcgcgcggcttccgctcttccgcggtgggatccccaggcgtccgccgcccacaacgacaagttggcacggctgcgcgaaggaacgaccagcccagccggcaggcagcatagcagcagacacgggcggatttcgtctcggcccgcgtcagggcccggctgttcggcggatgtcgctggctggctcggtccatgcaaacaagtggaaagtggcctatatctggattgagcctggccttgtcaacaagataggccttgtcgctggctcggtccatattgggctttcgggtgtgacatggaagttcgattcttttcttcaagtagaactggtggcactgttaaaaagacaacatgtttttttattgatcatttgcttctacccctggggacagtgtatagcataggttgttcataccatacggttatatgggaaaatatataagtgtaaaccatatatataatgtaaacccgaaaactatcgtacaataaaaaaaatggacgtctgaaattgtccacgttaccctgagtgaaaaaattattttcagatttaaccatagtaaaagttttaccatgacatggataagcattagatgcccatatttttatcctactatagtttttttt

SEQ ID NO: 42969 - DNA, 1501 bp, Oryza sativa; identical to SEQ ID NO: 42964

SEQ ID NO: 42970 - DNA, 662 bp, Oryza sativa
tagtttcacctttcactctgcagtttgattgatgaataatggatatttggtcctaaccagggggtatcccagaagattcttctcagcacagaaagtaattaaatcaagttttttcaaaaaagaaataactaaattacagtagcactggaccactggccatgcttccacttgataaccacattaagctcttatcgtttctgataaaagaaattagcaatcatcttacatcatcacctaacacctgctaaaccatatgggtccaattttattcaagggaaatggcgaaatcattagatcgatgagaacagagcgccgttgatggacatatgaataagtaactagataatgtttctatattgtgttaatcatcaagcttaaaaagtccattcagtacaaaagaactttcttgttagtgaatattgcagtcctaatccctcaacaatcacatcagcaaatcagccgtgagatgaagctcacgaacaagttgcattcttttttatgtgttcccaacgagagcttcattttactatacatgtttcagccatattgaatggcatagcatgtacatgacaaataccatctttcatcggtgacatcaggcgagattacgagcatatttttacaggagacaagactcctatcagattgtgcaagtggatttg

SEQ ID NO: 42971 - DNA, 1501 bp, Oryza sativa
gtcagggcattatgtaaaccgtaaacaagcatgatttatacagaaaaagacagagcgagcccccagcgttagatcgtagtcgatttaacatcggggatacccgcgcaacaaatattattgtataaagaacatgctctgggtaaacataataaattatagatctgacaatactgtatgatctgaataggtacgataaattgcagataaaatattgcgtacctttgtagatacatgccggatgtatttacgaaattagtagatcaatttaaaaaaccaatctaccaattaccttgttgcgtactcgttcgatatcatgcgatctgacatcttttggtacgccgcggagcttgaggcttggatgatctcgatagaccaagttgtcgatgacgatgatggctccgatctggttaggttggatctccccctcagctgaagtcgtcgagtagctcgttgtcggagaatccatcttttgaacccatcttgtcgaaatcctgaagcaccaaaatccccctacctggcgcgccactgtcggcgtttgatgtcgcaattctggtattacatggtatgtggattgtcagtgctaggatatatgcgagactgaggtaaaatagatggagacgaggattttatacaggttcgggcccctgaattgtcaggtaataaccctacatcctgttggccgaagccggtattgctcttattcatgataatcacaccagtacaatatttggagtagcctatctaactgttgtcgacatgacggtctgacgatctgactcgtagtcgacaacagggtagccttcctcctcgaatccgtgcccggcgagatcagagatggcgctttcgtctctcctgacagtatccggagacaccgtagggtactagccgtgcttatccctgaagtcgatatccggcggcgtgtcttggcgtatgtagtcttctatgttgtggcttctatgtcgattgtgttgggtgttgatcctccatggtgggtgttgattctctcgtgtcccctctcctcctaggggggcttgtatttatacccataggtgtccccttgtccaagtagaactagggaaaccaatatggatacaatccgagtagtcattgtcgtttccatgtagaactctggttgtctttccttatccggaactccctcgaggtcagtttccgtataagacatggtatgtgatggatcctgccgagatttagccaactactattaggtatgtggtatctataaccctgacaaaaagaggtggtccaaatcgttgctttgaatgtggttcaattgatcatctttgttcgcattgtcctaagaatgggacaggcaaaagagaagacaaagatggtgagaagaccaacaacaacaagccaaagggttcatcccaaaggaggaagctggagaatctcaggaaggcttttcaacaagtttgcaccgccttcgagccactaagtggagatgatgataagggaaagaacatctccaatgtttgcttca

SEQ ID NO: 42972 - DNA, 1501 bp, Oryza sativa
aagggtaaaatgactttcccaaataattaaggggatcaatgccacgccaacctattatttcatcactgtgtccatctttgatacatagacatacgaatgaaacggaaaaggtcaagaatgaacaagagataaaaggcaaatagtggaagggagtgtacatttgtggtttcatgaaaataattttttcattcgggtaatgtatatatatgctagagtaattctagcactgtagagtccatcttttgtctcatgagttgtccatttctcagagatctatagaagcgtaaggatgggaagcgtcaggagaaagaaaatgagaaacacccatataccatgtaagacatcccaatacctataatgtttattacttacagaaattcagtaggtaccataacatttttatgaacaaactagaacgacttcataattttacatacaccgatacactttttcagggatatgaagtagagtaaaacgcataacggatggatatgatacaattgacaagagacaaagcaggcactgcacaaagcaagaaaggcaatggcaatgtgatctctctctataggatgatagaaccagatataccatgcatcgataagtactagtagagtagcaggctgcaggcgcaggtggtgtggggttggagtaggttcatttgagagatcaagtgtacttgtcaaccagtttatagattttttttttgcggatgaattgtatatgttttctgccaagtgttgaggtggactcaatatataactcatgggaaatcgacttgtcatagggcggcttgctttaacttttgttcatttggttgctgaaatttgaacaagactaacatggaagtagttgaaacatgcatgagagacatgcatggtgaaatattcatatgacacaatgatattgaagagatgccaagaacgctcaatagaacttttgagaggcaccgacaatacctgatgaaaccctaattgagtggcatgtttgtataccactatactgtaactatcgtatgtatttcttccatttcatattataagaagttttgggttgtcttgaagtcaaacttcttttaattttgaccaagtttgtaaaaaaaaaaacctacacctgcaatacaaaattagtttcattaactccatcatcgaatattttttttgttgaaaatgttgctaaatattttctgtaaacttggtcaaacttaaaaactttgacttgggacaaactcaaaacaacttatatggaacggagggatttttttgtcgcaagcaaacaaagacgcttgattggctatttgcctacataattgcctagttatttcatctacgtatgtattactcattattacgttgatgattttggtattattctgttggtttcacgagttttggttacaacaggaattatatggttattttggaaaagaaaaggaagtcatggatccacaagaccataattgcaaaactgatatttgcaattaaataactgaatcaaactccgg

SEQ ID NO: 42973 - DNA, 1501 bp, Oryza sativa
cgttctagaatcgctgaactattaaagcaaggctagtaatacagccgatttgttggctataaggttatttacaattaatatagacccacttgtctctcttacagagtttcttggttcttgtgtctaaaccgcctctaagtttacagtccgtttcttctctctctcctctcttatctcctccatctcagcaacttgctcttagagccatgttacctcccatcagcaagcacttctcctccccacattaatgagatattttcttccacgcctgagagcttctctcctactttgattgtaaccttatcctctctagcgtatttcttccatgctcataggcacatatcttgaattcttgatcatggttggaacttatagcaatagttaaaagtagcccgagctcatgcagtagtcctattcttttctccaacaaaagttagatgaagattaagattcttgtggcacgcttttttaaactactaaacggtgtgtttcgtgcaaaaattttctatatgaaagttactctaaaatattatattaatctatttatcaagtttgtaataactaaaacacaatcaatgatatgttaatatcacatcattttgcgtaaaaaacttaatcttaatcttcatcttcattttcaggagaaaagaacacgatatattgtaaaatcaaaggtgtttttgattattattctgtgatgaacaattggacattggagattattggttttgttatttggaatttattcacgaagtggttttggagacgattggattcacaggtgatcgcaggattatattattttatgtgattggttagatcgggctctgatagccggtcagaccggcggtatgcgcgcggttagacctgccagcccgcggtctgaccggccgacgctgtgtcggtttcagtttcgggttgtttgtttggatatccgtgattatttcataattatgacttctagatggatactatacgtatgtaatactgttgtttgctactaatgagtcaagttggagatagcttggtctcggaatatggtttcattgtttatttcatgtgtaggtgacttgatgcctcgggagagtatttgcggtgatggatcgggagtcggcttggggataagacgacgtccgtggtggttagagatcatgcgggatacttaggctagagttgatgcacgtggttgatggagattccatatgacatacgatggaggtattgtgtgcgtatgggatgcggagacgaatttggaaggagtccaaatttggtacgattggttatgtaaagtttgtttcttgtactagagggtttcctaaggtgtttaggactcttagtatgagtttggttcatggctttaggctgcctacctcatgtataaatagagggggagcgtgaggcttcccggtatcgcttttgagagcaattgagttgagttttgagttaggatttcgagtttagtcaaaattttcataaggagtgctgttggtgcactttgtaa

SEQ ID NO: 42974 - DNA, 1501 bp, Oryza sativa; identical to SEQ ID NO: 42966

SEQ ID NO: 42975 - DNA, 318 bp, Oryza sativa
aataaatcccggtctctcgttgtatctatcataaatttcttactatacttgtcattcccggcccgaattgaatccttgtataaccgaacaaggcctacacaaggattcaatttgggcctctaggatacaccggtacatgcatacccaaagtataccatgttcaccactagtccactacattgtcttataaaatctccaacattgtccccgtctgtgagaatgtgagatcatgatctaaaactaattttagtcctactgcactaagactagcattagttacaagcattgtactgtagcatcgtaacactaactactaat

SEQ ID NO: 42976 - DNA, 1501 bp, Oryza sativa
aagcatatttcaatttcaacttattcaaattacatgttgagcaatccagaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactacaagcaagagaagatttatttttcaaatcatgtgcatcattaacatctctaatttttgaaatctcattcattaaaacctcacaattttcgcaatcatcatcattaggaataagagattttaatctagcaatttcagatttaagagattcaatgataaattcctattttctatacatcttctcacacttcttattcttttcactcaaaatattaatagcttcctcaaaatcacttacctcattttcttcatactctgtgtcagattcaccacgcgccatgaagcaaacattggagatgttctttcccttatcatcatctccacttagtggctcgaaggcggtgcaaacttgttgaaaagccttcctgagattctccagcttcctcctttgggatgaaccctttggcttgttgttgttggtcttctcaccatctttgtcttctcttttgcctgtcccattcttaggacaatgcgaacaaagatgatcaattgaaccacattcaaagcaacgatttggaccacctctttttgtcagggttatagataccacatacctaatagtagttggctaaatctcggcaggatccatcacataccatgtcttatacggaaactgacctcgagggagttccggataaggaaagacaaccagagttctacatggaaacgacaatgactactcggattgtatccatattggtttccctagttctacttggacaaggggacacctatgggtataaatacaagcccccctaggaggagaggggacacgagagaatcaacacccaccatggaggatcaacacccaacacaatcgacatagaagccacaacatagaagactacatacgccaagacacgccgccggatatcgacttcagggataagcacggctagtaccctacggtgtctccggatactgtcaggagagacgaaagcgccatctctgatctcgccgggcacggattcgaggaggaaggctaccctgttgtcgactacgagtcagatcgtcagaccgtcatgtcgacaacagttagataggctactccaaatattgtactggtgtgattatcatgaataagagcaataccggcttcggccaacaggatgtagggttattacctgacaattcaggggcccgaacctgtataaaatcctcgtctccatctattttacctcagtctcgcatatatcctagcactgacaatccacataccatgtaataccagaattgcgacatcaaacgccgacagtggcgcgccaggtagggggattttggtgcttcaggatttcgacaagatgggttcaaaaga

SEQ ID NO: 42977 - DNA, 1501 bp, Oryza sativa
tggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgcaatatatatatatat

SEQ ID NO: 42978 - DNA, 1501 bp, Oryza sativa; identical to SEQ ID NO: 42964

SEQ ID NO: 42979 - DNA, 807 bp, Oryza sativa
ttcacttgttcttggggtgttcttgggtttagcaccgggggtttcttgggttttggaggatgatttttggcgtggttgtggtttcttgggatggatggatggttttttcagggtggcgagattggtttcggttcttgctgttctttggtttcaaggatttcagtttcagggtggcctcggtttgtggtagagatgattggtctctttcacgcgcttctgttgttcggagggatcttggtttctgcatgttcttggatttgatggatacccgtttgtttgttcttgcatgtgtgttagtagttcgtggagtcgagtcagagttcagaaaaatgcagattttttttgtgtgtgcgcgtgtgttcgaagttcttgtttggttggtgggctgtgcagcaaaatcggcatgaactagttgtttcttgtgaattccagaatgtcaggtgatattcttggaataaaggttcatttttttatattcggttactgttcttgtcactctctgatctctgattattatattcgacggtaggatatcgtctttcccccacatgcagatgttgactgcttgctttagttttctcgtgtgtgtgttttttttactcggttcatatcgttttatggttatttgcatttgaagattgattcttgtttattggaatctgttacagttcttggttccgtggaaattggaatcataggtctcatacttgaatgttgaaaacatattttattattggtagtcaaatctttattttgtttttcttgggttaccatcatgacaattgcgtgcaggttctggtaactttc

SEQ ID NO: 42980 - DNA, 1501 bp, Oryza sativa
cctcacccggccccggccctgtgggggaaattgctatccctatattcgagtatgttaaatccgagtaaaccaaaatagtaaaaaaatgttaacgaactagccgtttcaatacttctatccacattatagcagtttaaaaaaacaagtatgtgaggtggtgttggcggtgggatacatgttgagttgtctttttttttctctctctaaatttgtaagagaaaattagtgatgtgtatgtagattacctaatactacctctgtcataaaataattgtgattctaagttatttagtacacattaagatttaaaaagaaaaaaaatatgataccccttattaaatgatgtataggtaagagtaaaaaggtagttgagggtaaaatatggagacatttgaatgatatgtgattaataggaccattagtattctattgtgacaattattttagtacaaatttaaatcacagaaatagaattattacgacacaaaagtagtatttacttatgaaatggaatcaatggttattatccaagccctctgctttgtagtagtagctacaaaatgactcatgtaatttcgttttctcattttaaatttcggagattatgatgcattgctggttggctaaggatgaaatcaggagcgttgattacgctaatctgatcaaagcatctcaaaacctgccttgaagcaattaagcaactttcaatgtaacaactccagtatttcttgttccatcccctgtccaaagcaattcatcaattaggagcgtctagctagttccataaaaagcaactactaggagtgtccagctagttcaatataaaaagtatatgatcggctatgattatgtctaccttatgttaaattagctccaataattgattattatttttgaatttaaaatcactcgagaacgatcaaataaacccgatcggtatatagcagcaagtcattagttggtactggtagcacgcgtcatgatagacaaacgtggataaccttgctatttggacagaaccaaacaatattcttgtaccacagctttattaccattgaaaaaaacatatgaaaatacatagttggcacacccttttaaaatagtattgttttaatgataacagtaaaccactataaaaatatatataattaaacaaatacattgtcccatgagaactatatagtaagtttgtcttaacaaatttagagctagcgggctacaaatagcgaaataaaaattcgtcgacaggtgattagcccttctcatcttccacgtacatacatgacaacaatcgcatttatgttagccctatcgtgctataataactaatggcggtagaattagaccgttgcatgtctccgttatagtataacttttagttgtgacgtgaactccaaccaatttacgtgcatgcatgggaaacgtttgcgtttctaatactctagcatgacgtgtattcatgcacgacattcgtctgtaactgttcacgtgtaggcctctc

SEQ ID NO: 42981 - DNA, 1501 bp, Oryza sativa
acatccgttccaaaatatagtaatctagtatgggatgagatccactattatgtccagatttatagtttatgatgtgtcttatcttattttagattgttatattttagaatagaggaagtaggtttgtttgaccaaactagaggagacagcgatggtgtaccattgcagagattaatgtcgaagcaatggaccatgagaagaaatgtctgaattccttcttggcagagagactgctcacctctctgccgtagacaacacatgccaaattggcaatcctttcttaagaagaaaataaaggatttgtttagggagttttagattataagaagcagctgatgagaatctaactgatgagaatctgaagaagctgaaaaaaaatcaatttatggcttctaattcatcatctagattccaactcttataatcttaattaaaagttaggccgttagagaacttttgattctgagagaagatgcaactgtcaaatgcttctcatagacccatcatagctaagtggacgaaaaagagacaaaaattacaaggaaaatctagaatctgaagtagcatagtacagtactagtactgagaccagagctattagagcaatcaatatgtgcgaagtgcaggatcttcataagaaagcattgcaggtaacactcaaatccgacagtttgagagaagcttcctccaattaaatcaggacagaaagggcaggtgagcctagatccagtacattgtttagatcacactacttacttctaaatcccatagcttttgctaatctattgaggttgacctcagcatcacatggggcatgtctcgtcacactgtacatgtggatgatgcatgtaggttcagaacttcagattcatttgatcatttcgtttacaagcatccatataattctagtcaactctgtctgtatattgcctaatggtcggcacaaactgtcaatggggataaacattcaggtcagtttctgcataaaataaaaataaaacagcctaatattttttttgaactctaatgctcttatcaggaactgagaaaattcctgcatttaaatcatggcgacactgcggtgatgcactgatttaattgtacggtttagatcttataattgtgcaacacacatgatctacactattgattgggtccaagagtgacctgttgcaatctacatcgcaacaaaagtccccatctaattaaaatggtggaatctaactgtggtgcattttacatggtttttagcctaacctcttgtatttggtgaagggctaacatccgaggtgccaaaacttcctgtagatgtgaattcttagagaagatcaccttgttattcctagataattttgttttttcactctggagtagatcagcagaatatctttgcctcatctcttctataattttttacttgtgcagtaaatggcatgaaaaaccttgtggttaactgtacctacctttcctacttatgtgtacattaatcacacaaaaatcc

SEQ ID NO: 42982 - DNA, 914 bp, Oryza sativa
agtgacatgccttagcctcagtttgcgaataatcatcactgtctccaaaccagtgctggctcctccatattatatccctgaaaaaaaaaagatacattggagagaacatgttacaagatcagatgtacacaactggagagtagtttcctagtgtgtttcataacaaaatcatgccatgtgcaccaaatttctcaccatcactcttggcttctctggccttgtttatgctgatgcttcccatccccatgcacattagcacatatactttcagaacccaacactttgtgggaaactagatatactctaaaatatgctaccaatattcagatggatttattgcccaaagtcacaatcgttctttcattttttttctatcctttgccttctgtctagctagtgtccacagttctttctcatgtttcattttggaagtttatataaggaagatggtgatcagacactgcaagggagatgtgctagagtctctcgctttgtgaatagccagctcagttaatttggtagtgctggctgttctatttcatatccctgaaaatgtagatgtatgggaagaaacatgtagttctctactttgtttggtcaaagaaatagatgtggaaaaaactgaatttctgaccacttgaacctaagtaatgcgtgtcactgcattaagatgaataaagtttggtacaaccaaaaacaaaaaggaggcagaacccaggaggacataagcctaatctagcgacattaggcagctaacctagcgacattaagctggcgtaagctggagcagcgcggcaccagctgcactccagagtgccgcctcttccgccattgatctaggcctgtagcatcctggtgccaagggagaaggttgtgatgtagacattgttaattagtacttctttccttccaga

SEQ ID NO: 42983 - DNA, 1501 bp, Oryza sativa
tagtactgtactctaatatgcttaacgcattcaatttatggtcaattctatccatttatgactttatgaaatcatgtttataccgttacatattatacaactattagatcttgggttggaaaaatttttctatcttttacaatttcgaatagccaagttgaaaaacctgggccgcccctggaggcaaggtagccggatccgtcatgtgcggctgtgctcctgcgcccacatcgccgggcggctgcctcgacccctcccgtgatctcctcgtgccaataacctgaccagcaaatcaacaggtagcgaggacacacactgatgaatatgctgccgaagagaaggaagagacttttcttggtcaggccacggctgctatggcaacgacacctccatgccggcgtcgccggtggcgccttcgcagcgacgctcctcttcctcgtcctcgttctcctctccacctcagctccctcctcgtcgccaccgtcgttgcgggacagcagcgtcgtgtcatcaggacgaagatcctcgtcttcctcgccaccaccatctgtcaactgcgacgacatgacggcgagcctgggggagttcggcgacatgatggtgtccatgctccccaagaacctcgccttcaccgtcttcgtgccctcgccggagtcgtttcgccgcgtcctcaagctgcaacgccccaacgacagcgctaccaacgggaatggcgccgatgatgacgccacctacgccgtcgtctcccgtgtgctcggcttctccgccgtccctcgccgcctgcgcgccgcggacgtggcaccgccgcgccaccggcagcagatggtggcggtggcgcctgtcctggagtccgtgtctgggctgaggatctccgcctggaggagggacgtggacggtgcactggtcgtcaacggcgtgccgtcagagtgcgtggatatcgtcaaggagcgggatatcattgtccatgtcatggccggcgtcctcatggatgcagagtttgagcggtctttctcttcagaatttgacaattgatcaactaagcaaatcctatcatccctagagttgtcatgttggtttttgtgtaacaattaaatgtacattgttttttctttttaaaaagtatataaatttacaacgcataattcttgtgcttgaatgtaggtaattctgtttagagagattattaatagccagccggtgaaaatatgaaataaactgatttcttaatttccggcttctaatttgtttttcaattcagaatccgagtggtaatatgaattgttttgggagctgagattttggaaaaaactgcagtcaccaaaaaattctcaaataggtcatatgtttctaattgaaatgcaaaatcgggaaaatgcaacttcgaaagaaacatatagccaaacccgttttccttggaaagggatacatgacttgaacttcttcgtgatatgtcactgacatgtaggcatctgacttcacgtgagaggatccccttccgttt

SEQ ID NO: 42984 - DNA, 691 bp, Oryza sativa
accattccctgcattatgcatttggaggtttatgtgacaaacatgcgtaggaagatggagtagttacaagtggtaggtgctataaaaataaaccctgatagatgtcatccagttactttcctcatgattgctccattttttttcatttgcattactccaagaggaggcccttatagatgtcagtctcatagacaagtagtactaggttatattactcaggatgatagtaggagcagggtagaagtaggtgctatgatttttgttgatgtaaatatcgaatctacacgcacacagggaattgcaattttagttcaaaatttctgaaattttggtaatcaatatattaactgaaattttcgtattttatcaattttttgttgaatttggtcaaagtttattcaactccagtaaaaatttgttagaatttcaaaaaaaaatcagtccaaaaagtaccgaaaatcacgaaatttcataaattttggtcttaccgaaattttcgacaaatcgaaattgaaaaccctgcatgcacacttgcacagcaaattgagaaagaacaatatatcgtcattgtattaggggataagaactaagtctaaacagaatcacagccttgctacatccagcggaagtccattggcagtccagttacatgcttattctcataataagcattcgttgatgggaaaaaaaa

SEQ ID NO: 42985 - DNA, 343 bp, Oryza sativa
tcgaactgaaactgactaatgaggatattgcttgaatgcttgatgagtgtgattgactgattgtgtgattgtgtgaagtgtattggttattttagcttcatagcttgtgaaatgtgaatgactatctagattaggatttaggaaccagtgctgctttgctcaattgctctttgatattgttgtttgtaggtttgaaacatgaagagaaaaaaaggtcccatggttaatttaaagagttttgtatgctctataaatttgatatgttttgtcaattaatagtttagtactgtactctaatatgcttaacgcattcaatttatggtcaattctatccatttatgac

SEQ ID NO: 42986 - DNA, 873 bp, Oryza sativa
catctccccccgcgctctcgccgtcgccgtcgccgtcgccgtcgccgtcgcgtcggctgggcggtgggtgggagtgggagagcgggacacgcacgggtgcgagttgtgtttagctgccacggcgacgacgtgggccccacgctggcctcccgggtttctagggtgaggtcactgacatgtggggacaggtaatgctggagcccacgtgtcagtgactgttaggcaggcgggggtagtccgcgtgagaagcgtagatgccgcaagcgtggggagaagaagacgacgaggacgaggtgaggtggattagtttggagcgacctgattgggttggaattggattagtgtgtgtgctaatcttatcttaaaacaacctgcagctggctttactttcgaatatgctaaacaaaaccgatttaaaaaatttattggatacataccactacgatgtgaatattagagaatgagctaatatcaaatgattatacgagtgaggcttcgaattcaagtcggctagctcatcatcatgtggagctagctgaaacacctctagacgttttctcgatacataccattactatttaaaaaaatataattacaattcatatattcgtatccatgctatacgaatacgtacaaaataacaaccatgctatcgacgttacgttttctatcatatagaccaaaatacgctagacgtgagacccgcatgtcagttccatcttctttctctatccatcactcttctttcttcatatctctctccacctcgctgaaccaaaagtgtcaggaggcgagtaggacacgatgagggaggcgaatggagaagtggtgtccaacgcaccggtgaagcgttggtactattcaccttggttc

SEQ ID NO: 42987 - DNA, 1501 bp, Oryza sativa
taatcctgaaaatagcgacatcgctgttttgagaatggccaggacacgttagaattgcagttgttaatataggacttcagctgtaatgctttatatgatgggagaatccattcagtccataattgaacatgaatgtttttttgggttaagttctagatactctgtgtttatcatattatactgtttgtttatgtgctggtgattctgatttaatgtttacatatcagtttggcaatatcattttcacctttgaaactaccagcttctgctcgtattttgattcatctgttcatgatcttttcctacgtttttggatacagatatcagatgcaaactaagttcttaggtgtgatttttgtttcagttcttgtttgtgtcagaccaaagaatcaatgagtcaaaactaaattttgttttaactgtctttttttttttttggtggagccaatagatcagtagacattgaaaggtttagccttcgctggtgtgctgttgctccccttttcttgggtatgttttgcctgcctttagtttttgtaatagcttattatgggtttatgtagtcttttttgttgcaagaaatttgtcttctttgttgcccaaaacatacccaagcatgaagtactgtcaaggaaacaattttatgcggcgtttcgatttttacgttgtgatcaccgatcaagcattctcttattagttattacatcttcctgcgttgataagaggcaagccagtaattgagtactaaaaaaatcagtagcatggctgaaattcccagctggagttctagtttataaactgtttgttattgttgtctgaaagtagatggctttgaaagaactgtgtttgtgtttcggacagccatttcctagtataaatatgaagatgtgcaccactaaacacaaattacgaaccttaacagagatcgaaatattagtaccactgttctgcagaactattgcgacgagcaactagcctatgtcttctattttcttttgttaatggtctacttttgtgcataatgcacacgctaattaatttcgcatgggcatatctttttcaggttattttgcagttcattgcaaactgcatgtcggcagaaagggttggttagtagagttttgtatttgtagaccatctatcagttctgtatttctagacagaaattaacttgtcattcagggactggattcaatcatggttgccagttttttttttctttttttttctgtacttctagtactcctagagaagtggtaccaaaagccagaaccacaagaaggtacttgcgtcaaaagatgaaatcgtgttgccaaactgtacagtaatacaattgaactttgctactgcgtgtcaactttatcttggagttgccgtttcatgctaagaaaggggtaattctcaagttgtttactgttctgctgttcactggcgttttagctactacacaggcttgttctttacacatgtcaggcctccctatatctttggaagaccaaaa

SEQ ID NO: 42988 - DNA, 1501 bp, Oryza sativa
gatgtgcaccactaaacacaaattacgaaccttaacagagatcgaaatattagtaccactgttctgcagaactattgcgacgagcaactagcctatgtcttctattttcttttgttaatggtctacttttgtgcataatgcacacgctaattaatttcgcatgggcatatctttttcaggttattttgcagttcattgcaaactgcatgtcggcagaaagggttggttagtagagttttgtatttgtagaccatctatcagttctgtatttctagacagaaattaacttgtcattcagggactggattcaatcatggttgccagttttttttttctttttttttctgtacttctagtactcctagagaagtggtaccaaaagccagaaccacaagaaggtacttgcgtcaaaagatgaaatcgtgttgccaaactgtacagtaatacaattgaactttgctactgcgtgtcaactttatcttggagttgccgtttcatgctaagaaaggggtaattctcaagttgtttactgttctgctgttcactggcgttttagctactacacaggcttgttctttacacatgtcaggcctccctatatctttggaagaccaaaatgcagcaagggtgttgtaaaatgtactccctccgtcagcaaaaggtaatttgcttctttctggtccaaaataggggtgctggccaaatatttcctcagttgaagactatcagagcttctatcgcaatgaaagattatcagagcttctatctcctctgctttttggaggatttggaatcacaaaaacaacgttatcttcaataatcaaccaccatcaggtgcgtgaattttacatcaaagaagcagatggaccggccctagatgggtggaaggctgtcttctcaattgctatttcttcgggctcctcccatgtttaattctgtttctttctctttattatgtactagtatgctccctccttgttttcttctttcctgtattttaattacccgttgtaagcgacttggttactccattaggaggagcttatatcaatataattcaatattcgcccaaatcttcagtccttgaccaacagttttgatcccacaattgcagcagcaattggtaacaagtccacttgcttctactgcattgcttagcccacttgttaggtttgtaacatatagttttatttcttaccgataatcaagtactccatccgtttcacaatgtaagactttctaacattatccacatacatatagataataaatctaaacacacatatgtctagattcattaacatctaaatgtatgtgggcaatattagaaagtcttacattgtgaaacgaagggagtagataagtatgaagtatgaactaaatggtagtaaaacatatgcgacctttgagttaccttcctgaatgaagtatgaactacgatttccatagcagtacagcacacaaatcaaaggcctcaggttgagtctgcaggatgaaatta

SEQ ID NO: 42989 - DNA, 281 bp, Oryza sativa
gccttttcacaagggcgcgactaatgggaaataagtgaaaaagctacaaaatggtagaattgatccatgtgaatatttctcaacttttagcatctggtggcaacaccatttgcccaattttggtaactttgtcgaatgtttcagagactggatcctttataaatgctcttgcccaatgtcttcaaatcctgttggtgaagcacaaaaatatacatgcaattgtgtagctaactctgaatatgcaatctcctcaagttttttcaggaactgtcttgtccagg

SEQ ID NO: 42990 - DNA, 1501 bp, Oryza sativa
gaagatgtattaacatgtgatatgtcattctgtaaacatgcaagtacaaattcaacttttacatctcgcaacggaaaaaacaaatttgattgtagtttaatttatttttttcgttgcgagatgtagaaattaaatttgaacttgcatgtttgtggagtgatatatcacatattaatatatcttcttaatttttttaaaaaaattttcataactatttgaataacatgcaaataatgagaggaagacccctcccataagaaaacaaatcttgaaaaaagccaaatagtgatcctggaggaagagcaccttcttttccagacatgaagcatgcaactccaagcaaaaagaaaacatgtgtatgtgtaatagtttagcactatggaatctgacgcttccaatggagtagtaccgaccgacgaccggctatgtgggtgtgtaagtgtaacaaccgtagatgtgtgacatgtgtcccccgtacattaccaacggacggatggaaagagtgatggtcctccacggtactgcacactgatatgtggaccccacagatatttggatctacagccaataagtagtactgcagagaacatggattgggatagaaagagagctcatagttttatctcatgttgataatggatattagaggcatccatacagtcatactagtatctttgatatgtacattgttaaaaactgttaactagtaaggtgatgtgatcatagttgctattgatataacattaacaaaccctgtgctccactcgagacactcatggctatgattggcccgatttttcgatgagttgaagataactatgatttgagagaaacgttgatgacccaactacagccgtacgaggtgttgttgcgttgcgtcttagtgattgatacaccgatgcagatcaaccttattgctacaagcaaatcgaagaaacaagcaataacaagataaaagcaatctgaattgcaaataggaattgaaaacaaatgataagttgggttccgaagacaaacaaacggactagccgacatgcgcgatgtaagaaagtaacaatgactaaactttaatctatacaaaacccgaaaaaccctaaatggtacctagctatttaagaaggtggggggacaaccaaagggtccgtagggtcgtgctccattaggtttgggcgcaccctacatgggtcctagttgggccgggatcccaaatgaagttacaagcctaatggcccaagataggtaggcatcaccttatttcttcaattgcaaatgactaacatgtaatttggtgatgaggctggatcctttggaaagaggacttcgagagtttttcatcaagtactcatggatcggaaacgaagatcgtatgcatatttggcggccgtttgaagtcaacgttgctgcagttggccgaattggattctagagtgtgggcagcttgtctccctactgtgctatgatatgagcaacggttatatcaatagcaactatggtgcggcac

SEQ ID NO: 42991 - DNA, 425 bp, Oryza sativa
actttgcgcatgaaaaaaaagaaaaaacaggctgcaattccacccaataagttggaacaaatatataattccgtacataattgcaatgcagaagaagatgtgtgcaaggaagaagaaagaaaaatctatacctgcaactcccattgcaaaaggagatgagctgccgccgggaatcatccgcgacgacggccccgggaacccgccgctgccgctgctgctgccaacctcgaaaagtggcatggtaggcgagaactccccgaagtcggtcaccggcggcgacggcgacggcgcgggtaggcggaagaacggcgagagcataggtggtccagttccgccgccgccgccgccgccgctgcggacgggggaggcggcgtcccacgcggcgagcggcgcgccacgcagcgggcgcgggctccagcggaagg

SEQ ID NO: 42992 - DNA, 1501 bp, Oryza sativa
ggccaagccggttttatcgaccaaaaatccggggatttccagtgtgcattcgagccgcgcgcggcggcgagaaaacgcgaggtgataggagaaaattcaacgaagcagagatgcctgcagggtgctgtacctggagctcggtggtgacggggtactcgtccatgtcgacgtagttcttgttgatggcggccatgatgagcttgtcgcactcgggctccatccacgtggtgacgaacgacgccaggttcagccgcgggttgccgtccagcatcagctcgtcgttgatgatctggtacgccgcctccttcgggatcgagttctccggcatccggtacctaataacaccaatcgatcaatcccatcgagtcagccatgaaatattggaagaagctctgcattgggccaagaacagcaagaacagagagagagcagatcgagagcacgtaccttgggagggaggcgcggacgtagcgggaggcgaaggtggagtgcacggacatgtcactctcggagacggccttggagagcaccatcttgcctgccgagctatcaacctgctcctcctggtggctttagcctcggtggcgatcagacgaagaagaagaagaagaagaagaagaagcagaggtggctagaggagagccaggtcgagaaggctctgtggcgcgcttctactaagctcttttcggggggggacttgaacgaaacggatgcgagttgttttggtgtggttggaggcagggggcagcgccgggttttataccgcaaaaaatagtgacgcggcggagacggagcacaacaaacgccgaaagggacggaaggagagagggacggacggaagcagtggccgctccgtcattgcccgctctcgctgggtctagaggaagcgactttgaaaagggggaaaagtcaagcagcgacggtcgactgagcgagcgagcgagcgagctgccaggcgcgaggccgcgagccttcgtcgcgcagacaaatcgccgtgtgctgtcgttacttgattcggtaaatggacacttttgatttggttccgttttcactagttggtcaaaaaatgggcactggtgtgtaactgcgtaattgtccaatgaatagggaaacaaactaacctgtcagtactcagtactcgtgagagagagagagagagagagagagagagagagagacggtgcacagtcttcttaaaaccaaaaagaaaaatctgaccatgaatagtcaaataaacaaaggaactgttgatctgtaaaacacatgctcctctgatcaaataatatgaagatatttttaggtcgttctggtgtgaattggaccgtgattatttattaagataaatttatgaaagtctattctgaccataaatggtcaaataaataaaagcatcgttgatctgtaaccaaaatatacgcatacatttttaggtcacaatgatgatactttaatcacaacccctccatccgtttcgtattacttgtcaatctagcaattttcg

SEQ ID NO: 42993 - DNA, 1043 bp, Oryza sativa
taatgggaactctagctggaaaacttgattgagggtcagacggcagtgtttggcacaaccatcacttgctgactgataagatcatgtggacgccgcgattgtgctattgtctttaaagaaattaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctatgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaagga

SEQ ID NO: 42994 - DNA, 1501 bp, Oryza sativa
gtcaggtgaacaacacataggatcccggatgggtcatgaccgaaataacatactttaacaagtttaggatctaaaaatgtattttgagagttagaatacttatatgacacaggagaccggcagtgtactttactcttaattttgtataagtatttaaataagagtataagaggacaaaaatcatttttatttctggtgtatataatatttcgtcttatctcttactagctggtacaagtaaccagtactccctctggtaaaacaaaaatacatcatttgattttctttcaatcatactagaattttgatcatcaataaatttcaaaatacttaagtctaaatcataaaaaatgatatatgtagctttgtcttgataaaaatactacctccatcttaaaagaagtacacttttatccatgaatttaaactttattttggcaccaaagtagtacgctaataatccataaactaattaaactttttgtaactaatatgggtagaccagtacttagccacttctttatattttgtccgaaaattgctagattgacaagtaatacgaaacggatggaggggttgtgattaaagtatcatcattgtgacctaaaaatgtatgcgtatattttggttacagatcaacgatgcttttatttatttgaccatttatggtcagaatagactttcataaatttatcttaataaataatcacggtccaattcacaccagaacgacctaaaaatatcttcatattatttgatcagaggagcatgtgttttacagatcaacagttcctttgtttatttgactattcatggtcagatttttctttttggttttaagaagactgtgcaccgtctctctctctctctctctctctctctctctctctcacgagtactgagtactgacaggttagtttgtttccctattcattggacaattacgcagttacacaccagtgcccattttttgaccaactagtgaaaacggaaccaaatcaaaagtgtccatttaccgaatcaagtaacgacagcacacggcgatttgtctgcgcgacgaaggctcgcggcctcgcgcctggcagctcgctcgctcgctcgctcagtcgaccgtcgctgcttgacttttcccccttttcaaagtcgcttcctctagacccagcgagagcgggcaatgacggagcggccactgcttccgtccgtccctctctccttccgtccctttcggcgtttgttgtgctccgtctccgccgcgtcactattttttgcggtataaaacccggcgctgccccctgcctccaaccacaccaaaacaactcgcatccgtttcgttcaagtccccccccgaaaagagcttagtagaagcgcgccacagagccttctcgacctggctctcctctagccacctctgcttcttcttcttcttcttcttcttcttcgtctgatcgccaccgaggctaaagccaccaggaggagcaggttgatagctcggcaggcaaga

SEQ ID NO: 42995 - DNA, 517 bp, Oryza sativa
cacgtggcgtgccacgtaggcaaaaccacggtcaaaagtggctttggacctgaatgatacaataaatcaagtttaaggatctcgatgtgcgctttgcaagttcgtggacctaagtgaaatctcctgacaagtttaaggaccgttggtgcattttactcaaaattaattgatccatgacacataagccccctcatctagaggttcacaaactgcttaacattcagagacatccatcatatggagttgtttaatcagcatcaagaaccgcgtgtaacttattatgatggttatgcaccaaactttcattataatgtctatcagttccgaaggaaaaaaatatgttaatacgattttccatgttttgcacgagcagctacacgagaaaatagcacgagagttttggtagtacaaaattgggccaactcgctgccagccacactactagagataagataggtgtctaggttcgatgaaccacaagcggtaccgaccgtgaccggtccgtgttgtggataga

SEQ ID NO: 42996 - DNA, 1501 bp, Oryza sativa
aggaagagagagagagagagatgcgtgtgtccaaggaattgccgactaattgagcttttctgcaacgcggtaaaaaaagaagggaaaaggaaagctaagcgcacgcagggatgctgcagcagcagggagaggggggggggggggggggggtaaccacgctcgtgatgattatactcgctcgcctggtgcagtagaaaaaagacgggcgagctgtgatgctgtgtgttcatcagaatcggcgcccgtttcctgcgccgcatcattctgcctttcggatcttttttcactcacaatctttgctccatttcgtgctacagtagctgttactactaccctcctgttggctgttaggctgtgtttagtttcaccggcaaaaaatttgccgggtcgcatcagatatacggacacacatttgaagtattaaacgtagactaataacaaaacaaattacataatatgtatgtaagttgcgagacaaatttattaaacgtaattaatccgtcattaacaaatgtttactgtagtcccacattgtccgatcatagcataattagacttaaaagattcgtctcgtaatttacacgtaaattatgtaattagttttttttaatatttaatactccgtaaatgtgttcaaacgttcgatgtgatggggaaataaaatttgctgatggccccccttgtaaaatcaaaggtgtttttgattattattctgtgatgaacaattgggcatcgtagattattggttttgttatttggaatctattcacgaagtggttttggagatgattggatttcacatgtgatcgcaggattcgtcattttatgtgaccggtcagaccgggctgtgtatgccggtcagaccggcggtgatcgagcggtcgaaccggccagcccgcggtttgaccggccgacactgtgtcggtttcggtttcgggttgtttgtttggatatccgtgattatttcatgattatgacttctagatggatactatacgtatgtaatactgttgtttgctactaatgagttaagttggagatagcttggtatcggaatatggtttctttgtttatttcatgtgtatgtgactcgatgcctcgggacagtatttgcggtgatggaccgggagtcggcttgggaataagacgacgtccgtggtggtcagagatcatgcgggatacttaggctagagttgatgcacgttgttgatggagatttcatatggcatacgatggaggtattgtgtgcgtatgggatgcggagtcaaatttggaaggagtccaaatttggtacgattggttatgtaaagtttctttcttgtactagagggtttcctaaagtgtttaggacttctagtatgagtttggttcgtggctttaggctgcctacctcgggtataaatagagggggagcgtgaggcttcccggtatcgctttagagagcaattgagttgagttttgagttaggatttcgagtttagtcgaaattttcgtaaggagt

SEQ ID NO: 42997 - DNA, 1501 bp, Oryza sativa
agcaagaaatagtatgaacataagaatttgatggaatgtctagagctgcttggggagcaccgcatattatggtttacaaggcgctccctcaaaaggcccaagtgggcatcaaatgcccatctgtatgcacctcctaactaagccaggacagtatgcacaactgaagtggccactcaaagaggaacatggaatggaagccattggtttatcatagcacatgcacgatgcaattcgcaatgtatataaactaaagatatatatgttggtttatcatagcacatgcacgatgcaattcgcaatggaatataagacatatgtggagtccatctaagaaaggatcaatggaaatttcctttccctaatatattatggattcaaactttgttatatgcccctgtctgaaccgcctgcgcattttgccacaaaacaattcgcaaccggttattcaagaagcaatcttttccccgttcctgatctaaaaaaaaaaaagaaccccttcgataatcccccaaacacgggtagagtcctatgtatacaccgacgacagatctgaccaatctagcagctaaatacgccaatacaagagggagggcacttcctgatcctacatcccaccaaacgctaaacgtgagaccacgaatcgcccaatcgcgcggcgcagatcgatccgaatcgaaaatctacccaatccaaacgaaggccacagatccgaacaagaacaacaacgggcgcgttcaacgcgagaacccaatcccaaacgccgcatggctactggggctaggggggagagagaggatgggggttacctgagctgcggcgagccatggcggtcggcggcggaggagaagacgaaaccctagatggcggcgcggcgaggaggggagcgagcgaatgaagagggcagcaacgggtcgggaggttgaacggcagccacgcctagggttaggcttttatagccgcgagtccggatttttttttcttttttttttacccgttcttgctctctctctctctctctctccaacctcccaccttcttgcaagacacgccaagctgacatgtggggccagaaatctgcggtgacatgtggggccattacttgtggggtccacatgtcggcggcacgcaagctggctgggagcctttgaccgttggaggggatatgctcggaacactctggattcctccagatgaccggaagcagcacgaagccgtgaacggctacgttttcatttttcgtgctcccgtgatgataaggtgaaaaatgattcgtgattcttccgatttgtacaaaatgaattgagcaatttagtcaaaaatattaagctcaaattagcatgcatttataaatgccagatgaaatatctctaattaataatcttctagaaatctcaaactaatatccatattaaggtttggtccaaccagctagatcccacacacacaaccaaacgcatgttgcaattgcacacaccattggcattgaaaacaaaagagtatg

SEQ ID NO: 42998 - DNA, 1501 bp, Oryza sativa
atggtggtggaggggaatggccgcgccgactcgatcaccattggcgtctgcgtcatggagaagaaggtcggggggatcttgccgccctttggttctaggactctcgttttcttttctttttcttcttcttctcttctttttttttgggtggttcacgtgatccgcgaacgcatggatatggctgtttgatttggttttcctttcgttttttttccttttcgatctctcctgtgttcactaatcacttatctgttctttcttttggacgtctctggttccttgatcgattcgtgctgttgccgtgcgtttctggttcttgatttgattcgccttgttgccgttactgcggctgcctattgattgatttggccggttcttgaggaatgaggtttctagtcgcgccgctggttcttgactatgattatgatatggtctaatcaatctcttgattttttttttgtttttctctgcaggtgttctgctctcctatggagcagattcttgagaggctccgtgcatttggagaattcgaggtacgcgagatttttttttccaagccgtttctctttctttgttcgatcaatttgcaaaagtggaaacgggtgtgcgattgaagcttgtcatgtggatcagtggatgggtggatggaattgcatacgataaattttcttctttttggtaaaaaaaattgctttttcgaaatattttatggcgagacatccgtgaatctttgtggataccaatttattctgcatcttttctttgtggataccagtacttgaggtccccatcatgtggttgcttttgcggtttgtccccaaatgttttgtcttatagcaactaggtcccttaatctgtactggacacgagtgatctctcagtttctttgcaatattctttttgggtggacttaagttcgcctactttgctttaccgataatttagccactattgtcaattaaatatttgaatgttagcacttgagtactccatatcccccattttttatgcaccaatgttgactccttttaagtatataagctattgagcggtgctttaatatgaaccgggattccctatcaattaaacaatggtgtgaaatgcaatggaaatcttaactttctgcagacgataaggcatcggatttggtccacggcatgcatatattaatccatttgcatgttgttctttgcattctactcgggaccactgaccacttcgtcattctttatgcattaccgtagttcgagctacatcacatgtcactaattactccttgcttccattaattcatcatgttgcttcttttgttttatgttccatacttcatatattttatcaaacctgttgataaacctggactgtacttattattttacgcttcaaatttctctattttttatctcaggcatacttaatctcattattaattactctatctgaacttcattttattaattgatgtttaagttatgtgcagaaagttgaaatgtttcagatc

SEQ ID NO: 42999 - DNA, 1501 bp, Oryza sativa
atgaatagtccatatggttgtatttagtttacatttaaatataactatttgggcattttttgaatgagaatgcatgacatttatatgaaaaccagtgcaacgtatggtactacactagcaaaagcttaaaataagacgtaagataatattgaagaggaacaaacagaacttcaaaaataaaaggaacacttccttgacgccggcctagttgtctaaatgttgtataagaatcatcatgtacattccaagaaaaatgatacgacaaattataataaaaattttgagaagtgctctataaatcattttagaaacagggatgtatttgctaaatcataatagaatttatgccaacataacaatgtagaaggaaacagttcataccttcgtaaagcagcataagcctcagcttttttaagagggaaaccagatgaatagaaggcaatcaagcaatcgcattttggccaactggacataaaatgcagataagtgagacattactcgtaaacttacagccaagcatgcactacatttatgccataaaaaaatactacagaagtagtgtggataaacctatacttgaaaagaacaatgattaagttatcaataacctgagttgtcattacatacatctcaataggatcctcgagaataactttatccccaaatattataatctgcaagacaaataaataatgctgaatgacaattgatctgaaacatttcaactttctgcacataacttaaacatcaattaataaaatgaagttcagatagagtaattaataatgagattaagtatgcctgagataaaaaatagagaaatttgaagcgtaaaataataagtacagtccaggtttatcaacaggtttgataaaatatatgaagtatggaacataaaacaaaagaagcaacatgatgaattaatggaagcaaggagtaattagtgacatgtgatgtagctcgaactacggtaatgcataaagaatgacgaagtggtcagtggtcccgagtagaatgcaaagaacaacatgcaaatggattaatatatgcatgccgtggaccaaatccgatgccttatcgtctgcagaaagttaagatttccattgcatttcacaccattgtttaattgatagggaatcccggttcatattaaagcaccgctcaatagcttatatacttaaaaggagtcaacattggtgcataaaaaatgggggatatggagtactcaagtgctaacattcaaatatttaattgacaatagtggctaaattatcggtaaagcaaagtaggcgaacttaagtccacccaaaaagaatattgcaaagaaactgagagatcactcgtgtccagtacagattaagggacctagttgctataagacaaaacatttggggacaaaccgcaaaagcaaccacatgatggggacctcaagtactggtatccacaaagaaaagatgcagaataaattggtatccacaaagattcacggatgtctcgccat

SEQ ID NO: 43000 - DNA, 1501 bp, Oryza sativa
tgtcctatcattctgggagttgggcggtgggagtttagtcacgttcatacgtcgccttaacttcccactttcctcccggtctccgaggcactgcgggctcgggagtttagcccataccttaggtcgtgaacttatttcctgtatatactcagcaaatgttgttagactctctcgggcccgtgaccttacgccgcgtaccttgcttgcccctgcctcttgttaacctctgttcgtgttatacttcatctattcaaaacgattatttttgcgtgagcgtggggactgaactttccatagtcaacaatctttacccgcgatcaagccaggctgggcgccgtagccagctggtggggccaaaactagctgctatggaagagccagcacaggggaccccaggcgtcgacggcgaccagagctcgacgcagggctaggatagagctaggaatcatagctcccacacttctagcaaagaatcgtttgaatggatgaggtgaatacaaactttttgttaccaagggaggcaagccagcgcgcgacacgtgggtaccgcgggaccgcgaggaagagatgggcgagagataaacataagcaataataattctatgcaaatgatcatctttgcgcgagtgcgaggactaaattttccatagccaacaatcttcacccacgatcaagccaagctgggcgctgtagccagccgacggggccaaaaccagccgctacggaagagccagcacagggggacccagacgtcgacggcgcccaaagctcgacgcagggctaggatagagctaggaatcgtagcccccatacttttagcaaagaatcgtttgtatgaatgaagcaaacacaaaccttgcttgcatgtcgcgacctttcaaacctttagcttgaagagggcctccctccatgggtccctaaccactttgggaagcctgcgaccacttagcaaacgaggttaggttcccacaagcctgtgtccccacgctacacattctgtttgatctttcctttcggtggcctcctttcaatatctcttccttctacacggacgactactttcgcccgtgtgtgagagccgaaaaactctagagccagcgatccccgtccacagttgagccaggccgggcaccgtagccaaccggtgggaccaaagctagccgctacggaagagccagcacagggggtcccgggcttcgacggcacccgacactcaacttaaggctagaatagggctagaaaacttagcccccacacctagcgaggaaacattcatgtagatgggagagaggttgggcttttaccaccgagggagcaaacaaatgcgcaacacgcgagcgtcatatggccatgagaaaagaacgggggaaaataaatataagacttcaagctgtattaagctgatgaattgaaaaaatgaaaatacttgaagcttgaaaggacgattagttgagccgggccgagcaccgtagccagccggcgggaccaaaactagccgcta

SEQ ID NO: 43001 - DNA, 1501 bp, Oryza sativa
agttgtttaactttttttctaatcaaacttctcttagtttgactaagtttatagaaaaatagagtagtattttgaacacaaaacaaatatattatcaaaatacatcaaatttttaatttaatgaaactaatttaataatttaaatgttgctagaattttttataaacttggtcaaacttaacaaagtttgactaggaaaaaaaatcaaacggcttataatatgaaatacgtagggagtaatacactaagacagagaccttttgtcatgtatttgcttccggaaaaatttattttagggtaagacctcacaaaatgaactaccaaatatagctatcaaaattacattcttcctttaaaatatggtcaataaagactggtggaatcgacaaccaattcgatgtttcgcccgtcacgcatccatgactaccaaatgagcagcttttattcgccgatcgctgcacccattggaccttcatttcccaggaagtacgtctttaacatgttcttgaggtcttggatcattgtcccatagatagaacggtttactccaatctgtgttagcatccccaccacctccaaactatctgtttcaataagagcaagtttaatagtatagccgatcgctggctccaaaaatctccacatcagtaatagaaatagtgaataaaagtagtatgtgtacaataagtagatgtaaaattatctacacccaatttgctatgtgttgacgtttttttgtggccaacacaatatcacctaatgatttgcggtgtaaacaatagagtcgccaaaatcgatagatcaaaatcggctagtgaaaccgatttcgagattaattcactttcgcggaatcacacgactaatttacaagcaaattagcaaagaggataaatatcgtacttacgtgacgatgaacgactagtttccgagcaactagcaaaggataatcttctcgttttttggagaagcacgaccgtttttcagcgcaaaacggcaaagattaactaaattctagggttgtcaaaactcagccatgaaaacaaaatagaaaataacaggaaagtaaataacaggaaaatagtagattgataattttgttcggggtttcctctaatctgtcgtcaccagtatatatactggtcactctaatcaatctttaacaatcctaattgatcccacaaaaatatggaaaagtttaatcggaaaggaaacaaactaaccggctaatccgtttctatctatcttgccgcaacacgcgctaaccggcttcatcagctctaacacgccacgccagcaccagcagccagcctaatgcatccataaaatcagatgaccacatccatccatccatctgcttctgtttaatcaccgtcatgcagaccatcgagcaacaagctagcaccagatttaaccttccagtgcaccaaataatcctgcacacatataaattgcgctactcttataattaaaccactaaacaatcacaccaactattttacat

SEQ ID NO: 43002 - DNA, 433 bp, Oryza sativa
accatggcctatacataatttttattaagatctctagtaaattattaaggagcgtgttgtgtatgcatggcactatggcccaaatataataaatcgtgaagacatgaattaattgaggggatatatataagcttcttttgtatatacggacgttctaatatattgacgtgcaatcctttggcgcgttcgaaaaaaagtatatacatatgtttcttcacttatccaatagtggcattctcctcgttttctatatgctctctcatgaaattcattgcctgctgacacatgcattcgtagtttcctactccctctggtatcaaatatatggatgtttgagggttgtgctctttggatgcaaattattgacgttttggtatttgattgccactttggactgctatacctttgcatgcatgtaatgcttgtcttcagt

SEQ ID NO: 43003 - DNA, 1501 bp, Oryza sativa
gtgggcccaccattggctagccaaatagagtggtcaaatttggctagtggaaggagggttttggccagctggaaggcttagccatctggttggagaggctgttggagcgctttttaagctagaataactaaaatttggcttgaagagtgggatgtggaggctgttggagatgctttaggaccttgagttaggtagctcaagatcattccatttgtccattttcaaatttttcaaccatgcgaagtcacccaattgacttggaactagtgatttccatcggtttcagctctgtcctccaacattacggtttcgttcgattcagtagtttggctgagatgatagacattataaaaaacgatttgagtcaatagtacatgattaattaaatattataacattaaaattgtatttatttaattttttaaagaaacttctatatagatgtaggagcagatattttgaggtaaaaatttaacttgcattatataaagctagattattttttagtacaatagatatagccataaatctcaaccttcaacaacattgaacttttgaaccaaatttcaaaccttttggcaccaggcctaaaatgaaccaattcataaaacaaaaagatcgtacaaaacttgtacatggcaaacgttagcggtgaaaacgattcggataatatctgatctgatccgcttcgaatccgtccgaaacgaggatatagtatgggcttttagaaatccggcggatatcgaatccgtccgaaacgaggatatagtatgggcttttagaaatccggcggatatcgaatccgtccgaaacgaggatatagtatgggcttttagaaatccggcggatatggatgcggatatgatatctctaaaatccggcggatgcggattatccgacatttttatcggattatccaataagctgtttgccgaataatccgaaattatcaacatatataaccactctatctattgcatataacataagttggtacatccaataccctaattcatcaattaacaaagattttttagtctaaggtttttatcgtctcatgtcacactcacgtagctatattttttatattatgaacatcatgtgtttatgttgtttagcacttaatcatataattattacgatggatcatttattgattattgtatcgttgttccttggatttctaactggatgttgcattgatcgcatatacacgtagcatccgataaatttaatctgtttccgaactgattccacactgactccgcaccatttctgacatctgaaacaatccgctccgcatccgcatccgtacattatttgcatctgctccgaatccactcaaaaaaaatatgggttaggatatagtatgaccactatccgttcgaattcgctccgttttcacccttcgcaaacgtgcccttaagacattttgtctcaacaaaaaaagcgcgtgcaagtcagtggcgacgaagatatagcaaaaatatcatgacgcagt

SEQ ID NO: 43004 - DNA, 1501 bp, Oryza sativa
tgctatatcttcgtcgccactgacttgcacgcgctttttttgttgagacaaaatgtcttaagggcacgtttgcgaagggtgaaaacggagcgaattcgaacggatagtggtcatactatatcctaacccatattttttttgagtggattcggagcagatgcaaataatgtacggatgcggatgcggagcggattgtttcagatgtcagaaatggtgcggagtcagtgtggaatcagttcggaaacagattaaatttatcggatgctacgtgtatatgcgatcaatgcaacatccagttagaaatccaaggaacaacgatacaataatcaataaatgatccatcgtaataattatatgattaagtgctaaacaacataaacacatgatgttcataatataaaaaatatagctacgtgagtgtgacatgagacgataaaaaccttagactaaaaaatctttgttaattgatgaattagggtattggatgtaccaacttatgttatatgcaatagatagagtggttatatatgttgataatttcggattattcggcaaacagcttattggataatccgataaaaatgtcggataatccgcatccgccggattttagagatatcatatccgcatccatatccgccggatttctaaaagcccatactatatcctcgtttcggacggattcgatatccgccggatttctaaaagcccatactatatcctcgtttcggacggattcgatatccgccggatttctaaaagcccatactatatcctcgtttcggacggattcgaagcggatcagatcagatattatccgaatcgttttcaccgctaacgtttgccatgtacaagttttgtacgatctttttgttttatgaattggttcattttaggcctggtgccaaaaggtttgaaatttggttcaaaagttcaatgttgttgaaggttgagatttatggctatatctattgtactaaaaaataatctagctttatataatgcaagttaaatttttacctcaaaatatctgctcctacatctatatagaagtttctttaaaaaattaaataaatacaattttaatgttataatatttaattaatcatgtactattgactcaaatcgttttttataatgtctatcatctcagccaaactactgaatcgaacgaaaccgtaatgttggaggacagagctgaaaccgatggaaatcactagttccaagtcaattgggtgacttcgcatggttgaaaaatttgaaaatggacaaatggaatgatcttgagctacctaactcaaggtcctaaagcatctccaacagcctccacatcccactcttcaagccaaattttagttattctagcttaaaaagcgctccaacagcctctccaaccagatggctaagccttccagctggccaaaaccctccttccactagccaaatttgaccactctatttggctagccaatggtgggcccacacagccaatctcctccat

SEQ ID NO: 43005 - DNA, 1501 bp, Oryza sativa
tttatatgtgtagaaaaattttagtgtgatgaaaaagttaaaagtctaaagaaaaagttacgaactaaacctggcctcggttagattgctgagaattcatttcacgaaatgtcacagccaaccctaagctcaatcatgtacagagaccgaagaggattttaactcttgcacgcaataaaaccttgtgccatctcagtcaaagtctacttcctaattggacacatcatataaattaaataccttctgttctgtactgtgtgtcctactccctccgtatcattttaagtgcaaccataaattttcatagccaactttgatattccgtcttattttttaaaaaatatgattagtatttttattgttattagatgataaaacatgaataatattttatgcgtgacttatacttttattttttttaataaaacaaactattaaagttagacacgaaaaattatgactatacttaaattaggaccgagggagtgctttagattcagttgagctagctcgatcacatccacgatgaccagttaatcagagtccacttaatttcaaggtcagcatgtggccatgggctccattgattcttctactcctaccttgtcaacatgagattgagacttgacttgagagagtgtgtaaagtgacgacatgaacccccaaaaaaaaaacaacaacaaaaaaaaaactgtagttgaaacagagaggaaagagtgtggactgaaatggacagaaggccaggaatctaggcaaacgtatgtacggcttatggatagatagcaagaccgacacttgtaatggcgtcgaaactattcaccgtccttttctgacctgtcgagtagcaaaattaatttgtgtggactgttgttagcgcatccccatcaagagccgtcagtgttctatctttgtgtgatgaatgccaacagcttagaaaaacaatgagtagaacgagattttaaaggggaactaacattgttagtttagtaaaatatgcaaagcatccggatgcatatatatgaattgaacttcatggttatagctaagtaccaatatatatagtacatgaagttgctaaatgctaagtgaggagcatttcagaatggaggtagcaagactaacctttgttattcaactggttattagcaacactctagtcggtatcatcaaacgttccatctttcaatccggcaaatctgcaaattttgggttactatcaaggatgggcctatgtggttgccctgtttttggttgggctagtggacaactttgctccatccatctttctctgtcggctgagcccatgcaaccttcgcctcctcctctgttcaacttcgtttataaccatcttgccttctactaatctgcacttctgcagttaacaggtcaaaaatagcactccctccagttccatgattcttgtcattttgtacaatatcacgatctcttcatcaaagttctaatagtttaaccacaactttatccaaaacaagaagaatta

SEQ ID NO: 43006 - DNA, 1501 bp, Oryza sativa
gctccatgggagaggtgacacctgtgcccgcctccagcgctccatgcccccggtaccatccgagcacgatccctccggcagaacttctgccggagaagggacgcatggttaattggttcgttctctttacgttgcaacccattcatttgtcaagaatcatcactgtgagtgtcgagggttattacagattgcaggatcactaatgctcttttttgcccaaaaggtgttcaacgaaatgctgcttagccaatgtattaccagaaattgatttctctgtaagtgagaatgtcatattgtcatgtcccctatgttgttatttatactaatgattgcaggattctctctgttgttatttatgctaatgtaatgaaatatccaattactatgtatagactctagggctatgaactgctgggaagttgagagtgttgctaccaagcagaaagattcaaattatatgttggagcaaactaatttggatcttgcagtctcaaaactaatctggtccttgattgtttcagagtggatgaaaataaaaaatggaacgatgcagtgaagattatgtaagcaatgttcgtgatatatcgatcctgaaattctcatagatggccattgcacaaatacaaaaatttgcaggttattaattagtgaactacatctctgtaaatctgcataacatatgttaaagctagcccaagaattaatatgttgtaaatctgctctacagttgacactgcttacattttctactattaataaccctcagttgtgatagatctgataccttcttaaaaatttgaactgagttttcatacctagcagtaggactaacattttatggttgtattgttcagctcaagatgaacaaccacaccaaccccaagatcaccaactaagcctatcctgcttcatgattgttgctgcatactccaacatgcttgctgctggtgcaatctgagccggctggtggcagatgggagcctgccctatgttgttagcagctttcttcactccaagtcatgcttgctgcctgtggtcttggtagtttcttttttgtgttgtcaatttaattattaggatttcccatgtgctcggttattggtgttcttgtatctgtttgtttcagggtgtcattactatggagtagatcatattttttttcttattttttccaatgccttgtaaaataaccaactagcagggatgttcataaatttcccccttttgtttggtttttttcagacatatatataatgaaggcatatatacacaaaaggaggagctgtttgagggtctaaaggacaatagctcaattgactgggaagttgttgtcatatgtcgagagcaatctgctaaatgttaaagaggtgcatctaacttttgtacccagtgaactgcaaatctgcaccttctcttttttgattaatagtttctttggattcagatcaaaatagctcaacatgggaatttttctagcagaggatgggcaattctcggaaaa

SEQ ID NO: 43007 - DNA, 1501 bp, Oryza sativa
actcggaaaaaaaaaggaattggctgatgttttccctcgttatgcatgctcacacacttttatatcctgtgcgaatgcaaaaaatcatgcttgaagtgtttatactttatagtgataaaaacaaattttaaaaattaattaattaatcttttaagtataacaaatagttaaatgtgtctctaaaattaacgatgtcaattatttattagtagtactatgcaacatatcgtaccatccaatatataaaccactccaatagtaaatcttttggaccagatattaatttcaaggtcatgtggaggtttaattgcatatatgctagtactatagaaatctaagcattagatctggggttgctaaccaatccaattaacaaaagacagccattttgctggctaattctcctgcagcacgtgcccaacaccgaacccgacatcccatttacttttaagcaattttcacaaaactcatatattatactcccttcgtcctaaattacaatgtataaatttttacacatgttttaatgacatactttaaccaataatttattatattttatattcctagcagatataaaattaacatcacattaaagcactttaaaatatgaatctagttttttactgaaagttaaactatgaatctagtgatataacatacataatatttagcataaatatatggttaatatgcttattagtcaaaaactaccaagtttgatcttcctaaaaagaaataggacatcctataatttaggatggagggagtagtccaatttgttttataaccattataaccttatagagtcataaaccacaacattaaacattttttctttgactagtaaggtgcccgtgcgttgcaacgggaaatgctatatatcaatttcaaattatattaagtgaaaagatattaaataatcattgagtgaaaatttattgaacacggaaaaaaaatctggcaatccaaaaaaactacaaatcataattgttctatagattactttcaaagcaagaaatatgttatcattatagaagtatagtgcaaactttctgccacatatataaaacaatctcatggtgtttattaaattataaaaagacaacatagatagaagactttcttatggatgatcacctcaaaattaaattactacatataggtaaataactattctaatgttgtgcacttgcgatacacttaaaaaatcccgtgcaccgctagggtgttgctttcacactcattttgttggtacatcagtagatttagcaaaaaaaaaattgccttagctcgtcaccatcctggacatgttaaatatttataattataaaatatagttacaagcccgcgctagcgctatggtgacgatttatatcgtaaatgaaacaatcataagattggctattaagtatgtcgacgtttgatgtcacgactacagtatttggacagtatggggatcgttggtgctaggatatatgcgagactgaggtaaaagaga

SEQ ID NO: 43008 - DNA, 1501 bp, Oryza sativa
taaaaacctcacccggccccggccctgtgggggaaattgctatccctatattcgagtatgttaaatccgagtaaaccaaaatagtaaaaaaatgttaacgaactagccgtttcaatacttctatccacattatagcagtttaaaaaaacaagtatgtgaggtggtgttggcggtgggatacatgttgagttgtctttttttttctctctctaaatttgtaagagaaaattagtgatgtgtatgtagattacctaatactacctctgtcataaaataattgtgattctaagttatttagtacacattaagatttaaaaagaaaaaaaatatgataccccttattaaatgatgtataggtaagagtaaaaaggtagttgagggtaaaatatggagacatttgaatgatatgtgattaataggaccattagtattctattgtgacaattattttagtacaaatttaaatcacagaaatagaattattacgacacaaaagtagtatttacttatgaaatggaatcaatggttattatccaagccctctgctttgtagtagtagctacaaaatgactcatgtaatttcgttttctcattttaaatttcggagattatgatgcattgctggttggctaaggatgaaatcaggagcgttgattacgctaatctgatcaaagcatctcaaaacctgccttgaagcaattaagcaactttcaatgtaacaactccagtatttcttgttccatcccctgtccaaagcaattcatcaattaggagcgtctagctagttccataaaaagcaactactaggagtgtccagctagttcaatataaaaagtatatgatcggctatgattatgtctaccttatgttaaattagctccaataattgattattatttttgaatttaaaatcactcgagaacgatcaaataaacccgatcggtatatagcagcaagtcattagttggtactggtagcacgcgtcatgatagacaaacgtggataaccttgctatttggacagaaccaaacaatattcttgtaccacagctttattaccattgaaaaaaacatatgaaaatacatagttggcacacccttttaaaatagtattgttttaatgataacagtaaaccactataaaaatatatataattaaacaaatacattgtcccatgagaactatatagtaagtttgtcttaacaaatttagagctagcgggctacaaatagcgaaataaaaattcgtcgacaggtgattagcccttctcatcttccacgtacatacatgacaacaatcgcatttatgttagccctatcgtgctataataactaatggcggtagaattagaccgttgcatgtctccgttatagtataacttttagttgtgacgtgaactccaaccaatttacgtgcatgcatgggaaacgtttgcgtttctaatactctagcatgacgtgtattcatgcacgacattcgtctgtaactgttcacgtgtagg

SEQ ID NO: 43009 - DNA, 1501 bp, Oryza sativa
tatttaataaatttatttttcaagtttacaatagacaacacttaagtaatcatcttcaaaaatacttaagtaataatgtgctagtaacttatacctttttaattagtacagctaactagctaatgctaaccgttatatataacgcacttagagattgagatggaactgcatgcctaccgatcgccacgggtgcatatatatcgttttgtgtgtgtcatcgctttcgctttggcttctcttacaaaccgatataattttctgcgaggaaaatcgatttaattctcccaataattgagaaagtactctaaccatctgatcgccatcagatcgaggataaagatcagtatatgtcagcacagccaaaattaaacgaggacagtgatgactgatccctgcaattattcttttcttttcaattttcctcttcttcttttatggaatggaaccaaactccagcacactgcgtgatgtgattaattttgccagtttggctttacagacagatggtaaatggtttggtcgctgttagttttagttcattgacgctttaacagtagtactaaacaaaactttgatgtcaacttgtgaagtctctactggaaagttttacttctacttgacaaaagcgtgacttttgacctgatcttttgttgacttccatgtagattacgcatgcgaccaaaaaattgcaggagcaaaagtcatatcaatatcaagctcattaatttaatcgtgctagtttaggcattactaaaaacatcttttttgaaacatcagttacatatacaatagcagcattggtatatattactccctccgtcccataatataagatattttgatttttcgtttgtattgtttgaccactcgtcttattaaaaaaatttgtgcaaatataaaaaacgaaaagttgtgcttaaagtattttggataataaagtaagtcaaaaaaataattccaaaattttttgaataagacgagtgtcaatcaatgcaagaaaaaaactcaaaatcccttatattatgggacggagggagtatgatattacgatggttttacaatttagccagggtaggtgaaggttattttgctttcgtttcaagatattctattccatgaggaattcgggacgaacatatactactccctgttttgtaaaatatagtaatttgtaactataaatttaaacatattttatgacggagctgaggttatagacaagaagtcaactataacgatctcatgtggaaataactgtactgcaccagtataatctagtagtactgcataagtacatcttccttttttttttttaagggtggcatatatccccctaaaaacaagggttgcatatactattattcacagatggaacctgtattaattatttcctttgtacagtgggattattgtgaaagggatcaaatcaacaatggtagtgcttaccccccacgtgaagatgctaaatgcaagttattcctttgatttgtatttcagcagc

SEQ ID NO: 43010 - DNA, 1501 bp, Oryza sativa
ttataagccaaaatttaaattttcaacgttaaatttggagctgattttggggttttttcattgaagtttatttttcagcctttgcttttagatcgctaagaacacatatataaaaattttattcacaaattaatttttgtttgcaaatattcaaaaaatatgccaaacgttgaggctggatatgttgtagtacaataaatgtttatatctggtacgatcgtacaagatcgatttattttgagacgtagcgagtatatacgatacgaggccaaattctgcatttgagccaaaggcacctagctatacacgcctacaccgggagaccaactcaatggaccgacgcaatgcaagaggcagcagcaactcgacacttcgacagcaacagaaaggtatgggagaaaaagaagttgaataaaaaagaacagttcgagctagaaatggttgtagctagttggagatcgagacagcaaaggtatcaggtaattttatagtaatcctgcctcttggtagagctgtccctcgtactaggaagctacgcatcctttcatccgcatcaaaacttcagattcgtacagggaaattaaagtgttttctcaaggataccatctcgtttatataaacatgttagctaaatagttacatttttaaaaggaaacttaataagatatattaatatgagataaacacctacaagcctttaaaagaaaaagaatatagctgtaaatttacgttaactagtttcggtttaatttgttctttcgctgcaacttgttcatatactactagtatgcatcatcatgcagtaggagtatgcatgatatatatggtccctttctttcttcatttctcatctctactactcactgatcccatctctcgacacgacgtagccctgaagcaaagctccctccctcactggtcgtcactgcctccctctttctaccccctgctttgatcgatcgaccatgcatggcaaagcatcatgcgtgcacactgatgcttcttaccgatcaaattaagttttttttttactcagatcagctcatatcattcatcaaaaaactatatttgattgattcctgtctcatttttttcttctctctttctctgtcgatttgatctcattgcaattgcgtagtagaccacttcaagacatcgacctcttcttatccctcctctcttcctcccgcccgtctctctccaccatttgattcacactatatatatatatatattttgcggcttaatttcccttgtttctttatgcttcttgttcatccaagctaagctgagctgagctgagatgggcgagagatgtagaagtagatagaattaagctagctagagaggtagatatatagctgtggtgaggaagtttccagaaggttctagaagatcgccatgggcaacacgtgctgcgtcgctccggctaccaccgatgaggtgggcgcgccgccgcgagatcatcatcacgcggccaagaagtcgccggcgccgtcgg

SEQ ID NO: 43011 - DNA, 534 bp, Oryza sativa
aaataagagagaggtggtgaggtggcatcctgagatatgggtcctacgctgactcagccgccacgtcagataaaaccggggtaaaaaccaccgaaggacctaaaataaacggttttgttaagttgagggatgttatatatctagttttgtggttgggggacgattttgtaactcgatgataagttgagggactttcggtgtactttttcctccggtggagtaataaagatgaagtccagtttgactccccaatcataggtcgagtctaatttgtatccctcgaaagaacggttataacggcttgttcaagtattaaaaccaatacgctctctcggcactgttgaacaacgtttttcgctgatgtggcacttaggtgacatgttgacgtagtcttcgtcctaagtaacgcggaatcacacttggcaaagaaaataaaaaaactaaatgggaccacatgtcattgataatttcacaaaaaaataagaagaatctgtggcccccctctctctctctcccttcttcctcctacctagc

SEQ ID NO: 43012 - DNA, 1501 bp, Oryza sativa
tggggccggacggcgtggtgcgcggcggttcgatggctgagtgcggcggcgcggcagggcatggcgcgcggcggcggtgtaggatcgagatgtcgactagaggggggtgaataggcgatttaaaaactaaatgacacctaaacaaaactaacctaagttgctaggctcggtgagggttaagtctaactaagtaactaagttatgttttgcaaacctagggtgatagtggctcaattaattctctaggaaagtaaatcacactcctatgtcaatgttttgcaatcctagggtgatatgatctcaagtatgtctctagaaatataaattgcacaaatgtaaatgcgacaatcaaatgagataaggagacaagagatttttcaccgaggttcgaaaactcgccggtttcctactccctgttgaggcgagcccaactccaccgctcaaccatgaagccaccgcacgcccccttcgtcaaggggtgggcaaggtggaaagcaggcccacggggaggactacccaagcctcgatcactcgtggtagttcttccttcactccgaaggtggtgaaatccaaaccactcacaaaccggcaccgggcctcctccacaatcttctcggagaggtcaccgggcaactcctccacaagccgtctaggaggcggtaacctccaagagtaacaagcgatggcgcggctcggagatgatcaagtgccacactagctctacaatggaagcaattgcacttaactcttggctagaacaaccctcaaacacactagaaggatgaacacaaagctcaagtgggtgtgtgagagatgaaaggggtgtatgcaattgaagtggtgccaagagagtccccttgctgctggagagggagtatttatactcccaccaaccaaaactagccattgggggagaaatcccctaactctgtgtactgccgctctgaccggaggtgtgtggccggtcagacagtgctactctgcaacggctagaaaactagccgttgtagccctgttagagggccccattagcctggccggtcagaccgcaattgagtggccggtcagactggcctcggcttggtcagaccgccctcagctcggtctgaccgaatatggcttcatcggctctgtatcggccaccttgagcaacaccatcccagcctccagggggccggtctgaccgcacaagtgtcgtcagtcagaccgaccttgtgcgccggtcggaccgcccgcttggggccggtcagaccggacagggcacgccggtcagaccgtcactaggtggccggtctgaccgcccctggtcaggccaaaacacagtgaaactgcgtgtgttgtgaaaagtgtgtgtgtgtgtgtgatgaaatgtgagcacaagtctaaatgcataatgacctaatgtggcaattaagatcatctctttgctaggtcattacccctcttaatagtacggcaaagctataaataaactagcacaattttgatcgcccaacgcctc

SEQ ID NO: 43013 - DNA, 1501 bp, Oryza sativa
  unsure (1)..(1501): unsure at all n locations
aagatcgtagaaagatgtgatggcttgccacttgcgattaaggttgtgggtggactcttactgaacaagggcaaaacgagagatgcttgggtgaacgtctctaatcactttgcatggtcaatgacaagaagcaatgacgacatcaacaaagcggtctatctgagctacgaagagctgcctccgcatttgaaacagtgcttcgtgttctgctcacttttccctaaagatgaactgatcataagaggagtaatagtcaggatgtggattgcacaaggttacggacatgacataatgagatcgacgctacctgaagatttgggagttgaatattacaatgagttggtgtcacggaatcttctagagccatacaaacgatcctatgatctatcagcaagcacaatgcatgatgttattcgctcctttgctcaacagatagttaaagatgaaggactacttgtcaatgacagacaagatgtgcatggtattgcaggtgcttcaaagctgcgtcacttgtctgtatccaaaactgcaatagagcgggtcgctatacaaaagcaagtgtcattgaggacattgttgctctttgggagatgtataactgagttgacgtatttcaggaacaatatctcttgcctaagagtactacatttacaaggtgtagatcttgttgacctgccggactatatatgccatctcaagcatctaagatacttggggcttgcaaatacaggcatatctgcaatccctcgaggcataggaaatctaaaatttctacagttcattgaccttatggggtgtcggaattttcatcagcttcctgacagcatcttgaagctacagaatatgaggtttctcgacttcaggggcacgaggttaacctcaattcctccaggtatgggaaagctagaaaacttggtgaacatgttggggttcccaacttatttggatgacaggggacatgcctggagcagcttggaagaactacggtctttgtcgaacctaaaatggcttgatttaagaggtctagagcttgcatcttcaggctctatggctgctacagcaatgctcaacagtaaaaagcacttgaaaatcttagacttgacatttgccagtaggctcaccgacaacgggatgatcgaaggaaccagcaatgtaatcgaggagcaggaacgagccgaggttgtgttgagtaatctctgtcctccgccttgcgtagaatgtcttacggtcaatggttactttggatatcgactaccccgatggatgagaacaatgtcggactttccaagcttaaggcgtttggagctgaaggactacgtatgctgcaagcagctgcctgtcggcttgggccagctcccttttcttgattatatttggattgatcatgctccatccatcgtgagcattggccatgatctcctcttcctctcctcctctagtgctgatgaccagaaagtcacaactggaacaaggatcactangaagctgcagctccatggtc

SEQ ID NO: 43014 - DNA, 1501 bp, Oryza sativa
aaagcgaaacatgggtaataaaagatgacccataatgaaaatctacttaagaaattatatatttacttatactgcattagattagattagcgggatcgaatgttattatccattctcggatggctcaaccggcttatttttaatgatgggcatattgcccgcgcattgcacttaattaatgaaaactatcattaatccattgttaatattattatttttatacatcatctcttgatatttgtttatataaatttattactaacttgtgaaccatttttcctcacattatcatttttctcttaaaaaaagttgtgattttaatgtgggttctgagaccccattcgtcctttttccattgtaaaaaagataatgagttggtgatggagtgaacagatttattacttaccaccgttattatatatttttttagagtacaggaaagtcaactgatcgctgccctttttagttctcaaaacaaaaaatttttaccctatcaaacgtatgaatagagtattaaatataggtaaaaaataattgtgagacaaatcttttaaatctaattgtaccatgatttggtaatgtgatgttatagtaaacatttagcaataacggattaattaggcttaataaattcgtctcgcagttttctaatggaatctgcaatttattttgttattagattttaaatatatatattcgtatattgatgtgacgacttgaaaaaaaagtcaaagtcaaaatcatgctgcggagaataaaaaaaaaatgcacgcccctatcattgcagcgatacacaacattgtcattgggggtctgatcttctctgctcatggcggcggcgctggaagcattcgcggccaagctggcgaacgtcctggtggggatggcgaaggaggaggtggagacgctcctgggcgtgcccggcgcgatcgccaagctcgagacgacgctcgccgacctgagcagcatcctggccgacgccgaccggaggcgcatccacgacccgggcgtggagcggtgggtgagggagctcaaggacgccatgtacgacgccgacgacatccttgacctcttccgcgccatggagggcggagaagaccccggctcaccgccaagagctgctccggcgccgtcggcgtgctggagcgccctctgccgccgcagccctgccgctacgcgcaagatcgggaggaagatccaggagctcaaccggagggtggaggagatcgcgaagaggagctcccgctttggatttgtctcccaagtaatccactcctcctcggcccttcgtctaaccgatagacccatgtgttcttgctcgtcagaaagcagccgcaaccgcaagacgggaccatccatcattcgatccgatgttgtcggcgacaagatagatcttcacacaaggaacctcgttgatctgctgattggcaacaagctggcggatggtcgcacgcgcgcaagatcgtcaggcgatgtcatcgccgtcgctatcaccggcgct

SEQ ID NO: 43015 - DNA, 1501 bp, Oryza sativa
tagagacgctgccacctgatggtccgcgagcggcccgatgatgtcagtcagaggaagagcctacgcttaatcaagtcataaggtgatctcgaaaggaaaatgcgggatgcctatcgagtatacttacgttgatagcgtcatcacgttcagccgcccccttttcacaaaggggcacgaggatgttactcgccgttgtcggaccactgatcatcacctggccgacgcggcgctccacggtttcgctgttcagacctatgaaacgagaaccaagtttcgataaatcaaggggaacgcgaacataagcatgtcaggataaatgcgagaaagataccccgaggagaaacccgggtcgcgtcctctggtccggaatatttaaaggctggatgggcccgagcctggagcggctggatccgcctaccaacgaagtctgcaacgacttcataccccgacaagccccgtaatcggagatcgtcgatgatgtcgataaacgactgaagatagggggtcaaagggggctttgcagtccaagacgaaatcttgtccggttgttcatcgggaacaacgaagacaaggtctgaatctttgatctcaagatagaaccacatattccaccatttgctgcgagaagaagggcactggaaggggatataacgcgacttcaggccatcccgaagtcggaacccaacgcaaccagataccctgttggactccatccaacgcaactcgtagtagaagcgaaaaagatcaagaaaaggctctaccccaatgtaggcctcacaaagatgagcaaagatgttaagaaaggcgatagaattgagattcaaatgaagaagagaaagaccatagaagttcaaaaccaggagaagaaattcggaaggcggggggagaaaaccgcagagaatatagacttcgatcgcaaccatgcgacctaagacgggctggggattaatacctcttgcttccctctccatgcttccacgaccaggaagggcgccgtcttcctgaagcttcttcagcgacgcactggtggaagatgatttgccgaggtccatcgctgatcgaagatcgccggagaaagagcatatgttgctaaaactagggtttcttgtggcagcgaggaaggcgaagagcgcttacaggcggaatgttttctgcatggtgggcggacttcaagatggatccccaaaattcctttaaatagacgcactaccgacggtgcgaattccaaggaaaggagagagatggccgccggaaatttctgggtccgttacgtgcggcagtttttcagacttcagtttaaattcactcgtgaccgttgggcttcacacggtgttctcgatcatgtcctgtctctacggttcccacaccgagaacgacatcagtctcgacatcagaagtcgctattggtcgcacgagttcatttaagcagaaatcaggggctactgtcagggttacggattaggtataccccttacccttcgatatgcgccacatatcgaca

SEQ ID NO: 43016 - DNA, 1501 bp, Oryza sativa
atccttcgacacggagtcgtcttgggttgcaaccactgcgttctcgtttccggtcattgacggaccggctgagatcggtatcgtggtgtaaaccgggaagacgatttcaccgacttgagtccacaccaacattgttgaagcaggaaacccgtggttgaggttggtgttgacgctgttgtcaacgaagctggatgacatagtagtagaaccttgagcaccaagtccccctacctggcgcgccactgtcgacgggtgatacccgtagaccggatatagagggtattggggtacgttggtacaaggatctacgtaatacgacatcgagcaaacaaaagatgaggattatactggttcaggccccttgataggtaatagccctaatccagttgatatgggattatatgatggaaaaccacaggttacaaagggaacgatggaactcgaagaaaccggcgagatcgtaatcgagttagttcgactagatctcccggcgacttggctcctgcaggctccgacttcgtaggctgtgggggtggtgttggctgtgagattcgatgccttaggtcctcccagggagtcccttttatatcgcagatcaggtggtctccaagtagaactcggagacatcggaccctacacgatacattgacgaccctgtcttgtccgagtaggactcaaatactatggagaatttccttagtgtatgcagataatgtccgtgtatgcgcgggtatgccatgtcgatatgtggcgcatatcgaagggtaagaggtatacctaatccgtaaccctaacagcgagaccgttcggtctcgctcttccattccgcgagaccgtgcggtctcgtggcgcgagaccgcgcagtctcgcgcgataccattcgcgatgtcattcccacgtcatcttcgcgcaacggttgtgcgagaccgatggtatatttctgtaaaaaattttgcatcccgaatatttctgagaaaaaaatgaatgaacagtatattttaaaatttaattcttctttgatatatgacaaattagatgcaaatgaataaaaaaattaagttgtccaaaatgatacataaaactacatggaccaaagtaaaaacattacttgaagggtaatcgatagcgaaacatcggtaaaaataagtatcttaaattcaaatgtagtctgttaaaaaagtgaagcgaataatcggaaaaagaggtatacccacccccacggcccaccccgccaagctcatcgtgtggcggagcggggagaggacttgttcaccggtgttgtgagaagaggggatctttgacgcgtggggtggaaaaatgctttgcaaatggcatccaacaaattagactcgggaagaccaacgatgaagaaaatagttttgtcacttgcatgtgagctcgctagtttaaagtgcaaagatgcaaactttggtaacaaaacatggtctaaagtgaaaatattttctattgcctagtgcaatatgcaacttgctcatttcgt

SEQ ID NO: 43017 - DNA, 1501 bp, Oryza sativa
gcttaatgcaaacatataaattcttttgtttcttcccatgaaacgctaattttccctattggtttgttgctccccaccttttttaaccctatacccttcaggacagttggttgtaccgtggtttaaggtaatgttattatattatagccattatatctgaagtgagcttcttcctttctatgcatttgtctatcttctaaatctgaattagtaatctgtaacctcacaatgccaaaatatttgcaactgaaaacataggtgactttctatagtccaccaaggagtgacggcaggataaaagtggtttttctccaccatgttgatccatcccagaaagcttctccaatcactacatcctattttgcattgagttaaagccagtttagacacatcaagtattctcacccactttagcatattgctagctttttttagcactacaaaattaattgtgttgtatatgcagagttcaggtcaaaatttccaatccaactatacactcattcatttcttacctaaaatggaaatatttgtgtggagcatttccagaatacgaacaagcaaagttttatatagtatcacaactgtctagcctttttagtatagtatttcttttcaccagagttgatatgggagagaaattacaaaactactcaaaagtgttgtaattttgtatcgatgtgtgatatttaagtatcttaatctatcaatttgaaattactgtcattggcaagcattgatgattggtaagcattgatatgatcgttccttaatatcctttcctttgcattgaaagactactgggaagtagtattcgcttcttatcactgcttaacactgatgcaatacaaagctggtctgatccttcacaatcaagtgacacaatagtttatcggtacacgatgtgttgatttctctactttcagatttatgtgccaaagcaaacttgcaaacgacctcctgtcgtgtgtacgagataatggtaaataagtctcttcaatatgttgagataattatgtttgatacaatgttcaattgttaattctcttgaaccagtttgagcaattgtgtatactcaattcagcagcatcatggtcaggcgcggcaatatttctagttttttcttttcaaaaaatgcatgatgtttagcagtctaggagcatacgtgtgaaaattgcgagagtttttcttccctttctctagctgcctaacgctaggagggacacgcttttttcatggcgcgaccaaaatattgtagacgagctaggctcttgttggcacgccgatcagaccggcccgcaagcaacggtctgaccggccaatacacggcggttagaccagccttgtagagaaaaccagtaactttatcaaatcttgacaattctcttcaattttaaacctaaatgccaactttaggtgtaaacagctctatcagcattcaaccagttcaccctcctggtgcagttgcccaacgcaaattgcgaggattcatcactacaca

SEQ ID NO: 43018 - DNA, 1501 bp, Oryza sativa
aatattagtccctgtcacatcaaatgtttgacactaattagaagtattaaatgtagactaatgacaaaactcattccataagtctggactaattcgtgagacgaatctattaagcctaattaatctatgattagcctatgtgatgctacagtgaacatgtgctaattatggattaattaggtttaaaaaatttatctcgtgaattagctctcacttatacaattaattttattattagactatatttaatacttataattagtatcaaatatccgatatgacgggactaaatttttagtccctatccaaacaccaccatagggtgcgaccgtcgattggtcgattgcacggcccacggcatagtaggacgcctagccccgtttagttcccaaaaagtttttcccaaaaacatcacatcgaatctttggatacatgcatagagcattaataaagattaaaagaaaaactaattgcacagttagggagaaaatcgcgagacaaatcttttgagtctaattagttcatgattagccataagctacagtaatccacatgtgctaatggcggattaattaggctcagaagattcgtctcgcggttttcaagcgagttatgaaattagttttttcattcgtgtccgaaaaccccttccgacatccggtcaaacgtccgatgtgacacccaaaaatttttatttcgcgaactaagggcccctttgatttgtaggaaaaatgtagaaattttggaggatttcaatcatatggaaaaaaaaatcctatgaaggcctttgaaacaaaggattgcatcctatccaatcctttaaaattcctatggaatgggtaatcctatgcatattttagaggaaagttagcaagaggtctaacctcttggaacatttcctctgagtctatctctctaatctgattcctgcgtttttcttgtggtccgatcaaacggccattcctgtattttttctgtgttttgcaatcctctattttacaattgtatttatgtcagaatcctatatttttcctaatcctttgtttttttattcctatatgattcaaaggggcctaaacatgcccctacttggaagttggaactctccacagggttcccctcaccccttcagcggcttgagcttgacagctccctggtgcataggactccagtacgcgatacgtcccgtccgtttgaccacccaaagcggggcgtggcctggcctgtctgtccgcctgtatacatatctcccctacctcgcccactgccggacgcccagcgatccagtgccccccactccccaccacccgcgcgtggcccggcacgaacacctcaacctttctttccttcccttaccaagcgccaagctagccccaagcagagctctcaacgagaggagatcgatcgatcgatctctcgctccgtccattgatggactactcgagctccaaggagccgtcctcggcaaggtgaccaccaccatcgcccgctcgcgctcggc

SEQ ID NO: 43019 - DNA, 1501 bp, Oryza sativa
gagagagggcacggcaggggaggcccatgtcatcatgcgcgtgtgccgccggtccgggagactgacgcggccgcggtggcctggttggtcgccgaccgatcttttgaccggaacttgccttaccggccggccggccaaaagctctctccaattcgtgcaccgtctcgctggacaccggacagatcgacgagcccggcctctggtccagactccagacatcgaaaagacaggaagtggctcgggctggcccgctagccccggtggtccatcgctatggcaatgggacgcgagatggcgagggatcattaggctagtggctaccatcagtcgagcagaacaatcatgccgtgacgacaacaacaacggaagcagttcaggcattagccaggcaccttcctgagtcgccgttcccgttttaatacgatcgagacgcaggaaatatgatttgggtccatctatctatctatagcctggtactgtcaatttccgcccccatggacaagatcccaagcagtatatacatagcagtagcatttatgctcactagaacaaacttaaaaaagagctttcaagtttcaactgctaagccgtcgtctagctgtagcctggagagaataaaatcgccgatcagtctctgcagtggtcctgcctatcgacggattcaggaaccgaagtactctgatccagcggcatcaattccacgctgtgccgcctgcttttgcgacatccatgtgtaccaagtcttaagctagagagactagagcgtgatcaagctgagtgatcgatcggctcagcacacaatagtataccattaccgtgtaatttaaagctaaagctcagctacatgatcacggcgatcttctttagcggcctagctaagctaaagcatcgcatcaacacaggctagcttaggcccaagcgatcatggccgctttcctttgccttttcgccctccccgttttttcttacacatccgatccaacatggccatcatcatggcttccctctccctagcttagctcaattcgccgaaacttaacgaaattttaggatagtttcgattgatctgcacttccgaagcatgtcaccaacaccatgagtgacatttttcttgtgtaggattaatcaatgcaacgcgtacgtgtggcaagtgttgcttcaaattaaacattttttcctgttcaaggaaaggagtactttagatttcagaaggctggcacaggcagatatatatatatatatatatatatatatatatatatatatatatatatatatatatgagctagtttatacttatcggtacaagggggcaaaaggaaaaacaaatgatcagtggtagttataaacctttattagcttttctgaagatgagaggagacatgacctcaatatatataaaagaaaatgttagtgttgtgaattggtaggtttggtagctccagattttgattaatcaatttcttcacttctcagcattctgaaccgcacgtatccatca

SEQ ID NO: 43020 - DNA, 1501 bp, Oryza sativa
aacacaggccgggagctatggcttccaacgcctctgcaagtatgggtttgaactttgaacgaatgaaagggagagatatccgacttgtaacaaagtggcaatacggattaaccaatggacggatttgacttgaagaaaattaaacagcttgcagaattaagaacaagaccagccaacaagattgtaagttgttactccacctagatagtcaaaagtgctgcagccagagccaatcagcgggcagcggcacgttatcatgagctttttaatactccctatatttcatactctatccttccacaaaaattacactactccgtattacttttctcaccaagaccaaacacaaattaactatctaacatataacaaagatcaagtagtgtaagcactcatgcaaccaatgagtattaagatggctcattagtttctggttaaacatttaatttacctattcatttaagtctttgaatgcatagagacaaaatagaaacaacttatttggaaaaactaagatataaaataggtctaactctcgtggatggagtattataagacgggtttctaataaggatcaagtttatagaaaaataatagcatgtacaacaccaaattagtttcattaaatcgaacattgaatatatgttgatagtatatttgttttgtgttgaaaatgttactgtctttttagaaaaaacttacagaaatttaactttaaaaatatcaaaatcgtgagtgtataacatgacttttatatgtacatttaattattcatattattcatttttgaaaaaaaatgaaacaacataaaacatacttatttaaaataaaacaaaccacaacaaaataaatagtgataactttttttttcatatgacgaatgatcaaacgtgtgtctaaaaattaacgccatcatatatacttaagagagatgctctagtgctctatactagtagtattatactaccattattattaaggataaattagtaagttactaattcaatgaatatgagttactttgttatttattttttttctagctaaatcgatctatgatcatccatcacattggcatcgctcatatttcatcgacaaagccaaaaaagaagaaaaaaagttgtcactactaaatgatgattataccctccgcacttatttttttctgacaataatgcccctccaccttatagtataaatagatatgaaccatttgatcaaatgagatcaatgatttagatagatttctactgtcagtagagagcaccgtagcaagtctcgtatacttcttaaagaaacgcagcaagtatttgcgagctatcagaaccctgacttctttgagcgctcgagttggctccgggcgcaagcgaaacgaaacgcaacacgttggacgttaggaccaggttgcgggccgacgggccgtgtcgctgtccggcagcatgcacgagcacgactcagcctcggcgccgggagggagagggaagggagcccggaattccgg

SEQ ID NO: 43021 - DNA, 1501 bp, Oryza sativa
ctagccgccgccctagccactgccgcgccgcgccgtttgcaccaccggcttctccgtgcctcgccgcaccccggcctccgctccgtttccccatttaatcgccgcaaccacccttccaccgtgcatcccaagccacctccaccctacgccgccgggccgccgttccgccttcgtcccgaggagcgccgacgccgagctcccccgcctttccccgcccctcgtcgtcgcgtccttggtgagctcctcctctccctccttgcctccctcctctgtctcccatgcgtgctgccacgccggtggccgccgccggcgaccaccgggccatgtgccgccgccgttaggtcggccggccagcttgtcgccgccccgctcgcctaggccgcccggatccccttgccgcgccgcaccaccgctttcccgcgtgcgtcggcgtcgtcgcaggaggccgcgccgccgtgagccgtcgctcggccgggccggcctgagctgtgcccgtgctcagccgcgccaccccgtggccgcccgatcagctcgggctgatatgggccatcggttcccgtggaccagcggtggactaccccgtggtcccggtccacggtggaccggcgcccttgtgccgctgaccggtggggcccgcttgccggcgccgccctcccctttgatgacgtcagcaaccgtcttttcctttggaaaaataaataataattgcgtcataattcgttaataattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcattttgcgtgccagcgtgtagttcccgtcatttcggaagatcgcggtcgcaaggataagagttcggaagattgtttgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaataaatcgactagctcatgttacttatgtgacctagctagaactatatgcttagccatgcttaattaccactagctcagttgatggggtaattacagttttagaccttttagtatcaggatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtaggcaacggctgggcttgtagtgtagctttcctctagccgacgcatccaggcaagggtgggcgtga

SEQ ID NO: 43022 - DNA, 1501 bp, Oryza sativa
cgttgtcgcgccattgtcgcccctaccctgcagtcgccctcgccgtccgtcgccgaagcaccagggagaccggtgcgtgcggggacgcgagacaaggactccgggcacctcttcttccccttccccggcccaaggccggagagctcgccccgcgccatcggttaccgtcctgcgcccgccacagcacggtagtgcatctccccgttttcctccctcgctccacctccctccttagatttgggtagtagcttgagtagtgcccctgtagcaagctggcgccgccccaagcctcgccgccgctcgctgtaggctcgccgccgttgccgcccactcccggaggccgccgctcctcgtcggccctcctcggtgctcttccaccccatccaacgccagaaacgagtcccctgagtcctagatatgctcccactccgctgaatcgaactcccattgctccggtggattttccccttttgctcgccgccggccgccgccgtagcaatccgccaccgtcgatcttcctccggcgaatccaagccactggctcgcctcctatcgtgcccctcttcactccggtgtgctctcccttggccgaagaccgtcgcgccgtgctccggtgagacctccgccgctcaccgtccatcttggccggcctccttcttcttcctcccaccagcccgcgtggcaaccacgaaggcgccacgtcggcgccagctcggccgcaaccgggtcaaaagaccggtcagccgcctccctccgtcccatctttcgtgcgcctggtccacggagagccctagcggctgcgcgtgggcccgccatctcttggtccacccggtgctcaagccgtgagccgcgtccgccaaaccctcgcgccgccttgcgtgcgcccatccctccgtgagccgcgtcaccgacaagcggcccccacccgggaccctgcgaggtgcactcggtccaacggaccgccccctctctcttccgcgcgccctaatgggccgcctcaccatggccgcgcccggcccaatagccggccgagccatataaacccctcgggccgcgccctagccgccccgaggaagtctgatatctctccctcctccaatttcaaaaagggtttaataaattattaaatccttttttcctttagatagaaattccttaatccttagaaaatccatatcttctcaaccgttcatccgattgactccgttccatatccagtaattccgtaaaattgagatatatctaatggcactattatttagtctaaataggatctttattttgggtcttgtgtaggtttttaattgtttgcgtatagttgcggttaccggatttccgtcaatcgcgggttttctcgaagattcgtgaagcttcgtgaagaccttgagcaaggcaagtcacactttgatcaattgctcctataattagaaaatcattattattttgtttgcaactttcattattagaatcacacacttaacttgcttggcctcggtttgcg

SEQ ID NO: 43023 - DNA, 1501 bp, Oryza sativa
caactaataaaagctgcatgttctaataaatagaacacgcatggatgataactagagctgtcactatatgcacgatcgatcagtacataacatttcttacaaaaaataatccttattccattttcacttggagcaaaggatcgccgctcctacgaattcaattgaaatggctcaagacaatgagattttggataaaaattagtattgaggttcaacctaatagtattactccctctgttttaaatacataagtcacattaacttttttttattagtcaaactatttcaagtttgattaaatttataaaaaaatacaacaacatttctaacataaaaaacatatttgatgttatatttaatgaaactaatttgatgttgtagatgttacaattttttctataaacttagtcagacctaaaacctaaagaaatttgattagaaaaaaaaatcaaaaacaacttacaggggcagttcagattgatgtcattttaaaccatacatttttggtaaagtttccaaaatgtacatacatttaactttttgccaaactttcataaatgcgtaagaaataatgccaaaatctttttgccaaactttcataaatgtgtaagaaataatgccaaaattttggtaatattgtcaacttactaaattttttgtattgccaaaatttagtgaggtttattttgactataatctgaacaaccccataatataaaatggtgggattagaaaattccaactagtcttcttttccttcttaaactcttaagctaatgtgttttgcaacttctgttttatacttctacttagtatcaaaatcctatatatttgctacttagtatcaaaatcctatatatttgctacttagtatcaaaatcctatatatttccccccattcaatgtaggggggagggggacctcaaaatccactcactctaccctaacccttgtcaatcccataacaaaatatacacagatggggaggataataaaaagtaaaaaaaaaaaaaaagaaagcctatgccccaggaacaatcaacaaccaaggcccattcccaagctcacttttacccaggaaacatgatcatacatgcatatgtacactcctgccccaaaagcaaggtaaaaaaaaaaaaagaaagccatttgcccccactctccctgtataaccttgtacccatccccaaagattcccctctcctccatccttgtgactctctcctctccatctccaagactcccaagtgctcttgtggtggctgtcccctacctctctctctctctctgcattagtgcactgcagaagtgaagtgaagtggagtaactccactgctctgctctgtgcctgaatctctgacaactgcacgcttcttgcattgcatttgcattgcatcaagaaaatggcgatggggtggttgccgagatctgccaccgccgttcttgtgctcttcttggtcttatggagaggtaggtaaatctgtgatgtttgatcttgttc

SEQ ID NO: 43024 - DNA, 1029 bp, Oryza sativa
gcaccctactttaccattgcgggtgctctaataaccgaaataaacgcgaaagctatagttttgacattcctaccctttgcaaaacctcatttcacgatctgacatttgccagctgggaacatgtcatattactgtagtaaggctgggttactttgatgaaaaaaaaaccttaccaaatcatagctgtcaaaattttgagaggattttttatatagttaccaaaatttgacatcaaactaaatatagttattttttttaactttatcaaaatttggtaaggttaaaaatgatatcaaagtaaatatgctctaagtttgcccagagtattacttgtaagagagtcgcaataccaaaattccaggcatgaaaaaaaaaagaaagaaaaggagaggaaaaaaaagagacgatgtcctaccgaaaatggaccgtacagtggtgagcagtagtaaaagcgaatttcacagagaatcccatgtgggccagccagtggacacctttcacgtcttttcttgctgtttactccactgaccccaccctgccgggaaggaatctcacgcgtttcacacccgcacacatcatacgacagcgtggacccacacattctggtccactgtaagtgagacaaggtgctcattttgtagtcaagtcaggttaatctttgcaccgggatgggtagaaatcacggtgcattttttttaaccttttgttttttaccttgcaattttttaacggggaggtagaagtacccgcagataggacgatgtggtcagtggtgcacggggagacgagattgaccgcattaaatgagctagcaagtgtgatgtggtactacactgtagagtagggctgctgcttccgttggatgaactgcacacaaacatgtgctttgatctgagtagactttggcttttttatccgttcttaatacttcgtcataaattatagtataatgagatatattatagtgaaatgtatcttaatatatatatatatatatatatatatatatatatatatatatatatagga

SEQ ID NO: 43025 - DNA, 1501 bp, Oryza sativa
ttgaatcggatataattcaaattcaaaattgaatcgggtatgtaaattttgacttataaactttaggtttataaactttaggtgtataaactttagatgtactatatataaaaaatatttgaattcaaatttaaatttgaatcggatatataaacttgatttataaattttgggtccctaaacttgaacttgaaatgtacaaactttagatgcataaatttaggaaagtaatacggtgccaaaaaagaaaatcaggtggaaggaagggaggaccgaatcctgatcgcccctggcgatccatcgccaggtagcaatctcgggttaagtggtcgtcgtgtgtacagggagccaagacatacgccagtgctgcgatcctgctacgtgtgaacaaaggcttctatttgcactaacagatcaatttgttagattttttgttaagtgtacacagccatcgtactaggagttaagcttctgtgctaaaggcacatatggacgagcataccatagaactacaccgtttccctactacaccaagcctgaggtaaaatttacaaatatatatgtttctcaaaataattttacaagtaccattaattctcatacatatgttgttagacctatttttaatggatatatataccgcgtcggctggtgattattcaaataattattttaggtatgtaaattatgaatctgatagcgcctcagcctataatgcgtcggctagtgattattcaaataatgatgaactgaagctattgttgttcatgtacctgtaacaaattgaattgcaagttagtaagatgaaaccatccagaaagttgcatagtatgataaatggaaagtcaattttagttttaacattggaagggttgactgatcacttacaaatacatgagttcgttcattccagttaggtctggcagtggaccagtaagattgcagtttgcaagatggctagtgtcaaatgaaagcatagcgcgtaagctattaatattgaataattgacaattaataaagcagacacacatagtaaactcacagttctgtaagcctggttaagttgttgaggttggtaggaactggtcctgtcaattgcgcattgttatcgaaacgcctgcatcgatcgaacttcatgacataaggcagcagtgtcaatctatgaattttattgtctcatccataatatgcgcttgtactcacagaacttccaatgtattaagaaggcctaaagtagaagggatgcttccggataatttgttgttgtcaagaagcctggataatatacagatggtagaaatcagtctcaggtctgagcttaacaacaataattaaacacaattatgatgaggaataagtccactttgactcccttaaaactgacccaaatttaatccatgaccctgaaccgcaaaatcagatatcttgacccctaaactgttaaaaccggtgcaatttgactccctcgacggttttggtgagcggtttcgctgacgtggca

SEQ ID NO: 43026 - DNA, 619 bp, Oryza sativa
ctagagtggccatttctcgatgtgttatgctactaaaccatgcatgataatctatcactcacaattgctcaagaacttcttgttgaggtggaggagtgagagagagtagagagaaaaagttgactcttttcttagcaacaggtgtgataccaagtgcaataatagattccggaaccattccttgatgggttttaagatcgcggtgggaggtgtagaggatggtagcgtggtataggcgacgatcgttggcttccttaaccattacgaacttgtgctatgcaccatctttctcttgtacttttgtcctaaaatataaacagttttggttagataaaactattcttcctcttcccatgtgttatctcgggaacatgcatggcatcgtcttccttgtatccatatttcaatttcaactcttacacacgcctcagcacagtaaaacacatagtagtatggatcatgatcgttgtcgtccaaacctagaatcatcaccaatcacatataagtcgatcgccgtttgtttaaaaatattgttttatatgcacgaatatacatggatcgccaattatatactactatctgaagaactatcaatcaagataaatagattaggggaata

SEQ ID NO: 43027 - DNA, 1501 bp, Oryza sativa
tactagggggcaccgcacggcaggctgggcgtgcgtccagtcgcttgtggcatcatcaatgtttactacctactttatgaataagggtgggccctgcatcagtgggtattagttgttgttgtagccacaatggtgaaagaacaaaagtgggtagtaagctggaccccacaatcactagccatgagagaaagatgagagaaatcatttgtttattccttatgactaggtagtaagtatatgacctggtattagttacttactactcccacaatgtatacaacctggtagtagtagtattttattctttattatccactttagatgtacattgtagatgctctgagtggatgtaaaatccggctcctctaactgctagtaaagagtatacaaaacagagttaaactaggaccactaggagggatatttcttgcaattgtctgtagcaggttcagctcacgttggcgacaaaaaaactaaaaaagtcacaaaagaataaaagcaaaacaagtaattcctccgttttacgatgtaagtcattttaacattttccacatttatattgatgttaatgaatctagacatatatatctatatagatttattaacattaatatgaatgtgaaaaatggtagaacgatttatattgtgaaacggaggggtagatatttagatgtgaagcatttacacatcatccatattttgctcctcaattttgtactacttatcgtacttccttgtacgtgcgattccattcattacttcttgtttgggtaaagactatcttatcagcttaagtgattgcgatgtgttacccaaaccatttaactcgaatggataaaagtcatgtgacaccaacatcattaaatcttaactaattaaaagattcatatttttccgttcgtcacatgattttcgtccgtatgcacgatttttcacccgtccgtgcgatccgtccctcccagagtccgagtctgtattaaaaaaaaatccccgagctagatccccaaatcaatcaatcaaccagacaaccaaaaacaacacgaaaataccaaatttaaccttaacctcatgaatttgatcaccacaagaaacctaatacccatgtatttcctccctcccaatccgatccgatccggcaatacagaaagtcaaacaaaggcaatcatgtatgaatttgctggcaaacaagaggcagcaggaggcacgtcgggttgcaggcgacgtgcggcggcggaagtgtttggcgcggtcgttgggcttgttgtaggatcgagatgtcgactagaggggggtgaataggcgatttaaaattaaatgacacctaatcaaaactaacctaagttactaggctcggtgagggacaagactaactaagcaactaagttatgttttgcaatcctggggtgaaagtggctcaagtatatcactaggaaagtaaatcacacttcctaagtctagtttagcaatcctagggtgaaatgatctctagtatgtctctaga

SEQ ID NO: 43028 - DNA, 181 bp, Oryza sativa
gtcagctcaccgggaggatcgccctcccaattcgaagttttttccaagaagtttcaaccgtcgttgactatgacaatagtcgcgaccgactattaagatcctcgtgactatggaagggcggtacgctctgctctctcgcgacctctagtctaatcaaaagactaaaggcccctacggaaga

SEQ ID NO: 43029 - DNA, 711 bp, Oryza sativa
tataaattgcactcacaaattaaatttcatcctagaggtaagctgaacgctcttgcttcccaatggcagccgcaacctcaaaaatggggaattaaggtttggggtgaggaatggggattgactaaaggctgctcgctgaagcggaaaatgcaggcacaagtggcgagcgacgcttcggtgacatcacacgttcttcggtcgcttgtctgtaactgttcttcagtgagaattttacatccaacaccccagaatcctctcataaacactctttgctatacaattacagtgtgtcatagacacttttgctctgccaaaattgggcatcacgaaaaagtgtagcatatgccaccccttcttaattagatgccatcccatcagtgtgatgctactaggataacctatacaagttttcagtacagctaacgagaacatctgtaataagacaactaaaacttctgatggtactaaagcatcacaggacttcatctccccctcattttgttggtcaaaccaccaggattgccaaaattcagtccagcattccagttccgaacctccagccaggttttgcgccatacatctcacttgctacttgatttctgcaaaataagccaggtttaatccaaaagcaaacataatggatcagctcaacagaatgtgttttaagtacatttataaaacatatcacatatgcattcctggttttccaga

SEQ ID NO: 43030 - DNA, 1501 bp, Oryza sativa
cagaaagatgaattctttggggaggaccttaattctataattgggtaaggacctgaattatagaatcccactgaccacaagtagctgttaatttctttttgaagaataataagtagttattgctagagtttttaattgcgttatatgtgttgttagtgccatgttgcattcaacttgcgccatcaatcttcctaggattttgttgggtaggtgccaacttttctgtgttggtagcttgcttttgattgtactcctgttgttcatgattaaacggaagctcgtttactcacaatgagaaaagtggttacatcattacatgccattagtttgctcctttgtatgatgatctattgatgtcccctaattttttctaccgctcctgtgatggatacagatgatggtgcaaatcatggaatcggatggctttagaatctcttggctgcagtggtgttgaaggatcagttatgcatctgcgctgctttctcctgattgcagagggtgttgaaggatcactccatgtttcaatgaaaaggttaaagtggcattttgttgtcgttggagataacagctactaatactccaacgcatatcagattactccataattcaataaaaaggcgaaattgacattttctcgcctttggagattacagttaatacttcatgtggtacattttattttgtgcgtgcgatatgatattgttgtattcctatctctggttactctgtttgattgtctgtgatgacccaccagctgctctagttcttttttttttctctcataggcaattcatctttcaaatggaacattgatcatttgctccatagctgattgagcatatacattttgcccaaaagttgtgttcacttgatcttatgtaaaaaactttgggccaaaatcaagtgcaaacaactttggatcatattatagaagctcatgcaacaattgggtgaaccgtccaatttttccgttttgtgttcgcctgtgttgtgtggtgtgcatattgtgtcttccgtggaaaaaaaagagccattttttgtaaaaaagtgttcttggttgaaaagaatttttaaattgtgtagatacagaattttgtatttcaattatttgaagtaagccatcaaatgcttgcatgaaattctcattatttgcattatgcatttccaatggttaatctatggcttataatctgacaaagataaacgaagcaattcaaaatataaatttaggataagactttgggatacttttactctaggtgatccaataattaagcccaaagtatagaaaagcggcaaaagaacgtctagactaattgtagacggtaaattgtattcacggtgcatcaacttaacagttgggtggtgcaatttagataaaaacttaagaaatgagtgtcctagtgcaaaaggtgagtggctaaaaaatttataaataataagcttataattagaacaacttgtaaagttgtaaggtagctgcgattttgtggtacaataa

SEQ ID NO: 43031 - DNA, 1501 bp, Oryza sativa
ttaatgcaggcttcaaaggaaaggctgttgtttttgcaattgattttatttaaactcctttttgaaacaactaagtgagtgcttctcaaacgacacggatgggacagtgcgtcttgtccggtcggagtatgtgcaatgtatcagtctttgaattgatcagggttggcacccggccaacagctttcaaacggtcacccgggcctggttgatcccatcaaccgcagatttttcaaacatcgaacccattccacaacagcaatttcacaaagcagtagtcaaacaaaactacgctaggaatcacctcacatccgcccatgaccgtgggcacggctgttcgaacagtttgttaacctctgcagagggggtgcactttacccacacgacattactaacccggatcacccagcccgtgcagaatggccacgtctggagaccttgacgctttcatgacaaggcatttcgaaagccgacacaggtttaccatatgccaacgagaggggttccagaccaacaccaggttaggtcccagaccatactgtgccaggaagcccgggagttctccccgacaccaccccgttgaatccacatgtctcttggcatcaaggctcccccgattagcaatttactcagccaggggtgtcccatttcacccatgtggccgcacttgtcttatgtttggatgaaattccaaggaaacggtccttaagtgcaagagcgggaaaccgtactcccggtacgtcccccggcctgcgattttggaaattcatttagttcgcaagcaccgacccaggtgtcgggttttccaagtcttttgtaaaacccaagttttaaccatcgttggatgttttatatttgaggggaggtgtcccgatgcgcgtgcccgaaggcccgtacatcgaagcacaacagtcgacaagggagggttaagtgttcaataattcaaggagggtaattgcagtaattaggattgggggccgacgggctatctcgcaagccgcggccgaattacttgtgttaatcctattcatgcaatatttgcggaaaagaaatacttagatttaaattataggtgcaagatggtcaaaggtaacttgccttgctcaagatcttgagcttgatcctcgtaatcctcgcactgtgggtcttcgggctctgaaactacacgcgaaacgggacaactcaacaaacggcaaaaataaagccctattattgacctctaagcgtgccattagatagatctcaagatttgaggaattttggaagttgaacggagtcgaacggatgtacggttgataagatatggaatttctaagattattggatttttgatctaaaggaaaaggatttatttaaatcctttttgagaaaagaaaagaaaagaaaagaaagagggaggggaattagacttccctcgggcggctagggcgtggcccgagagaaaggggcggctcggccgaacttaacgggctggccggcccgagaaggcggcccaaggcgcgcg

SEQ ID NO: 43032 - DNA, 1501 bp, Oryza sativa; identical to SEQ ID NO: 42771

SEQ ID NO: 43033 - DNA, 1501 bp, Oryza sativa
acatctcgtaaggtaatagctctaatccagtttatatgggattatagagaaaactacagagtataaaagagaacaactgaatttcgagattactgacgagatccttgttaagaagtactcgtgacgagatctatcacgagcaggcttcaagttcttcagattgcttgtggtggcgagtgtcttatactaagattagatgccctgtacctcccgggggggtattgtcgacgtttgatgtcgcgattccggtatttgcatagtatatggatcgttggtactagggtatatgcgagactgaggtaaaagagacggagacgaggatttttatataggttcgggcccctgaattgtcagttaataaccttacatcctgttagccaaagacggtcgttgctcttattcatcataatcacaccagtacaatatttggggtagcctatctaattgttgtcgacatggtggtctgaaggtctgacttgtagtcgataacagggtagtcttccttctcgagttcgtgcccggcgagatcaaagacagcgctagatccctatagccggcctctgtaggtaccggatagggtcgatccaggcatatctctgatgtcgatatccggcggcttgtcttggcgtatgtaagcttgtatgttgatcttctgtcttgatctatgttccgtgtcgtctatggtgggtatgtcccctctcctcatagggggtcttgtatttatacccataggtgtccctttgttcaagtagaactagggaaaccaatatggatacaatccgagtagtccttgtcgtttccatgtagaactctggttgtctttccttatccggaactcctcctatatctgcaggttgtctccgtatagaacatggtatgtggtgggtcctgccgagatttagtcaactactattaggtatgtggtatccataaccctgacagtagcccccgactttaatgcaaatgagcgagttcatattctcaactgcagaccttggagtaactgttatcgagctcacgtgaccgttctcggtgagttcagagataatgttagacttcctttattagcctcgtacgggcacctaaagggtttgtctgagtcaatctccgacgtcaaccaagaaagtacagagcatacaattaagtctcccgtcttgctgtaatcgagaatttggattgaagtcaagaaattttatctcggcgggtacaccatcttttcattccgtattccttgccgagatccaccaacctttctcgaatgatcgagaaggcgtaaaatctgcaacgaagtcttgtcaacatttgtcgtactcgccttagtcgattttggtgtagaacaatagatacatgaagtcttcgataatgtcaaatagaattttcctgaaatcaatactcagataagaatattagatagaaatagccccccgagcgaacgctcaaagggtgacatgttataatatgtatggaaaactgaaaatgaattaaacttacagaccaatgt

SEQ ID NO: 43034 - DNA, 1501 bp, Oryza sativa
ggactagcgggcctacggctcaatcttcacaggcgctcaactggggtataagccaggactccacctaagacatattctccaaagcttctcttactgaagaggggaaagattgagcaagaatgagtgcaaccacagtactcagcaagccacaccggagatgcataattaatgcaagggggggtacaaggagataataatttaggggttaagttttgcaataaacggcatttaaaagtcacttagttgcccaaagccatttataaagacgatcctagagctacacagtattattaaacaaggccgtgaaccctcacgaacctgccctaacccaaggcctacgatgattcagaccgaactggcaacccgaccctgggtcccagctcgtcccaagccaacccaggccaaccattgcacattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacgaccgcgaaccacgcttcgggaacctccggaacgacgaaagctacgcgaagcacacaagcaaagctacaagcctataaagaagcaataacaa

SEQ ID NO: 43035 - DNA, 1501 bp, Oryza sativa
ttaaaattgaatcatactacctccgttttttaatagatgacgccgttaattttttctcacatgtttgaccattcgtcttattcaaaaaatttacgtaattataatttattttgttatgagttgttttatcacttatagtactttaagtgtgatttatatcttatatatttgcataattttttttaataagacgaatggtcaaacatgtgagaaaaaaatcaacggcgtcatctattaaaaaaacgaaagcagtatgaatcaagccgtacaatatcttttgtataaatatgataaatagtacatgcacagacaataattgcagcaaccaattaggggtccatctctcaagacaattacacaacacctaccacatgtggaaaaggttgaatatgagaaaagcaatctgctttaaaagtaggtttgtccctacattaatccctaccatcgaaaccgactataaccgatgcaatcctatatccaaaacaaaacgggcaaaaaaaaccggacgaaaaaagaataaaaaaacgggcggaaaaagggaaaagaaaactgaatccgattccgcagtaaaaaaaaagggcaaaaagaaaaaaaaaggaatctgtccgattctaaaaaaacaggcgaaaaaaaaaacaggtgaaaaaaaagaccggccaaaaaaaaaagaatccgtgtggacgctgtaaaaagaaaggagaaaaaaaaaataaaaaaaacaaatatgtccgattccaaaaaaaaaagaattatacgtgacgcggtaaaaaaatcgaatcctattatatttgacacggtactatatatctctatcttctctatctctactgcttaaaaaattaaaaatgtttctgttgtccgtaataacgaaaaaaaggaccaaaaaaacattaaaacaaataaaagaaagtccgattcaatctttccgtggggacgagcggcgccctccatccccgcttgcgcgatgaaacgcaagctaaaaaaacaaaattgagcaaagggataaactagattgaagttcccgaaattaaaagagaataaacgatattgaaacacccctaactcgaaaagagggaataaaatagattgaaatttcccgacaaaattctctaaattcgaacaaccctaatttcgggtaagaaccataagagtcaaatccaaatcaattaagctaagggttcgggttacttaccagacttgaagcccctgagctcactggagctttctgggaagcggcaccaccgcaccttcacctcctcgcagtcgtgtcgggtttcctgcgcacgctgtcctggagcacccctccaccgtcctttgccgaagacgggaagtgtcggcttggtgtcgcccctaccaccgacgaggtccaagccgctcagcgctcgtcgccgtttgcacgaccacctaaccggaccgccgacgtcgtggcatggctttgcgctgccctcgggtgcggcccccagccggcgaagcaggagccgctcggcggtcgtcgctgcac

SEQ ID NO: 43036 - DNA, 1501 bp, Oryza sativa
cgcccggctcgtcgtctcgcggcgccgcctccgtcatcgtcatcgcagcggcgtgttccacgtcgtcctcgtccccgtgcagccgctgccggctgtcctcgtcgcctcctcgccggccccggtcatcgtcgtcgtcgtcctctcgtcgttcccggtcgtcgtggcgtttgtccctccgtcgagccgttctcgttcgtcctcgcttcgtcaaggtcgctgcagcccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttacacctgttttataattgcaaagcttaattataataatccgcaaatctccatataacagcattaaacttcggatgatcatatcctggtcatacgagctccgaatcgacccgttcaagtctcctaatgtttgttacaacctaaagaactgtgtgctttctttttatgtgttgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccatctagtggacactctatttatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 43037 - DNA, 1501 bp, Oryza sativa
cagagcctgcacataaaatataggtgaccgtagccacttaattccctctccaccccaaccaccaactctttagaacccgcgtataaaatattagcctaataatccttataccctataaaggagataggttataccctaaaccctagccctctgtactgcttatctctttcttgctattttatggcttttattgaatttggttcttccttttctttagtagagtctgttatattttagatggcaacctgtggtatttcaaagatcggataatcaggttgcccatctcggatttatttgcgttggagcaaggcaagttattattcctctcctttgagcataactaccctatattctatatctctgttctatgcattagtcatacatgatttcaaatgcataacctgaacatagcaaaccagatatgctagattttgcttagccatgcctagttagattgcataaaatataataaacttagattgggacagtacggtagaaatggttgatttccgggtggctagtactgttccaaccgacataaaactgccaagtacatgtgaagaacatacgagtacgaccacaattctcgtatgggcatagacctagctgattaagttatctagcaaaggtggtacctctgtatagtggttcttcttaagtcctcgcgcaggaggcaaacttacgccgagcagggcgattatgatatttaccgaggcgcaggtaaatatcttgattatctcgcgagctgtgtgtgaattatgaaaacctgattgagatgacgggggtctctcaaccagttctctctgaaaaccccgggaacgccagaactcctcttgctgctgataacgttacgttcagagcgcatggggactagagttcatggaacaggtaccactgatgttagtaaccgaaaagctttgccatgacaaggctaatgtgtttggcacgtcatggattgcgggtaaagcgtacatctactgcagtatgaatattattaaaactattcaaatagccgtgctcgcggttatcgagcattgggactcacaatggcatcttggttagaaacataatttcaaactctattaaatactgttgcatatcaaacatttcaggatttctacttctttattctcagctttctgcaattaaacctagctctactcaaatattaccatttcatacatttattattgaatataatagcttgctgagtacgttgtactcacccttgcttcaacccccttttccagagtcattttggagttcttgccgaagccgggagttcaatcataagttagtctcattctaacttaattctcaaatatagattagatagatagtttaagtctatagcaaaacactagagttgagtcatcgtatagcttctactgtaatagttagccacaagtttgtaaataccctatcattttatgtaaaggaatctcctttaaaaccttgatcaaatgtatgcaatgaagatccagatcgttgaacctgtatc

SEQ ID NO: 43038 - DNA, 1501 bp, Oryza sativa
aaagacatacaccacaccataaatagagcacggtaccaagctaatgagtactgagcagtcgagctagtgcccagccttgcgttgaacatcacattacgtacgtttcagcaagcaggtgctcgatcgatcggccatggcaccgcccacggtgctcaactccggcgagcccgacgcccgacgccgcgagcggccgcacgtcgtcttcatcccgagcgccggcatgggccacctcctcccgttcttccgcttcatcggcgcgctgtcctcccacgacgtcgacatctccgtcgtcaccgtcctccccaccgtgtcggccgccgaggccgaccacttcgcccgcctcttccacgacttccccagcatccgccgcgtcgacttcaacctgctgccgctcgacgcctccgagttccccggcgccgacccgttcctgctccggtgggaggccctgcgccgctccatgcacctcctcgccccggccatcgccggcgtcgccccgcgcgccacggccgtcgtcaccgacgtcacgctggtgtcccacgtgaaccccatcgccaaggaccttcgcctccagtgccacgtgctgttcatctcatccgtgaccatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccacccgggactaaagatgatctttagttcccggttcaaatgctgtcagggtctgtcaggccctcccggtatctttagtcccggttgataacaccaacggggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 43039 - DNA, 1501 bp, Oryza sativa
gcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccacccgggactaaagatgatctttagttcccggttcaaatgctgtcagggtctgtcaggccctcccggtatctttagtcccggttgataacaccaacggggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgaga

SEQ ID NO: 43040 - DNA, 1501 bp, Oryza sativa
ccctagctttgccgtcgccgccgtcgctccagccgtgcgccgccgtcgtttcagccgtcgccgtcgctcgggaagaccaccgtcgtgctcgccaagtcgtcgccgtcctcgtccgccccttcgccgtcgccagagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcatcttggtgccctccgtttgcgtcctcgcgccgccgttcgccggcgagcgtgcgccgttcgagccgtctcctccaccgagccgccgccgctgtcggtgatgtcaccgctgacgtcatcggggtcgtccgccgtgagccgccgtggacccgatcgatctcggccgtccattttggattggttcgatctcggccgtccgttcgtgtgaaccgccgcccgtgcgcccggtccaccaaaccctagcccgctgacgcaataaaccctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacatttatgggataactaatgattcactattatttcatgatggcttaatgatagttcacgatggtcgatcgtgattagttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgtggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattg

SEQ ID NO: 43041 - DNA, 1501 bp, Oryza sativa
ttatgcacaaattagttcagaaattactagtgaaatttctgggtgtgacttggaacacactttatagagactccaacatcacacatttggtttttgatgtcttgcgacacaaaagtccaagtgtgggggaggtcaacgagcttgtcatgacgagttccatcaaccaattccatcctggtttgcagttggtgttagtcctaccttgctaaaaaaagaaaaaaaaagggaaaagagagacagaaggaaaagaagaaaaagatgggagaagaggaagagaactagtagcgatcatgctgcctggatacactcaacccctctcttgagctcatgtgtcgcattagtttagccttcatccactcctagttgtgcacaacctctcgctcccgcagcacctacacgcatacaagcaagaggagatgccctcttcttttctcggtgtttgctactccactctagttggcacttgtatatttgcgtaaaaagatatgcatcctacgtctctgcagcattgtgccaacagatcacgccttcaaggcacaatgttcctgcacgtgaggtgtgtgcataaccaaaccacttacatgagttggcattgtaaagtgtcttcctccgctacaatccgcatcaagacagaggaaagattgataatcacatgtgaccataccaccactccagagatttcaacatatacatcatgctggtggtaagtacacttaggtatacaaaaggcaacaaaagattcacctcatcttttactcatacttatctttatttgaataagacttgagcatacatggttatgtttcttgtgtctatttgcgtatgctctagtttgggtgtttgtgcaagacatctataggcttttgaaattaagcatggtacttaggttaaggtagtcttctttaatcaaattagacatggagtcgagtttgattaatgaactctcagagttaatatgttcgtggacattggatatatatatcttctttggactaacccctataggaaagttttcaaattgacgggtaagtcctcaagttcaattcacaatggaggtaggtcagggccaggaacaaatcaattgcaaacatgcaaaggataacacatcagctttcaaggtgcacggtaagtatactgtcaattgcttctttgttatgatcgtgcaattttatcttaagctctgtataagtttttgcttaatgaaaatttggtgaacagtaaattttttgaaaaatgaaagatttcaagaataaaagaaatgtctctcgaaaaaatgataataataattggcaaacttgtgggatccacgcttcttaagttttgaatccaattcctttttagcatggatgtgaacaactaatcttgaggctacgataaaatcttctcaaatatttgtagttcctcgagtatttgttgtccactaaccttttgcaggaaataaaaagacaactaaggagcagtgtacaaaaactgcaacacccataccacgctccttggttta

SEQ ID NO: 43042 - DNA, 1155 bp, Oryza sativa
tgtaaaaatagtttttgcaaagggtcaaactgtcaaaatttgtgcacaaaatagatagacaatgcattacaacataaacacttatgccatcacagcttatcagtttctcatgggggaatgagcatcagtggactagatggtgttaccaccctcgtcacctcatgtataaatgatatgtattatttccaatatgcaatacctacatatcattttaaccactttattcatgtacataactctaaaatgacatacatttgtagaggtagtcgacagcatctgacatttgcatgtcacggacttgcattttggcacgcataactgttgggcttgggccttctatcttataataagctcacacaaaaggcccagaccagcatgggctaagagtttctttaaaaaaaacatgcgctaagaagattgaaaagcaaacactgtattgaccaaaacttggaattacatgaaattatcgggaaccagagggccagaggcccctatggctcagtacatatgtaaggcagcccatgggaagatattgtgcgcactctctccatgaagaaattaacagcccaatgttggcccactaaatattctactacctctgtcccaaaataagtgtagccatgggtacccatgtccgatgtttgactatccgttttatttaaaattttatgaaaaaattaaaaagaattaatcacacataaagtactattcatgttttatcatttaataacaataaaaatactaatcataaaaaaatttcaaataagacgaacagtcaaacgttaaacatgcacggtaccaagttgcacttattttgagacggaggaagtatattttaactctttcctttcagacgactataactactgtgattaaaaaaaaacacttgaccgacgcgagaatggacgtccccatggtttttcattaagaataagcctcaacacccggactcaccacctatggatcaattcttaaccgttactttgaggcccttgcttccaacacgaggactcaccctatataggtcgaatcttaacacatgtttttatgtgggatcagagagagagatttttttttaactaggtctgaaattcaccaaggaacccaggaaaaaaagtgatgcttaagtgctcttgtggcaaagctcaccaagta

SEQ ID NO: 43043 - DNA, 1266 bp, Oryza sativa
atgatgacgcccatggttgtgttgtatatatacagattttagtatacaaatatgtatgtgttggcaaacattaatgttctacatattgcatatatgtgtcctggttttgcaagaatatttttcatgccaattaatctctggccgatctctaattgatacaaatacagccttcactaacataacatgttggttgatttcagtaaaaccatatggaacagaactacagttacagaaacagaaaccagagactatcttagttgtaccagagtcacaaatgattctatgaggacttcatagaggtagagtgtgcgtgtgtattcataggaatgagtgtgagcgcattgtgagcgcctgtgtttgtattttacttataaaaaaaattgctccaaaatgcatatacattttatgttaatatacttggtgagctttgccacaagagcacttaagcatcactttttttcctgggttccttggtgaatttcagacctagttaaaaaaaaatctctctctctgatcccacataaaaacatgtgttaagattcgacctatatagggtgagtcctcgtgttggaagcaagggcctcaaagtaacggttaagaattgatccataggtggtgagtccgggtgttgaggcttattcttaatgaaaaaccatggggacgtccattctcgcgtcggtcaagtgtttttttttaatcacagtagttatagtcgtctgaaaggaaagagttaaaatatacttcctccgtctcaaaataagtgcaacttggtaccgtgcatgtttaacgtttgactgttcgtcttatttgaaatttttttatgattagtatttttattgttattaaatgataaaacatgaatagtactttatgtgtgattaattctttttaattttttcataaaattttaaataaaacggatagtcaaacatcggacatgggtacccatggctacacttattttgggacagaggtagtagaatatttagtgggccaacattgggctgttaatttcttcatggagagagtgcgcacaatatcttcccatgggctgccttacatatgtactgagccataggggcctctggccctctggttcccgataatttcatgtaattccaagttttggtcaatacagtgtttgcttttcaatcttcttagcgcatgttttttttaaagaaactcttagcccatgctggtctgggccttttgtgtgagcttattataagatagaaggcccaagcccaacagttatgcgtgccaaaa

SEQ ID NO: 43044 - DNA, 1501 bp, Oryza sativa; identical to SEQ ID NO: 18751

SEQ ID NO: 43045 - DNA, 1404 bp, Oryza sativa
  unsure (1)..(1404): unsure at all n locations
ttcataatcctgataaattcattttagagagaacagcaaattggtcctgtgagtttcccccctgggggtcactttgttttttagcattcaaattggcataaagcgccaaatgggcaaagccaacgaagaaaatggctactattggtgaaaaaatacaacacaatgaaagaaaaagggaagagaattgattggatcatcccattatgcccttgtatctttgtgggccattgcagtgggcgcccgatatgatattatattagtgtcataaggtttgccatctgttgagttggttttacacgcatggtgttttacctctcaaggatcattttgaactaatggacaaatgggcaaactttgagggctctgatgaaatcaattatcaaaggctagttattctggagtcatacttgagggaccaaattggatattatgtttcctttanggagaaagaagttagattggcaaaatgatcatttctgttctttcaaacacaaaaaaagaaaagatattcatgaacacttcaatcttcctctcagtaggaactgattttttattttcttaaggtcacatggcaaatggttacagaatggcaaccttctatgccaaaagttggcattggtagtgtgaaagaggatgaaatttttgccttttaaattattgcaaatcattgagggtggaacactgaggcagcctcttattaagtatttgagctaactcattctgtggatatggcttttattagtttatataaaacttacagtaagacatgtactagtagagaatcagtatgacgcatatctgttgttccttttttctttagatagtccttcactttcagttattgagaaaagcaaagctagttctgttatgatttgacagtttgtgctggcaaaattaataagtggccctgatgttagttagtagtattgaagctttcatttgttttgctattatgttagcagatattaataccggcaaggtgcaactgtaaagttatcatacaatggaaatatatttttgtccttccattgctgcagctatcatttctttaggattaaatttcagaaaactgcaattatttggtcgagactatcactttgctacaactttaaccggctattttataaattgcaactttagcagtggattttatcaaataactgcaattttcccatatgtgtatgacatgtgggcccaacttattactacatgaatatttcatttgtgtatggaagacatataaagttgtagctttctgataaaattatacactattgttgcaattctctgaaatgcgcagttaaagttgtagcaaatgatatgtgctttgctgtaatttactttcttttaggaagttttgtttttgcatttacatgaatatgtttcttgcctttttattgcagg

SEQ ID NO: 43046 - DNA, 739 bp, Oryza sativa
ttgtgtgccaaaactcttaggcatatattagttgttgctttggcagactctaagccaactgctctaagatatgctatgatctaaatcagatcatcttgaaacatgtggtgtctgtgtgtgtattttgtgtgtcaaaactatgtggagtgttatcatttgaactgagtgacatttgataatttgatttgagctatgtttcaatttgctgaaattatgtggcttgtactgatctgatctgagatggcatgtaaaaatgttgaagttatgtgcattgtgatgatctgagctgatattatgtttgtgaatttgtatgatctgatatgttgacctgatctaagctgaaatttcaaaatgttctatttggtatcttatgtttgtgagctatatcatgtttgtaatatgaaaatattgtgcaatgtgcaatgtgagctatcttcatcgaaattcactggaattactgaaatttcagacagccatagctgcattcactcaaattccagacaaccatattgcatcttagatgtattcattgataattcagaatattacagctcagttgttgtacacatcaagttattaactaacacctaacacaaatggcagcaataggactagaacaaccaccattgtgacctaattggtgctaacatagtgcacctcatgcgaaagggactatagcctagtggttacaagagcctcaatagcaccttaggtcctgggttcgattccccatgagagc

SEQ ID NO: 43047 - DNA, 1180 bp, Oryza sativa
ttcgaatagccgtgcccgcggttatgggcgggtctaacaatgtctttcgtgattagtctcacacctctcatcattgtaaaagatgcttaaactggtaataatttgtttagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggagtggaggaataggtgtagctttggtcaagctgcctgtggagtggagccgtctgcgccgtttatttattttccgctgcttagatccttattgattgagaggaactatctacctctgtaatgacattttattcgcttattaattagagtaataattgtactctattatcaatttgttattgtgtgcctcggctgattcctggacgagggttcacacacatttaagcgtttggaattttggatagaaattccgggcgtgacaagttggtatcagagccaggttgaccctaggttatgccaaatggttatccatagaagccctctaaaaatattggaaaagtagaactggtctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactacctcctttcacttgtctttaga

SEQ ID NO: 43048 - DNA, 356 bp, Oryza sativa
tttgtttttggtaaaaaaatcaaaaaaaagagagaaagaaaggcaaaaaggtgcataaaagagaagaaaagaaaagccgcacccaaaaaaaagaaagaaaaagaaaagaaagaaggaaaagagcaaaatcagttgtatctttgagtttgcttccatatattagagtgtgtttgagttgtttctggtgctatcttgtggtatcatttgtatctaggctcgcgtctctagtacgttctagcctaggaccagcacggtacttgactttgaacgatcattcaactttgcattctctgatttaagcatttgctatccctatgctaaatatttaagcctacccaaaactccacggatttgat

SEQ ID NO: 43049 - DNA, 400 bp, Oryza sativa
aatttccattttggtgttaagaggcatcatgtggtaactagatcctgttatttccttttttattttttttaaaacgttatgtatcttttatctggtagcaattggccctaattctctcattctctcattcgcagaagcctttgtttgaaaggctatacactgcaaccatttgtaatagaatgcggatccatgtttttcatctatagaaaatccaagctagccattctccattgccttcataatatctactgtccagaagataaagttttagatcagtagtcagagactcttagcagagacctgaaaaatatttttgaatttttttaagttatgttaacttctttgtgttcctaggatctacttctgagtattgatatgaatctccttttagtgtcaaagt

SEQ ID NO: 43050 - DNA, 530 bp, Oryza sativa
agaaacaagacccaaagtgaaaagtttggtttacacctagtcaagttgtaactacggtaataaagacaggcccaagatgcaatttactctaatatctctgtattcctataaaccctttagttttttaaactagtactgcttagttagggtttgttgagttttttttttttggttacattcgagtgtcattccttaatataggcagaactttcttatacggacttggaatcaggtaaattatatatccatggacatctacagaaaaagctacatccaattctccccatcttcgcttggttcagtgaatttagaatctccaaattccgtttgcaagattatgttttagagacaagaagcttttcaatatagctttgaaaaattctacgtcacatattttgtccgtttgagcttaaattttatattgttggttcttgtgtgctctttaagtgtgaaaaaatataaaaaaacaaaaataaaaaagttacacatctctcctctatactagagaggaaggaagaaagtggtgtgtg

SEQ ID NO: 43051 - DNA, 200 bp, Oryza sativa
gtcacccatggatataagactattgttctacccaaacacacttgagcaacaagaagaggttcaatcacgtttcacagtataagtgatccattagttcattgcattcatactggttaaaatgttgattaaccagcttttaatcagttgtatttaatatatatgtatttagtgctcattttattttcccttctacctgcagg

SEQ ID NO: 43052 - DNA, 1501 bp, Oryza sativa
catgcaacaaagggactttttttttaaattgtgtaaaagtcacgtttgtaaatacatcatgattgtactacaatcacaaatgtataggcggtctcaattttttgggaaaaaacgaaccatttagcagtttagaaaatgtactaacagaaaacaagaaagttgtactccctccatccacaaaagttacacctattacttttgtcaccaagactaatgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaggatctaagcagcggaaaataaataaacggcgcagacggctctactccacaggcagcttgaccaaagctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccacaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtgaatcattagttatcccataaatgtgctaatgtttctaagcagggctaagcaattatatctaatatctagttgaaccaatataaataaagctcaactagtcaaattgtaataacccaaggtatcaaggaataaggtaatc

SEQ ID NO: 43053 - DNA, 1501 bp, Oryza sativa
gccaggatccaaattatatttggaaggtttaccattgatgcccccatggccaccaccggctggagtaagcttcctggcatgggagccttttgatattggagttttagtcattggaaccgtgattttaacacaggagatggctgggttgaaaccatggcctccaccaagtctagtaagttctttggcatgggggatggagggaagagaggtctatggtcttgcaatgcaggggcatcatatgaatagccaatctatggaacttgctcgtattatatctaaagaacttgctcgtattatgaaggaaagacagttgagcaacaaagagctgcaatgtatatttgaaggtgcaagtcctgggaagatgtgtattaacccaaaagcattaattcatgatggatctttgaggtcattgctatccaagctacaagttcactctattccaaatgccctttccttcactaagcaagagcatatcaagtcattaagcttgtcccagtgttcagacataatggttcggtttgatctgacatggaacttggaggtgcatttggactctggcggggttctgcttcagttccttaatgctgcagctctactgtaccatagaagagttgcacaaggatataggcgcacactcaagctctctatatgtgaatcaatttccatgctccaggtgattaaatcaatagctgccaacttaatttgggatgtggaggctagaaatcgtttggtagtcaagaaacaagatgaagatttcagtggcaaccattgggcaagctttcagactaagatggtgatttcagagcctctgcaatctatcaaacatgcatttttttttatcttatcacagagcaaattcagattttaccaaggaatgcagcttttatatcaacaattagttatctgctggaagcaaagtttttgcagcctaaaggactaaaggtaccatgggatccaagaggtttctttcattggcttggggacaagccaaattttaagaagaggggattgtcagggcctctactaggctgcaccatgggctcggttagtcatgttccagcccaggcccaagcaagcaccactaccagcatatatgagcagcaacagaaaacatgggggcatcgattgatcaatttggcgagctgaggctcacggcggcggcggtgacctgggcggccggtgggcatccctcgttgatctacttctcttcttcctcctcctcctccttcctgtgttactagcaacttgtatcccccatttcttcttttgttcctccaaatatttgagtgttgaagcatatatgtttgctatttgaattggagcaaagggtgctaacatcaaggcttgccaagctctgcaaccgtgacaatacccacctgacgatgaccggcgtgcggggcacgcggggctacgtggcgctagagctgtagctattgttgccagtgacacataagtgcaacgtgtacagcttcagctattcagcatgttggtgttcgagatc

SEQ ID NO: 43054 - DNA, 981 bp, Oryza sativa
atcaattattttgttaatgcatgattggctgacaacttgacatagccatgtgttcctatgccctattcctgtctgctatgaaggtttggattaacccatctaggacaattctttttggagtaataaattgtcacatgcatatgctgtaatctatgatcaatgataagtgctccatgtcaggattgccaggttgccaactggaggtctgcctagcatgttttattgttcggtcttctggctatacatgaaaaattgaggatataatagagtgccagattttctgtcctttggctgcatttttcatgtggttctagacattatattataatcaagcacaactcttcaccatacaacaatgcagaaaaaatgctggaaatatcccatataacaaccatcatctcctgtacaaatgaatcaagaaattcaagatcacaacattggtgaaagtgtttttttacaagcttttgttgtctgaagatgctatgcgtgcagtgttctatatctgcaaaagtgactgaagcagcaaccataaaagtataagatcaaaatgagaagcatttcaaatattttgtgattttattcctttcattgggattagtctcctttttgtcatcatcagccacagcgcgattgttatgatctggtgcaggtgatagtggcgttgggctgatagaattactcttgttatttacaggagaaggtgaaattggtggtgttggatcagcagttggcacagttgtaacctccttgccatcacagacaatcttgacttcacagtatagaggtgcgttcttctgaacctgtcctgctattgtgtttcctctcttgaacttcctgtgctcattcagacaaattcagaatgtatttctgaaatgccagcaaattattttggtagttctgttaattggaacttgcaaggtatataaaccttaccgcaatttggattttgaaacccccagaactagctgttgtacatgaaag

SEQ ID NO: 43055 - DNA, 1501 bp, Oryza sativa
tggacaaggttgtcaccacctgccgcctacctcactttccttggagcacacaacaaacgaaggtaacctctaacgtagacactacgtctacgttatcgattactattatagcctcggccaagaacttccttctttatccagagtctttgtactagagcactcaattgcacacaaagggcctgttcagattgatgacattttcaaccataccattatttggtaaaattgacaattatatggctacgtttagtttgttaccaaatattggcaatgcgtatataattttagcaacattattaagccaatcctatcaaaattttggcaatgttgtcaatttgccaaaattttgacattgctaaattttggtaaggttcattttggcatcaatctgaacagcccctaagcgacaaacccgcaaatgagaatatatatcacttaagtaaaccaattaaataacataaagaaatctcaaatacttactttataaaagaagcatccaccaaggtacaagatcggagagagcgccgacactctggcattcctctgggactgccatggaaagagtgctcacaactccaacactcctccggaactccttataaagaactccgaactttggggcactccttttggagctttccctcaccctcttcccatattctaactctacgagagagtagcctagatatcaaagtgagttgtactccacttgagttgtgtgtcttgagtgtgagatgagcacctccttatatagccatcctatggcggttttgacatttatccaagccgtgaaccccgcacaaccaccatcgggacttcattagggacctacacgtgtcagcagatggcgagaggacacaatggtggttcggccgacccctttagcccacctcccaaccactccttcgattgggaggctgcttgatgccccccctaacatcttatactatggctgggcttaattttgttagaggataaatcttgcatgcttgtttttagctagttagttaagctttggattttgttttgtgcattgtcagcgcatgagccccaacatgtggaagccgtgcgtgtaggagtcaagcgagaatagctcgcggcgtgcctaagcctgcgggcgtatgcgcacgatgagcggacgcggggatggacgcgatcaagccgcgagtcgtgggtagcgatccgagtttttggcgtcgctttgcatgtttcagttctgcacaataaaaggagagaaaaaccccgaaaagctgcaagcaattcaggcagcaccaaaaactctatttctgttgtccgttcgtctacagtattgtgttctacatgttcttgtgttcttccactttcgcgtgagttcatccagtgttcacaagctgattgatcaagggtttcctgacaattggtatcagagcaaggtttagggcttggacacgtgatcgtgcactagaagaagcacttatgccaaggcgtcgcacgagctccccgcgctgttggtcggtgtcgc

SEQ ID NO: 43056 - DNA, 318 bp, Oryza sativa
ctatttttatatagattgatgggctgaataaatgtgtgatgtgtgtggagatgggcaaatgtgttcatgtgggctatatttggcattgaggagacgttcatataggctatatttggcactgagaagacgaagagactcacctggttgggctcaatcctacattccatctaacctctgaaaagcacgaggtttaagcttttggaagaagggattcgtcagtcggtaggaaaagtactaaaattgtctgggccgctgtgggcctcatgcctggctctctttaccgggcctcggcctctatatgggcctaacaggtagaca

SEQ ID NO: 43057 - DNA, 367 bp, Oryza sativa
gcatgccacatcttcactcactagcaattactattctagcctattttaaatcccgtgcaagcatgacatatcatctacaatattatattatagagatcaacaagtatgtgtcaaatcatcttcctctcattattttctcaacatatcaactttcatcattttgacaatatttaacatatactcatccatgaatcccgtaggaaagcgtggggtatcacctagtctaagaacaggattcaaccaaagacaacaactaaatggtaggcttaggatagagaggatttctatggattcaactagctaacttaagttaaaggtaaaactctatcaaatgtttcgtacaccggccctcctttggtcatccaga

SEQ ID NO: 43058 - DNA, 697 bp, Oryza sativa
tttaaaggggttcagaggcggcggcgaaggcccaatgcggcggcaacggggaaggaaagcttggcttgaaaagagggaaaccgattccgaaacgaattgatttccacgaacttccaaaacgatttagccaaagattccaaaggagaaaaggtagaggagatcccggagattgttttccctcaaacaattcggccggagaaggaaaggaacggccggatttggaaaggaacggcggcggcggcgcgctagggtttcgggcggcggcggacgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaatttcatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaactaaggagaaattaaatcatcttgg

SEQ ID NO: 43059 - DNA, 1501 bp, Oryza sativa
ctataaacttagtcaaacataaaaaggtttgactaaaaaatcaaagcgacttataatatgaaatagagagagtatattttagccataatagaaaaggaaaaatattatatatttaagagtataaatgtgtcagaaatttgtccttttttctctctctctaagtataatgaatttgaagttaggtgtgatactattggaagtgcatgtacatttttttttagaattttcggtgatatttattagttagtgtgcacgggacacttgtgtgtaccatgttcggatagacagaataaccctttttcagaacaagggtagtggaagcgagcctacaattctagttgattcagaggagttacacctagttccttctctatatgggtaattttaccatccataagaaaataccgggaggtaatatattttctagtataaaacccgttaccttcagctattagatattttagtatgaaatttagtacctatggctactttctcatcaaggaccgtaaaatttctctagataatgtaagggcttgttctttatgggtgatgtatagaattaagtgtatggaaattattcgagaatataaatgaatgaattaaatattaaaatattgaattgttggttttcaaaaagttttctaagaaatgcccataattaaagtttttacaaataaagtatggttttgaagcttacgaagtgtgccgtatcatctacaatctgtaagctggaaagaacacgacccttatgcgagaaagaactatatttgtttttgtcgatgcatctacagttaagggataatggcccatcagtggtatatttctaaaacccacgtttaatttttcgatttgacaaaaccaattataatttgctcggtcaggtacaaaagtacatcccatcacgaattttgcttcatgtgattccgcattaattttattctctgttctcaactccatatacgtggagtatattggatggcaaacagtagagtagactagtagttcgagtgttataggtctctgagatgccggcgtgagcagggcgagtactttgttacacttccactgaaatgtgaacagaccagtacagtgagattccgttctcgtagcttttttttttttctttgacactcgcacagcaattcatcgttgattgctgaatgatgcagacaggccattctttggcatggccagataggggagctgagaaggacgactgcctagagcttaggaaaacccagggctttctggtatatgcagagatatatactgttgtataactctcattttaggctagctgagcaatatagataactcaccatacagtaaaaaatgttaagagcaaatcatcagtacataactctgaagaaaccgttcggtttttctggagggatagggcgcgcaggatctatatttaaagtcttttcatttggacatcatagtcatggttgagtctaggatttatgtttccttctagcttgagtcgttgttaaatattagg

SEQ ID NO: 43060 - DNA, 262 bp, Oryza sativa
actcagttcatttgcatattaaagatgactcttctgagatatatattttctactcagaacctgggaggctgatgacaaaattctatctgaaatttgatactatgaagcttattgtcaaagcttctgcctgttgcactttggaagatctgttgcatatcatctgccactctgcagagattacttgtaggtaactccagtttattctaattaataattaaatataataaattagcgatttgattttttttctgtaatatcaagg

SEQ ID NO: 43061 - DNA, 162 bp, Oryza sativa
aacagtgaaattaaatttctttacgtttataattttacagggatgttttaggtctcactgttgactgtacaaacatactgttacataattatgtattattccctttcttgttaacattgttttgcatgtttttgtttgaaataaactcttccttttatcagg

SEQ ID NO: 43062 - DNA, 1501 bp, Oryza sativa
tgtcctggctacaaatgcaaaagactgagctcttcttccatcaataggaattcttcataggcctgcactgacagaggaagaagaaaagaatcttccagtggtcttgagcacatgcctaagactcatttttgtgtgggcttcctaatttttatatgggaaattggttaattagtatatttttttcaatatgctctattgttacactgataataatacatatggtaaatactccgacggaccaccgtaaaatactacttcctcggtttcacgacgtaagacttcctagcgttatctacattcatgctatgaatctatttgaatgtggacaatgtcgtagacaatgctagtgcctactaggaagtgttatagtgtgaaacggaggaagtattagttatatacacatgttttcattatttttaagaacttggctctgcttttactgaattctattctttttgcctttttggaaagtagtaagtatttcagtttatacattagtgctccaaaattctttttaaccaaaatttcgatgcggaaaatggctacttcgtcccttctttctccttccttgtcccttgtactgatcttaaaatgatggtgtaaattttacatatatggtgtcggacattattcctgcattgatggctgctgatatgggccatcggagtgcactgatagcgaatacggaacttctatctgacctgcccacatttatggatacaataactctgcacgtttgaattttgaattttttaggcgaagtttgatctctgcatttttcagatttttttggactcgtttgaatcttggcatcgtttgagcagctagtacgtacgttggcttccgtgcatcagagatgagaatccaagccataaagaagccatgaatgctcctgaatgagagagaactgtgctggagtacttcatccataggagtacggccaaaatagggttcaaaagattcgagaaaagacagcaaattttttacgtttagcctgctaaatcctgaccatgtccggacaaatttatcccggcagtatttacacagagcttcttttggctcattagctgtgctttacttaggtggtgtttggatccagagacttaactttagtccctctatttaaacactaatttagagtattaaatatagactacttacaaaactaattacataaataaaaactaattcacgtgacaaattttttaaggctaattaatccataattagagaatgtttactgtagcatcacataggctaatcatggattaattaggctcaatagatccgtctcgcgaattagtccaagattatggatgggttttattaatagtctacgtttaatatttataattaattttcaaacatccgatgtgatagggacttaaaagttttagtcccatctaaacagggccttaggcccctcacagtggcttagtcatgccacgtaggttttttgccgccgtggagggagggaccgcgccttagctaggttcgtcgt

SEQ ID NO: 43063 - DNA, 671 bp, Oryza sativa
actaaaaagataaaaataataccatcattttgctcaataaaaacattcaattatggtcttcttttctcaatgcatgatatatgataagtatcagtatttatatggtatttttctaattctttcatattagtttttacatatatgttaatttagactaatattttttcccataattaaatggataaataaatcttttttctatatttatctaaaatattttaagtgtatgtaatttaatatgtaagatatggacttatagtataagatttatcttttttaaaaaaatgtggcaccatagtagatgggtagtttagtgaacaaccataagaaatacgccctccatcccataatataacacattcacctaaaatcttttattttatattatagtacggagggagtagagaatttgttgtatgccactgattttggccatattctatattatattaatgtatcaatgagtttgtcaagttctacaatatgccatcgtattttgtttaacttctataatataccatcgtcattcagttaggctccattagtgctattgtacaattttatcctaatgaccgaaataccccgtgatgaactttccaaatttggttaaaaattttctgaaatatcaaattataaatcttccaaagtttgagagcagcaagtcattgcaa

SEQ ID NO: 43064 - DNA, 584 bp, Oryza sativa
gttgcaacccagtcatccttgtgtgtccttgttgactattacaacctttggctatagatattgttgtggtttgtcaggaggagacatcgagatttagtatgctatttgtatcttcggaaacgtatcctgttccacaactctgacttggtttaattaactagataaatctccttaaagacatggtaaaacttgtccctttgcccctgttcaacaatagttttgacattgacatttctttctttctttatttgtttgttcagttcaaattaaaaaccattcaggtccatgccatcatgttgaagtgaatctgagcaacaccaatatgccattgccatgggggaaaaatcgcctcaggaattacctcagtccttgcttagatgggactcaatcccaatccattcacgtgtatagggagggaatttgaaactaaaatcttgggccatccaaactgctcttattccgcaagtttagggggttaggaacctggttatgtagttcaggatgagccagagttcagggaataaactgaattactctgaagccttctcatccttgaaaacctgaccatgttgcatctttgcagg

SEQ ID NO: 43065 - DNA, 764 bp, Oryza sativa
cataatactcccctaaaattctaatccatatatctataggaaggggaacttaaatagactttgtctgagatttttagaaggcccaaaaggctgagaagacccaaaaaaaaccttacccaaccgtaaatctcatctccctcggtcgctcttggctcttgctgcagaggcgccgtcgtgctgctcgcgtagagagaggcggaaacgcgcaagggggcagggacggcaccgcatgcggcgggcgcggcggcagccggcaaactagcgcctccaggcataaacgcagagtggcgacggggccgcggggggacgcggcgcgataacactgcagaaacacgcggcgcgcgggcacgccggttgctggccactggcaggcgtgcaacaacaactagcaggcaagcagcgaagggccaagccgccaagggtggcagcagcaagcaggcaagcagtgccagcagcaggccaagtacttgaggatatgaggtatagaaaatttctgatttgttatttaaaatcaatttcaattgtcaagactagttgttattaatagttcaagtcttcaagaaatcatagagatattgaattgaaaattttgtttgtgattcctagtttgctactctgctatattgctagattgtgaagatgccaaaaagaacactgctcacatattattctagttcaagtaacacaaataccagcgatcctccactcaataatgagattgcaagtcagtcaaagaggcctagggtagaattaatgttcaaaca

SEQ ID NO: 43066 - DNA, 167 bp, Oryza sativa
ttggaaggctgcgcaagacggacgtccaaccgatctttgataaaatagcaaaccgggtcaccggctggaggggaaaaaacatcaggccagcagggcgatcaactctagtcaagtcggtactgactgcgcagcctatctatttgctcactgccctcaagatctctaag

SEQ ID NO: 43067 - DNA, 1501 bp, Oryza sativa
atgcactcgttagtgctaaccagcgaccatcttttttaccaaaatagtacagtgggtatcaactcgttacccttcttaatagcacctgccacttgcatcctcattgcccatctaaattccaaataaaatttttctcttaaattatttgtcggatctacgatccgattacaccattgtgctcgttgcaattaaatctgtacaacaagatcttacatgattatattatgatgaaaaaattatttatgtttgtaaactacttttattatatactaagttacttttatcatatatataaattacttttagatttgattaaattacttcctatacattcataatgctatgaggtgattacttttattattattttagtcaattccataatttgtgctgattaatttagtttctagatagagttatgtttttatactacaacggatttacttctaatgtcatgacaaaattactttctttttgtctcaagttacttctataatatatgtaaattacttttagactttattgaatttacttttatatgtctaagaagtaatttagtgaaatctaaaagtaatttagatatattataaaagtaatttgtaaattttcatcgtaatataatcatgtgagatcttattgtaaagatttaattgcaagttgcaacgaacacaatggtgtaattggattgtagatcagataagtaatttgagagaattttataagaagggaaaaaagacatggatgcctaacactccgatgcttctctcaaattgtaaactctgatgcttctcgactaaatcggatggccgcgccagtcgtcgctgtgtaagaccagatcgagaggcctctcgttatagattttacgtttttaaaaatattaaaaaagaaaaaagtcttaaaacatttacccaaacttctttgtcatgcaaggagaccaaacggaaaatttcataattttttggaactgctattggtgtcaatcaattgccaacccttgtatgtatataagggcagtttggttattctttcaaaaatagctgggcacactgtagaaacaattgacgaactcggtggcatattgtagaaagggataaagtcgatggcaaattgttggacctaggaagttgataaactcagtgacgtagagtagagactcttaaattaactgatagccatgagcctacggacagaaatatttagtaagtttttgacccaatgaatggtgcaataagctgcaaaggttacagaaaatttgtataattaatttttaaatttgaattcaatgtctgcttgtacattgtcttgatttcatgtgcttgcaatgttatgtattatttgtacatttcaatccatatttaggctatcctagattacaggaactcaatttgtaatactattttgcatttcaacatgcataagctggcaatttgcaataatgtgcactgctttctttaatggttgtggtgtctgaataatcctctgagattgtttctgtaacagg

SEQ ID NO: 43068 - DNA, 234 bp, Oryza sativa
atcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagc

SEQ ID NO: 43069 - DNA, 243 bp, Oryza sativa
catttgtttcctttgtcttgttttttaataattgacagcattgagtcctattcgtactatccatttgttagatttattttcaatagtactattataatagtatagagttcaaatattcttaaatttattattattattgaagtagtggttaaagcttatatagctcagtcaacgatgtttaattattgaaaaacgaaccccactgtctagttaataattacagtatctggcaccatttcatca

SEQ ID NO: 43070 - DNA, 240 bp, Oryza sativa
tcttggtattctttaagctgcttaattggagtttgctctttcattatgtagtttaaaattcttagctattgctttccgacttatattataaatacttaagaaatctcaatttcttttttcttttcctcctagtgcaggagttgatcctccatcctctcgtgatcctcctatcccacttgctgcaactgcttcggaccatctgtctttgcagaattccatattgctggattcatccctgcc

SEQ ID NO: 43071 - DNA, 221 bp, Oryza sativa
actttcagctatatgtggcctcaccatcaagtttgacccaggctgctcagaatgacgaaaatagttctttacatcagaaacttgggcttgggccttgtatcattacagcccattaggggtccacaaaacctagggtttgctcccacctcctctcctggtcattcctccaactatataaactcctagcagccaccattttgcactttgggttttgttttgat

SEQ ID NO: 43072 - DNA, 1501 bp, Oryza sativa
gatctatcatccaaaggctagaaataattagggtgatgtgggttaatgagaagagagaaatagcattaactacacttaatggagatgaactatataagtatataggataactattgtgttttgttcagattatacagtctatatcacattatatgccatagattaatttttaaaatttaatactctgctgtagtaatcatgattgtgcaatatagtattttgctacaacttgcattgttgttaaactgatcattctgtctcaatacgaccaaatagtgtggcccatcgagtgttgcacgcgtgtttttttctagtctactaatctaaagctggccattctttctaagtttgattggtccacgtggcgccgtattttgcgaagtgactcgtgaatacgcatctctagctagcagcggtttaaactggacgtaacaccggcaaaaaggaaaaaaaaaaggaagaacgggcgcacgcacagggctgaggttgacaccgagctgtgggctatacagcccaatcatgtgtacctgggctggtcgtttcatgctgttcatgctagaattcgcacgttggacgttggctcctcgtggccactaacaggcacccatgagcaaacagaaataggagaagaaatagtagggaaaaataaatacaaataatttcgtaaaaatatttgaatatataaaaaacatcataaaaaataaacgaaagaagtaattttggcacccctaattacatgtttgtcacaattaacataatttggtttttctcattctttgacaaacacaaaattaaattcccgtaatatgtccttcttaaaggaatttctaagcgtgtgaaactactatgtaatgtacacccatacctatagacacaccacatacacatcctaccactactgtacccagggttttcaattttgaacagggtttttttttgccaggggttccgaattcacgaaatcaccaaaatttcggaagttttggtattttttggcctaaattatttgaaaatttaactaactttaaatgaatgtaaataaacttttaccaaattcacataaatttgcaaaaaaaaaggaaagtttcgggcaagatatgtgcttgccggtgggggcaaaattactgaaatttccgaaatttgttccgaaatttcaatccatatttgtccctttgaagattaaatcatcattcatatctaggaattgataatggctggtacatcacctaccactgaaaaaacaaatagctgtaaataagaccacacatgttaactctataccttaatcctgaatagacatgttccaccacacggaatgtaaccaaccgatctacacttagtatatcctggatatataaaatcaagataagtatctttaccatgttggtgtcctttatttttatttctagaaaatgaaatgggtaatcaaatacacatttatttagatatgtatttcctactaattatgcaacatctatgacttacatgtataaaaaatgat

SEQ ID NO: 43073 - DNA, 643 bp, Oryza sativa
tggtatacacacgtgggtgtgatgtttttgaccggaatgaaaaagttcaaaaagcaccaaaacaagatttttggacatattcgagtttattgggtgcgtttgtgacaaaaaatcaccccgtgattcgcacggcgaacttttctcaattaatgccgatattggcatatattggcacacgtgggtgcgttatttttcaccggaatgaaagagttcagaaagcaccaaatcatgatttttggacatattgcagtgtattgggtgcgttcgttacaaaaaatcacttcgtgactctcgctgcaaacttttgtcaattaatgccaatattggcacacgtgggtgcgatgtttgaaatgaaaaagttcaaaaagcaccaaaacatgctatttggacatattggagtgtattgggtgcgtccgtggcagaaaatccccccgtgactcgagcagcggacttttgtcaattaatgctaattgcacaagtaggtgggttgtttttcaccggaatgaagaactttaaaattcaccaaaacatgctatttggacatattcttgtatattgggtgtgtccgtggcagaaaatcactctgtgacccgtgcggtgaacttttgtcaattaatgccgatattggcacacgtgggtgcga

SEQ ID NO: 43074 - DNA, 446 bp, Oryza sativa
agccgttgatgtagttgagagattctaggacaacgaccttcggccgactggatctgataattccaatgataaaaaaactgacaccgactgatgttgtattataacaatgattctgatgatgaagatgatggaggcacaatttgtacaatactgatgaatttatgctgtgcttgatatttcaaacttagctcctgatttcttaaaagcttttgtcaaaccttattgagcctaaaacccgcaaaagttattaaaaactttcagtcctcattgactaagccaaaaaatcaaacaaggcaatgataaatcaagtaagcaaattgaattgataaaaatcatactctattattattatagtagccctcgactgataactcaaggaaaaacatgatgttatcagtcaaagagggaaatacaaaagtaatgcctaagcataaaattgacgaaga

SEQ ID NO: 43075 - DNA, 1501 bp, Oryza sativa
gggaacgtaccgggtgtacggtttcccgctctcgcacttaaggaccgattccttagaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagtgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagatgcactgtctcatccgtgtcgtttgagaagcactcacttagactttttagaaaagagttcaaacaaaatcaattacgaaaaaaacagcctttccttgaagcctgcattaaacacttatttcccctggcttgctgagtactcccgtactcacccttgctctatataaataatcctcccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcgggactagttcggggcgtgacaagagatggtatcagagcacaggcttggccctagggcgaaacccgacacttaggacgaccctaaggatactaagttcaaaactacttgcgaaaagctaaggtttcttttgtcttctttattttcaatagtttgtttctaaaatggttactgatctttctccctctttcaaaattgtagatggcagtgaacgccagtttcagttcccacggttttggtgagggtcaccacgtcgctcagcttcgtgacctcgcccgtttccttggcttctcgtgtcccgagtacacggggtactccgtggaccgtgttccccctcactg

SEQ ID NO: 43076 - DNA, 450 bp, Oryza sativa
gtgtattgggtgcgttcgtggcaaaaaaaatctcttcgggattcgcgcggcgaacttttgccaattaatgccaatattgccacacgtgggtgcgatgtttttcaccggaatgcaaaagttcgaacagcaccaaaacatgatttttggacatattggagtgtattgggtgcgttcgtggcaaaaaatcacttcgtgattcgcgcggcgaacatttgtcaattaatgctaatactggcacacgtgggtgcgatgtttttgaccggaatgaaaaagatcaaaaagcaccaaaacatggtttttggacatattggagtgtattgggtgcgttcgtggcaaaaaaaaatcacttcgtgattcgcgcggcgaacttttgtcaattaacgccagtattggcacacgtgggtgcgaagtttttcaccagaatgcaaaagttcaaaaagcacaaaaaca

SEQ ID NO: 43077 - DNA, 1501 bp, Oryza sativa
accgaaaaggagtttttggtttacagccgagtatacatgaacctacagggtcgcacgcttaatgggccggaataaggcgattggatggagatccaatataagcttaattcggatagggatccgaataggagtcctacaggccttggaggcccgagtgatggatcctatatattcgtaaggggtgcgaacgacggagatattgcatcacgtgagaaacctaagccgtcacttccctccccacacaaaaccctagccgcgcgcgggtgctagcacatctccgtgcggcgttctgtgtccctgtacgtgtggataccggtagaggcgccactggtttgcggtgctgatcggtgtgggagtacggtgaggagaacgcacgaggaggagaaggtcgagccggtgcgatcgactacttcctctacatcgacgcgcgctacttcgcgagagttccttcgactttgcagcgtcttcttccgctgcgcagcgcgtcgagtggtaacgatctatgatctaatacttgcatggttcctggtttacgcgatagaaaattttgatttatgctattgtagcctacgcgtatcccaacacaaatatccagagatatgttcgcctttgcctcctataggttttttatcagagctgtagattataaaaatgctcaaccatgatgaccgtgtctccttgcgagtgcacctattcaaaccctcgaagaagaatagaggaggagaactcatctagtctcttatatgaatgaaattgtgagctacgtaaatcactaatcaactgcgtaaatggaatcttagcagatgcgcttcaccatgccattgaccggctgacctcatcaccgcttcaatcctcgaccatgtcggcagttctccctccgatatttttctagtgaaccaattcaaaccctcgtaagaacgaagcgatgtgggagaagagaaagaaagcacaacctgatttttttcccgtgtagatatgatcgatgcctaggtagatttacattctctagcgttgtggagtttatggataccccatacctacacggcatgtatagtctgactgggtatggggtgtcatgtatagatagaatatatttaaaaggactcgggttaaattccaaacttgtatgtcaaggaaatatctgagatcctagttggttacgattgtattttatctgtaactacatattccgttagggatatggactgtattttgtaatacggactccttctcctatataaggaggggtccgggtgcctctaggggcacgattttcacccagatcatacgatcaataatacactcggcggatcaatccccggacaggagtagcgtattacttcttgattaagaaggcctgaacctgtataaaattccttgtctctaaacccatccacttttccagcttgatagccacccccttttagtattgctgaaatcttgtttcgacagttggcgcgccagctaggggtagcgtcaagttcttcgccgactagtgcga

SEQ ID NO: 43078 - DNA, 1501 bp, Oryza sativa
gggagcttcagtgagcaacacagggtgctcctcaggtgcaacacgaagctcattatagaaagtgtgatgccagatcttctccatgtcatcccagttgcttacaataccatgctcaattgggtacttcaacgtgagaatacctctcttggactgtgcttcgtcaccaacatatgcatccttctgccccatccctaccatgacaccagtgtggcgaggacgaccaacaatgctaggaaaaacagcccttggtgcatcatctccagcaaacccagcctgcaaaattttaaggaattcaaattggtaaaaatgcagttggagtcttggagatgatagatggtttaaaagatgaagttcctgaccttgaccattccagtgccattgtcacagacaagaggctggatatcctcaccgtcagccatttcctatagatttactctgcaaaaataagtagcacgtgaaggttgtcaattaaaaacaaagaaataatatctttttcgatagttactatactgtgcagaggaaatcttgaggtgctaataaacatgatctctaagagacataagctggaatgactaggttgggttatatagctacaagtaattaacaacagaatacgtctagaacttgctttatggctagcatgagatatgctgccactcaaatagagtaatgaagagtactaacagagcttcacagttatcattatctcgtattttccactattaagaaaaagaatgcatgccactaatctcatatgttttgcatgttaatttgagtccatacataaataatattagaacaactaaagtattgtcattaactacttctatgattgcacctgacctgaatgaataaaaacataaatgtttagactaattagtgagcatgtgctagttgacagcccttcttatatacggcccacattgtaccagttctacaagaagctggaagactacaagtattcaaaaaccaaagtgtgcaccggcagtgctacctaaatcagcaggctaaatttatattcctgacatcaggaacccaccacccaaaaccaggatgcataatctacaaaaaaaaaaagtatgcaatgtgattttgtagtagctggatcactcaaccattttattactggcgatagattgcagagcacaaatccacatgtaacactaggtttggatctgaatttttcatgagtgctcaccaatcaccatgatggaacatgataaatagcatggtagcttacaaggatatgtttgtagcatcacatattcacattcctaacaaattttggatcggccataagctgtgactacaacagcttcacttattcctcctgtctttggttgaatggtctaattttaaacttgttaggtttagaaaatccaccagtgaattatgcaagacgcaaatcaagaaatgcacagcctacagcctactacatgaatttcagcacattcaaacacactgagcaaagcaatgccgctgcccgagttgacaaggccat

SEQ ID NO: 43079 - DNA, 1501 bp, Oryza sativa
ttcagcaactgggggaggattatttatatagagcaagggtgagtacgggagtactcagcaagccaggggaaataagtgtttaatgcaggcttcaaggaaaggctgtttttttcgtaattgattttgtttgaactcttttctaaaaagtctaagtgagtgcttctcaaacgacacggatgagacagtgcatctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacactaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattctaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaatgatcaaatgcaacaaattaggtaggtctgccaatctgccttgcagacgggacaacagattaagtgtgatcctatcaatgcataatatttcgcaagcaaaataattaaatttcaaatataggctcaagatgttcaaaggtggcttgccttgctcgagatctggagcttgatcctcgaaatccttgcactgcgggtcttcgggctccgaaactacacgcgaaacgggacaactcaacaaaacggcgaaaatagagccctattaaagacctctaagcgtgccactagatagatctcgagatttgggaaattttagaagttgaatggagtcaaatggaattacggttgggaagatattgaatttataagattattggatttttggtctaaaggaaaaggatttaattaaatcctttttgaaaaagaaaagaaaagaaagaaca

SEQ ID NO: 43080 - DNA, 1501 bp, Oryza sativa
gcactggagttaagcagatctcccaggctattgtgttcgttgagttagttcgcgccaatacagatctggcaccatcggccgagcgcggatttttcatcaacacatatacaacaccaacattaaattaatttaataaaataaatctactattgtatagtattcatgtttcaggttaaaatgttaattattatggttttaatagaaacttgctcaaacatggagaaatttgacttagaaaaaccaaaacatcttcattttaaaatagtggttgtactatatgacaaccattatatctagacaatttacacccactaccaaaaaaattcatttttcctgggagccaaaaccggtcctggcatgcggttggccagcacgcatgcacgaaaatgtctgcaaaaatcactattttcgcatgcgctcacccttaatgcagcacatacaataatcgatctttgcatgcaactgggttaagtggcccgcatgcaaagatcggttttcgcatgcagacaagttaggccggccgcatgctccatgaggcccattcccaaactgggcatttgggaagatcgtgtctcgtatgtaatacaacatttcccgcaatttcataatcgaaatttgaaattctacgcataggagctaaccaagttgtcattctaactacaatattgcattgacatgtaaatagtcttagaataaataacacaaaacatttatggacgtgtcatacatatattacaaataaacaacagtttcatcacgaacaaaaatattatattttcactatatatgttcttcctcccactctcctagtgggttgaatatgtcttttattgcgatttgactctccttttcgtagaatagcccaagtgcattgtaggcatcatgatgggtgaaacggcagtgctcagcgcacatgttccatataattgtgtcgtcgaaccgatttgctacgtaagggattgacgggatctatggacaaagtggacaataaatgttacaaagtaattttcgacagaataccctgtatggagtgcaatatccggacttacttcatcactgtttgttgtgtacctcttattgactctaaccatctcgcacatgtattatttacatagggaagtctgtggggttgtttaaaacactgtgaacataataataagagaccggtcaatactaacaagtaaggattctacgaaaaattgtgttaatatcatttgtcagtactgacaagcctgtcttggcgtgtagattattccttgtcggctcttttactggcccacctcttttgcggtaatacatatgtgtgttgttcgaacaaaacatttgttatagttacttagaaatttcataatagcaattatgcacatatggattattacattacttacaaaatcagaatagtgaggaactccatgaacgtttccttgtcgtagtgtgttgggtccaatgctacgaacaaatggtcctttggatatactaggaatagtatatagtgatcgct

SEQ ID NO: 43081 - DNA, 1501 bp, Oryza sativa
cccatggacagctgcagccatcaaagccgccccaccaacacaactccccacgaggccccgagcatatcatcgccttcgccgcaaagtcccaacactagcggcgaccggcgaggactccggcggcgacgtgggtgggactgagaagcgccgccgctgacaccagcgagacgaggcggcgacctccgttgacggtaacctacctaccaacctcgccattcctctccaaactgttgtgctgctgtctagatctcccacactacactagttactcctcgtagatctcggctacctggctcaagatccggggtcagatccgggtccggggattttctttgtgccctatggctgtattttggcgtctgtggctgatgacagcgtgtgttctcgagtgcggatgcaatctgagttatataggcaaatggccttgtcaactcgggcagcggcattgctttgctcagtgtgtttgaatgtgctgaaattcatgtagtaggctgtaggctgtgcatttcttgatttgcgtcttgcataattcactggtggattttctaaacctaacaagtttaaaattagaccattcaaccaaagacaggaggaataagtgaagctgttgtagtcacagcttatggccgatccaaaatttgttaggaatgtgaatatgtgatgctacaaacatatccttgtaagctaccatgctatttatcatgttccatcatggtgattggtgagcactcatgaaaaattcagatccaaacctagtgttacatgtggatttgtgctctgcaatctatcgccagtaataaaatggttgagtgatccagctactacaaaatcacattgcatactttttttttttgtagattatgcatcctggttttgggtggtgggttcctgatgtcaggaatataaatttagcctgctgatttaggtagcactgccggtgcacactttggtttttgaatacttgtagtcttccagcttcttgtagaactggtacaatgtgggccgtatataagaagggctgtcaactagcacatgctcactaattagtctaaacatttatgtttttattcattcaggtcaggtgcaatcatagaagtagttaatgacaatactttagttgttctaatattatttatgtatggactcaaattaacatgcaaaacatatgagattagtggcatgcattctttttcttaatagtggaaaatacgagataatgataactgtgaagctctgttagtactcttcattactctatttgagtggcagcatatctcatgctagccataaagcaagttctagacgtattctgttgttaattacttgtagctatataacccaacctagtcattccagcttatgtctcttagagatcatgtttattagcacctcaagatttcctctgcacagtatagtaactatcgaaaaagatattatttctttgtttttaattgacaaccttcacgtgctacttatttttgcagagtaaatctataggaaa

SEQ ID NO: 43082 - DNA, 548 bp, Oryza sativa
ttatccactttatattccgtcaattgctaaactagtctatgccatagaccagctggcgcccttggttgagttgtgccttcagacaagttttaaccctgttttagaacataagagattcagataaataatataaaagttacctttatgaaacagataattttgaagaagcatgtaatttagacctttgcaattgttaagtggtgtaaaatggatatattcctcggtaataatgtttagtccccacaacatgatacacaactgatgtctataagtaatggtttaatcataatggtagcttaataccttgtacgaactcatactatttctccgaaaggactacacaaacaagtagtaatctgataggcttctttgactggggatattgcttgaacggaaattctactgttggccgcgaagtgagcaggcaactggttttctgaggcattgatgcaaattgtactgtgttgtaggaagttcttatggtgggttatttaatcattgtacgtcataacatgcctagctaattgaccggttttttctcttgtagc

SEQ ID NO: 43083 - DNA, 1501 bp, Oryza sativa
ccagggttgtaattttgtaatttttctcctgctctatcaatagaacttcgcaccgtcttgtgcgagtcgttaaaaaaaagattttagtagattgacaattactgtggcgaataaggggcagattcatcttgtgtttgcactcaatgtcctaatgaaatctgtgattctctattacaaggattatgcaaatacaaatttaaataattaaataatgcagaatccaaattaatatttctaatcctcttgtgcttgacaatgcaacatatccacaaatatgcattctgtctcaaattatgcattaactaaacagtgataatgtgagtaaatgttctgtatttggtggtagaaaaatatgtaatatgcatgtagagatcatgacgcagcctccatgaatgtctgagatgtatagacctagcctctccttgtctcatatataccccagcatcagaaagtccattaacaacatcatattaatttcttcttttgttagaaattacattagttaatgcaaatatatagaaggagaaacatatatatgcatccacatatatatataagtacttaaagattgtgaaaaatatcagtgttatgaaattggacagtggaatctatagaccatgaaagtatcaaagtgtgtcatgccttgattttctactacaaatattgcaacaaaagaaaaaaaaatgaacccatggttttgtgctaagtacgtattacctatctaagttagtttgtagagtaatatagttaggtttgaacgaaaggtttaagcaattatcttgaatagctcatattttctcttatctgccaccgcatagcaaaatctgttcttctatatgcgaagtccagaaattaataaaaaaatgctttagattatccttttgtgtgtattaatttaatttgtgtattgattttgtaattaggaatatcacatacatgatacatgcagtatcacaaaaagaaaaaaaattcgaatatgaccctgtgtgtgtgtgtatgtgatttagtataagatcaaaataatttacatttgcgaccaaacgttatatcggatatattagtttaattacaataaatagtttttataaatcttaccccttcaatattcctagttgttatttggcctttaacacaataaatggaaatatttccatgatcattcatcagtgttattttcacaatagatgacgaattgaaataacttaataatagagaatcacaatttctattggctagcttgattggtacgatcgaataagccggcccctcatcagattagattttacattaattgaaattgtcactgtcattcaatctctctcatgagcatgtagcaggcaatatcatgaattcaatactaggttcgatcccaaattgagctgacgccgccatctaacaaagaaagaaaagtgaagtgggacaagaatggacaatatctgagaaacacacacataatcatatggaaatataaataatcaatacagcaaacaacatactatta

SEQ ID NO: 43084 - DNA, 174 bp, Oryza sativa
cagataaaatcattattgtacgtttagtttttcagttgtatttttctaaactagagcatgtacataaagttgtggccatattattttcttgttaattgtcaacggtgcaccgcttaactgatgcttgtattgttaaacatctaatttcttgcttcccaattattattctgcagg

SEQ ID NO: 43085 - DNA, 1501 bp, Oryza sativa
atagatgataccgttgactttggacatgacgtttgaccatatgtcgtattaaaaaaaataaatttgatttattttgttttgaactgtcttatcattaaagaaactttaattatgaaggtaataattttaaaagtcaatcgtgttatctattaaaaaatgaaggtaataattttattttttactgtttctttgtgtgtgtagatttcagaggttaaatgatatgaaaattttgacatatttgccctttcggaaaacttatttagactatcttagattatattgaatgacctatatatgaaaagtagagctgaatgggccggccctctagattgcttcaaacaaattaaaataccttagattatattgaatgacctatatatgtatcacctcccaaacaaactactattataaataaattgagttggattgtgaagtgatttgactaatatattaattgcaaatgtaacttcaacccaaccatccatatatagaacaacacaataataagaatgaaatggtgttcattaaaaaaagatgaaatggtacctatccccacgcaaatttttaccaattttaattacttgtggattatgagaattcatctccacaacctcctccacagctgaactggtacctcatccttttatggtttagggaaagtggcatcaagaggaccatgaccagttagggatagagtgcaatcctatatgctcaagccctaacagctctaggcttgtctctctaatccgttttaatcgtattaagaagtaatgaaaaatcgttaacacaaagcaagatcttatacgcatagcttaatttctaggaattagttctgatatatcacaccaataattacaaggattatacagacattgcacaaaagtacctaatcacttgaaaaaggcgtttataatttcaaacttcaattcaaaataacatttttgtgaactatggccagtaaacaatatcactgaaaaaaactgcagcctatttgctgtacatacacagtgaatttcccttaatcacatgagataggagtgacctaaaactaacagttaattaattaattagctaattgctccacttttagccacctttttgcacccctcttctgaccagacgaaaggtcaagctcatcatcctcgactttttttttcttctctgacacgagggcatctccagcgccgtcggctcgctgatcggatggcccaaggctccccttctcttggaatgttccaccgatgttctatggttggaggcgctgtgattccccgggccccacactacccattcccaatgacaccacccgctgggccccaccttagccgatcgccctggacacgaatccgaacagtagcagccgtcttcttcgtcgccactgtatataagctagccactacctctcccttctccttgcaccaccaccattgctgagctccaaagcttctagctgtgatcaagcaaagaagaattgaaaaaaaacatatatatattatatata

SEQ ID NO: 43086 - DNA, 455 bp, Oryza sativa
ggttggaaaaataaatatggggctttgtgtactgggatacagattgtgggtttgagtgtctctgttagttgcttcagattttaaggagcccatctagagatgttctccattgcgagctgagttttcctacgaggagaacactctagtaggagtagcttgcattgtggatgccctaatgaaggccttacgcatcctgctttctagaaagtgtaataccagccacctccattgacgcgtgggccccaggagactcctcccttctggccccacccgccatagacccctccaaaacccatcggccaagtcccaacggctccatcggccgcccgcctcgcacgcttcctgtaatcccgttggaggaggaagccagttaccacctcccgtctccctctcttgcggtggtggatttcttgccgacgtttccgtccccctctctcgctctccctctccgcagt

SEQ ID NO: 43087 - DNA, 215 bp, Oryza sativa
gctagctcgctctcgccgcacgtgaagtgccagcgtcggcggcccacggccacgtgaggcgccaccgccgggggcgacaaggtcacgcgcgcgcgcgcgcggcacgtcgccgtccgcacgccgtggcgcgggccgcgcctcccgtctcgtgtcccccgccccgtgcgcggggcgcacgcgcacgcgcacgcgacgacggcgaccgcgtctacagg

SEQ ID NO: 43088 - DNA, 1501 bp, Oryza sativa
acttattttatgaaagaatagtcttaacatataattatatttaaaaatattgttcgaaaagtcaaaggtttttatacatggttcgtcgtctccatcgccggcggcgcctccgtcatctagcgatgggccgtacgtaacaggcgaacttttattgtgccgcatggagaacagcggatccaacagtcttggttctcacgggcctaatcgccgcacgccggaaatggcccaatatgagaaattgggacggacaaacactggctgaccttgctgggccgcgccgtgatgaattatacgcgtgcttttaattgttcgcgccaaattaattgtgattctttttataacgtataccagtgttttcctaatgataaaccaatatgtacgactatcctatggagcagtagctagaaaaaaaaatgtaaatagatgagttcgtacagtcaccatcatttcctttttggacggttatccaaaaaaataaatatagcgacttttaatatgaatctaaatgcacgattatccagatttatagtaataaatgtttgtattttgggatgtttaagatactcaattttaatttgatggtatatctaatggtacttcttttaacttacttataaaaaggtaattgaataaatactgttagtcaaagttagggaaaaaatcaactacgtccagtagtgtatcagaatttttatatgggtgatccaatttctatatcttaaatatcgtaaatataataagattagaagtataaattaatcaaatgcacatcatgatatagaagtataaattgatcaaatgtctatcataatatactaataaggagttatttttctttcaaaagtttcttttcacatatgtagggctaggattttttttctaggttcacctatgactacatcattaataattaaaaaaacagtagtattatgcatttactttgtttaagccaagtttttcattttgttcaactcctctaaacctacggaaaattgttgacatgtgtggactatatatgacccagcatgaagaatttgtgtcataataaggacgtgtggtagagacgacgtggatgttttctttaacactgaagacgtaaaattctgctgctaaaagaagaaaaggtgaaatgaaaattgtgctgtcattaatgacttgagaataacttttaccgagtggagcatagaaaaagaaataagtgctgatatgccccaattggtgaattattaccgagcgcatactacccttttacgaaaagagatcgagaaaacaacgagcacaagaatcttaagaactatgcatgcataaatgcactgcacatcagtatgtcagcatatatagatgactcttgcgatgttagctaaggtgaaggatagtaagaatctgccatagtaggaggtaaaatgttagtaccagaaattctgatggctgcatgataaccttttgtcatgcatcttttccttaagattgctgttttcttagatgcagctgggttgtactt

SEQ ID NO: 43089 - DNA, 235 bp, Oryza sativa
ctgcgagttctctaggctattcaaatccatttatgaaatcgatgcagcagtatgaacatctaaaggaggctgcactaacctgtagcgacaagcatttgcaggcttgtctcgtacatggaggtcatgttgaatcttgttctcgccccacgataccttcacaacctacaatggtttcccatgttttgatgtgttgcctaacattacactgattggtgatgcatatcttatttcaact

SEQ ID NO: 43090 - DNA, 1501 bp, Oryza sativa
aaaaaaacaccagttataccagaacaactgtgcaggaagaagaaaacagatattccgataagtaactctaatatattaaatgcaacagcggcttcttcctgtaccaaaaacatcaaagaatgacagcactgatattccctgttttctcacctgccactcaatgctttcacagctggtatgaagctcctttgtcaaatgaacatgttctcctgtgtttgacggtgttttctcccatcgatggaaagtagtttgcaacttatcaatctgtcacagaaatatctttatcctcagtattagaagaataagatagatgcatgtgtgttgatggtgtgatatgttttcgaagttatgaaggaaataagcagcacaataacacgaaggggctatatcttcagcgataacaaaatctagcatagtaaaatgcatgaggatgaaatatgtttctgaatgtgtgagggagttaacaatagagatgcaaggaagatgtatattcaggaatggtagaatagcacagtgaacagcatgatggtgcagaatgtttctgaaactatgagttaaacagaaaagctactccaacagttcttaatcttaaggggtcatgagttatgagcttaataggaccaattagtgatggagtctgtaacatggcaattcagtgataatataagtgtatcagctaccaacttaacacaaatctgttcaaggtctgttcaagaacataattacaattcttccatcattacatcaaaaatgttaaaaatgcaacaccagactgttgtcaatttcccacgccctgtcacccagtcccattcctcaagcccattggacacaacatgtcatcctagcatacgttggaactactctaaattggatagacatttcttacagtgtaccgacaaatctgtactcttaatccttttggtggcatcgctagacataaaagacatcccaaatcacaggtagcatctgaacagaaacaggacgatcggcataatctacaaaatcggtcagaatcaagcaactaaggggtatgtctgcgcgcaaacgctcgaatttttggttttgatccatatgcatacaggacgacggcaactaatttcgcatttgctggaagcggagaaagggacaaaggagagaaagagcaagaattaccgagtcctggatctcctcccggacgatgtagaacggatcctgcgccgagctcatgctacctcctccaaaacgtcttccaaaacgaatccggatttggagggattggatttcctcccaaaccctagaattcgctcgcaggagagctgcgaaaccaccacgaggagtttggtgcggagatcggatgcgtcaccttgcttcggttgcgcagaggaggtagtgggccgtgggccaggcaggttggtggctgctggcccgtggaccgtggactcggtccacgaaaaccagtccacgcatctacgtggtggaccgggtgcaccacgctggcgcacctggtcttcttcctcccgaa

SEQ ID NO: 43091 - DNA, 523 bp, Oryza sativa
cacatcaaagataacaaaatcacatatactttcatgaagcaaaactgaataatattattgcatatcaacaatgatggatttactggcggaaatgagacatgatagtatgtatacctgaagaaccatggatctctcatattctacatacagacccttctctttgttgctgaaaaatagaatgaatatcagagaaaaatcattaagatgatagaggctaactcaatcactgaatatttaaaatgaactcacaaaaattgtgttgactttatcaccactgtgtgagcaggtaagttgatcccatgtgccaaagtattcggcgtgcaaagaatttgaatatcacccttcaagaaaagtccctcaacgacactcctatcctttaggcaaagaccaccgttgtgataaccaactgaaaagttgaaataagatatgcatcaccaatcagtgtaatgttaggcaacacatcaaaacatgggaaaccattgtaggttgtgaaggtatcgtggggcgagaacaagattcaaca

SEQ ID NO: 43092 - DNA, 324 bp, Oryza sativa
taatcaaaaataattaatacttttaagtaaattttatagaactatatatacttgatcaaattattgtaaaaatacagatttaagataatgtattagaaatatatatttaacaataaatttatcataaaaactatagatttaataattaattagcacaaaattatagcttatagggtttaaattcttagcatttatgttatgcctgagttataaatatccaagttttttactaaatcaatatttatgaaatttcacaatttatagttttatgataattaaagtatctgaaatttacttttactattattatttttgacgtgtagt

SEQ ID NO: 43093 - DNA, 1501 bp, Oryza sativa
ataatttatatattacttgtgataatcatattttaagcaggggttaagataatcaaagggtagagtgacacacaagcattaactactcatcctcataatatatcatctaagctaagtggaaagaaaagagaaaggaaatctattcctatacgtctaatatatatagtatacatacattctagttaactgatatactagctaataccctttatccgatgccctcctggtacttcaagaaggcacccctgactgccgagttccttacgacagcccgtcatgaccatacaaccggggctaaatacggaggaataccctccccaggaaattaacttaggattatatataggcgcggaggaatacccgtattgagctgtcgccatcagcggcccacctctcatccgcaatatataaccccaaataatgatatcccgtaatctagacaccacgtctaaactacccgatactactctaatatcatcgtcatgaccactctaatatcatcgtcatgacctagagtaattgcataagcaaacactatatccgcaccaaagcatctcctagataagctagccgtatatttagtataataagaacataatataaagtaggtactcatatactcggagaatatttcaataccataaatatatatagaagagtattctaataaaagtacaaagcatacaaaagagaagagaaaagctactagagccatacccgaactcttccgaaggcttacggaatcctgactcctattctatttctattccaccagctaggtactactaaactaaacttaagagaaatgagagagctattgcttgaggtgtgtgttgaagttaagagagtgaagcctttatctagaggtggttatgacggttgtggaagaggaattgtccgaagtaccctccaaccgtcattggggtgcaatcttggacgtccatgccaaaccctggcctcaacagtggagatgggggttcggccgaactccctggttcggccgaaccatgggctggcccaaaccagcccatcttcgcctggggatcctctattgcttcacttcgtagacttgtgaattttggcctaattcatcgtgtcaattctgagttcttttcccattcatacataagtctggttctcgacattgtccgattgatttatcgtctatgttgatgccgattctcctccactttagtgtcattctctacaaaggattaatatacctaatactagtggaatattattattctaacaaacatatgcattgcaagcatcactagttctctcttaatttggtaatattgatggtcgaaactgatcgacaacgaccgtcaacagtggttgcggtatgactaccttaattaggagttgaattgttttctttgtagttgttttaattcagattagacaattgcacttaaattataatgtaataaagcttaggttttttagcagtctatattctttcctttccccctttttctgtccatccccattcaga

SEQ ID NO: 43094 - DNA, 369 bp, Oryza sativa
gggcgatacggtgcgggaggcgatgcggtggggagcgaagggaccgagggcatgctccaaaacgcaatgaggaccactgagatgtaatccaacagccgataattaaatgatgacgtggcttcaccaaatctcagctttgggtcttaattttatagaaagaagggattaggacaatcgatcgaatcattagatccagagaggtgtttttaccattcaactgcaataccaagtttactgaacctacaggtattctttttttttccttttctgttttttcgcctgcgtaatttgggatcattggatgctttgttctaggtgtttgttagttctcgaaggcctgcgtttgtatttgtttgttgttcatatagc

SEQ ID NO: 43095 - DNA, 838 bp, Oryza sativa
agatgggtttcattttattgtataatttggttaattcatttctcatagttatgcaatggcttagtttttgttatacaaggattccatatattagagacatacggtgtgactcggcaaatttagcgattaatcaaattaacatgtttgtatgatactgcataaaagattatgcaatctaattattttttctacgacttggtcatgtctatattcaaattcgtagaaaaaaattactatattttgatgacacattagtagatattcatagatgacagcagacaagatatttatgcagtgatgcgcgcccataaggcatggaagtttctagacagttggtgtatgagccgtgctatagctaggatggtgcaaaccaagatgtgcatggtcataatacgttggagtcttgttgcgacgtgctagatgggctacggttatcataacgaggtcagatagtagcaatgatatgtctgtgtcctgttgtattttctgtttcatttgttatttaccacggtgaagaacccatttctcaaaacctcctcgaccaagctagcactacccaaaaaagaggtaagcaatgccggttggaaaactctctaccagtcttcccaaccggtactcaataagcggcacaacagtattaactcactactactacgtcaacgatttattcgtatagtcaaaatcaattttgcagcgggtgggtggttcacctacacccaggtgtctgtgaaagtatcaaaattttgtatacgggtagggcattcacatatgggcacttaagccatccaactgctaaaaaaaaaaaaaaaaaaaaaaaaaaaatttcaaaaccctagaa

SEQ ID NO: 43096 - DNA, 1501 bp, Oryza sativa
tcataaaactacactattaattattttaattttgatctatcacacttttaagttctacaaatcttttgagtcgttttatctatcgtatttaaatgttatgtccatgtaactatagtttttaaaattttgatatatacaagtatgtcaaattagtttacggtgtggttttatgaaatattaagagtataatacatgggttatacgtacttatgatcttgtataacttggaacatagtaaataaagttttatgaaatttaatcctaatactgatatccagaagtctatcttcttttttactggaaatcattgaccagaagtcaataacggttgagaaataaccactgtattaatgtattaatggtgggtcaagtataggttactggctaccaaccactagggagagccctttctgaataattgcggccatgcgctcctgctgcttgtgggagtactcctgatcgccggcgccgccctgctgcgaggtcttcttgctgctgctgccatggtcctcgccgtcgttgccgccgtggccgtgcctgccagtttcgtagtactccgccattctctcgtacgtgcagctaattaactctcaggtggtggtggcgaaagtattaatggatatgacgtttggatgatctcgcctttgttaatacagaggaactattaatcctgtaacttttggatggttaattattattatgagctagcttataatttggatttgtatatatatgtacaaagtacaacccagctgcatctaagaaaacagcaatcttaaggaaaagatgcatgacaaaaggttatcatgcagccatcagaatttctggtactaacattttacctcctactatggcagattcttactatccttcaccttagctaacatcgcaagagtcatctatatatgctgacatactgatgtgcagtgcatttatgcatgcatagttcttaagattcttgtgctcgttgttttctcgatctcttttcgtaaaagggtagtatgcgctcggtaataattcaccaattggggcatatcagcacttatttctttttctatgctccactcggtaaaagttattctcaagtcattaatgacagcacaattttcatttcaccttttcttcttttagcagcagaattttacgtcttcagtgttaaagaaaacatccacgtcgtctctaccacacgtccttattatgacacaaattcttcatgctgggtcatatatagtccacacatgtcaacaattttccgtaggtttagaggagttgaacaaaatgaaaaacttggcttaaacaaagtaaatgcataatactactgtttttttaattattaatgatgtagtcataggtgaacctagaaaaaaaatcctagccctacatatgtgaaaagaaacttttgaaagaaaaataactccttattagtatattatgatagacatttgatcaatttatacttctatatcatgatgtgcatttgattaatttatacttctaatct

SEQ ID NO: 43097 - DNA, 1501 bp, Oryza sativa
atcttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttaagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatcctttgtagagaatgacactaaagtggaggagaatcggcatcaacatagacgataaatcaatcggacaatgtcgagaaccagacttatgtatgaatgggaaaagaactcagaattgacacgatgaattaggccaaaattcacaagtctacgaagtgaagcaatagaggatccccaggcgaagatgggctggtttgggccagcccatggttcggccgaaccagggagttcggccgaacccccatctccactgttgaggccagggtttggcatggacgtccaagattgcaccccaatgacggttggagggtacttcggacaattcctcttccacaaccgtcataaccacctctagataaaggcttcactctcttaacttcaacacacacctcaagcaatagctctctcatttctcttaagtttagtttagtagtacctagctggtggaatagaaatagaataggagtcaggattccgtaagccttcggaagagttcgggtatggctctagtagcttttctcttctcttttgtatgctttgtacttttattagaatactcttctatatatatttatggtattgaaatattctccgagtatatgagtacctactttatatt

SEQ ID NO: 43098 - DNA, 1501 bp, Oryza sativa
ccagacgtacgtgaagaaataaactagctggccatatagccttagtcggattgaacactcaaaggttgagttgagcgcaggtatagatcgatcgactaactgatcgacagcgaatgaaaccaaatcttattcttcttcttctggaggaactcaggcaattcagcgattgaattatcctggctttgtgaagaaagccaaagaaattaacagtcttaatccgaaccaaaccatatatacagtatagtataacattcatagtctatattacaataggagaatactccatataaccatcgatcgggtggtacacactgaacacacagtagcatacatacatacactagctaagctagctatctgcctagatgcgtctatgcatccattaacttcttattatatactcactccattctaaaatatacgaatctaaaaaacatcaattcagattcatagtattagattgcgtatgattcaacgttaagttgctatattttaagatggatgatcgaacgaactatcttgtactagtagtggtagtatatgggccgtaggtagctactggtagctggctggtggcctcctcctgctgttggtggtggtgcactgccggcggcgccatactggttcggcggccggatcatcctgtggacgatcttcacctttctggtggtggtcggtttggacataatgccatactttagcatctccttctccctctcgagcttctccacttcgggctcgcgcggccacctgcccttgctgccgtggtacccgccgatgtcgccgtacgccctcctgccgccgccgccgccgccgtgcccgtctctcctcactatgggttcgtcttcgtagtcgtcgttgtcatcgctggtgcgcagccgctcatctctttcaacgacgttctgttcgacgatctccggcacctgcaccttcgtctccaccacggatggcgtccgattgtccttcatccacacagtcatatcatacagatgagatcgatagatgaattttggttgaatttgatcgtgagatcgaattgaattacctaccgacgctacaatttcgtcgtcctcctcctcctccttcattctctctatcatctcaagctgggcgggggtgggccacctggtcttggtgcgggcaagctcgtcctgcatcctcatggcgccgtgaccgtgacccttcctcctgcaatcatcgtagtcggtgcggacgtggatcgcctcgatcgaccttctcatcgatctttctctctcgatcgtgcaccactaacaaggtgtggtgtgctcttcagctttggttgatgtgagtgccggtggaggggactatatatttgtagcgtctcgcgagtgagactaaggtctttttctttcttctaatacagtctcagtttttgttagcacgtattttaaattgtgcatcatgcaaaaactttatatatatatatatatatatatatatatatatatatatatatatatatatatatatatatatagga

SEQ ID NO: 43099 - DNA, 1501 bp, Oryza sativa
tgggctggtttgggccagcccatggttcggccgaaccagggagttcggccgaacccccatctccactgttgaggccagggtttggcatggacgtccaagattgcaccccaatgacggttggagggtacttcggacaattcctcttccacaaccgtcataaccacctctagataaaggcttcactctcttaacttcaacacacacctcaagcaatagctctctcatttctcttaagtttagtttagtagtacctagctggtggaatagaaatagaataggagtcaggattccgtaagccttcggaagagttcgggtatggctctagtagcttttctcttctcttttgtatgctttgtacttttattagaatactcttctatatatatttatggtattgaaatattctccgagtatatgagtacctactttatattatgttcttattatactaaatatacggctagcttatctaggagatgctttggtgcggatatagtgtttgcttatgcaattactctaggtcatgacgatgatattagagtggtcatgacgatgatattagagtagtatcgggtagtttagacgtggtgtctagattacgggatatcattatttggggttatatattgcggatgagaggtgggccgctgatggcgacagctcaatacgggtattcctccgcgcctatatataatcctaagttaatttcctggggagggtattcctccgtatttagccccggttgtatggtcatgacgggctgtcgtaaggaactcggcagtcaggggtgccttcttgaagtaccaggagggcatcggataaagggtattagctagtatatcagttaactagaatgtatgtatactatatatattagacgtataggaatagatttcctttctcttttctttccacttagcttagatgatatattatgaggatgagtagttaatgcttgtgtgtcactctaccctttgattatcttaacccctgcttaaaatatgattatcacaagtaatatataaattattagttgagttctctctacatgatcttcccacgggataaaataaatacgataccattggaatactctaaggtgaaatgctacaatggtatatccatgcgcttgcggatgaactctgtaaccataatataccagaaatatttctgcgccattgttgggaattatatttcttgtaatgccgttaagaaataccaacaagcaattctggcgccgttggcggggaagattcataatagagattacttgaactaatactttatatttacctctgtataatcatttcctttgcaggctaaccttggttgttttcactttttgttgtgaaaacagagtagtgcatgactggtttcaacttgccggaaaactttaaagaaaatccaaaagctttcttccggagcgttaggccgcgagtcgttgctccgcagaaaactctactgacaaagaaaccagccgtaccagcgccactgaccttca

SEQ ID NO: 43100 - DNA, 216 bp, Oryza sativa
ccatcgctcgagcctggtccggcgaaaggggaaggcggcgcgcccgctcggtcgtcaggcgtcggccgaggtgaaggtggctcggcgtccagccgcccacgccggcacgccccacatgcggacaggccacagtgtcgcgcggcccgtcccttgagtcaacgagccggcgacaccgacgcactgcgcctgctcggccgacagccgctgcgggtgcaa

SEQ ID NO: 43101 - DNA, 1501 bp, Oryza sativa
acaaacaatgcaacggcagtgtatcaggggacagaccggccggccggatgaatgatgggcacggtgactactagtgtggctggactggtacagtagttgctagtggctgatctgcaacatagcgccaggtgcaacctctctcatccgccacgactcagtacgtgtacgctcttgtgctgcacaggcggaagaggattttgattccctcgagttatttgcatgtcactcaaatggttataaagaaaattaaaaaaattagaaagatatattaacatgtgatatatcactccataaacatgcaaataaaaattcaacttctatatctcgcaaaaaaacagatttgactttaaatatacgttaactagctgtagtttaatttgtttttttgttacgagatgtagaagttgaatttgaacttgcatgttcgtggagtgttatatcacatgttaatatacattctcaatttttttataaccatttaagtgatatgcaaagaacaagaagatatccccttgagggattagaattgtttctatgcacagtgatatgtgaaccaacaagattgttgtcggactaatgcctcactgcttggtcaatgaaagtggctaaaaccacacttcaatttgtgcaccatgcatgacactcagattattcgatatatctgaacgaacacgtacaacctactcgatcatatgatgctaaagtagatgagaattttcagaatatgccattcaattcacatcatcttcaagatttttcacttaattcttagcactttcagatcatgccaccgaggttcttagtttgctgcgtttatagcaaacgtgtacacggtatgggcaggaacagcagagtggtcgacgtgtttggccaagagcgctaccctgcactcccaactcctggagaaaccgataaaatcaacagtacaccgacacccaggacgtagggagataggatcggttgttctcttctcgcccatatcttgcatctcacaaagcatcctgcattcacctacgtcaacatgcatgcatgacaagtttgattaataatattttaaatgtccaaaaacaaaatccctatcaattatgaaactattttgatccatccataaatattccctcgttatttacatgtcacttaaatgatcatgaaaaaaaattaaaaactatagagaagatatattaatatataatatatcactctacaaatatactagttcaaattctacatctcgtaaaaaaaattaaattacagccagtgaacatatactcacagtcaaatttgttttttgactgtgagatgtaaaaattgaatttgaacatatatcatatgttaatacatcttctcaaaatttttctagtaacatgcaaacaacgagaggaaatcctatggagatatcaaaatatactcccctataaattgaagcctacagctgcgtatgttcagtacgagcttacacttagagcagtagaaatacaattacgggaggaaatggcttctg

SEQ ID NO: 43102 - DNA, 287 bp, Oryza sativa
gggttagtgacaaggcatttggcgatttattgaaactcgtcaagaacattcttccggggggaaacaaattgcacgagacaacgtacgaggctaagaaatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaagg

SEQ ID NO: 43103 - DNA, 1501 bp, Oryza sativa
ctcgcggcgccgcctccctcgtcatcatcgtaacggcgtgttccgcgccgtcctcgtctccgtgcagccgctaccggctgccctcgtcgcctcctcgccggccccagtcgtcgtcgtcgtcgtcctcctctcgtcgtcctcatcgtcgtggcgttcgtccctccgtcaagccgttcgcgttcgtcgtccgcgttccgtcaagtgagccgctgcagccccgtcatcgtctttgtcctcggctccgcgtcgtcaagcctcgtgccggccgcgtcgcaacttcgtccaaggatcgccgccgaagtcgtcccctcgccgttcgtctccgacgttcccggccgtctccgccgcgcccgttcgtcgttgtcgttcccacgcctcgtcgcgtggtggtaaggatctctcctcttgctgccctgtcctcgtcctttcggtgtcgccccgtacccgttgtgcggttgttgaccctggtacctgtgtaccggtgtcggtagtcgttcacgtgtgcgggtggtgaccgtgtagtgtccgtgttagtgtgcccgctcggtagccgcgttgtttccacatgtgcagcccgcgtggtgtctagtggagtccgtttgtcggccactcgcctcggttgacacacggggtccgcttccgtcgacccgtggaccgtctctgtgtactcggtctaccgcagtcctttaggttgacatgtggggtccgcatgtcaacagcgcagccttcctgtcttttccaggctagcgcttacacatgttttatagttgaaaaacctaattataataatccgcaaatctctatataacagcattaaacttcggatgatcatatcttggtcatacgaactctgaatcgacccgttcaagtctcctaatgtttgttataacctaaagaaccctgtgctttctttttatgtattgttattgcttctttatagggtttagctttgctggtgtgcttcgcgtagcttctgtcgttccggaggttctcgaagcgtggttcgcggtcgtcgccgaaggttcagcaggccattctctctgagcaaggcaagtcacatcatctttgaacatattggatcccactttgtgaaattattttgatttaaattaatgcattatcgctttatttaaattcccatgttatcactgttttatttagccatgcctatttacctttgttatgaccttattattattgctattgttattattaccttgttcaccctagaataaaccaaaccccaactagtgggtactcttttcatggttccactagtatgaatttaggtagatgcttcgctaattatttaggcaacattaggtggttttataactctagactttgggaatattcatatcacttggacactatggaatggttggattattgtggaattggacgcacatctccccctctattcaaaaccctcaaaatgattttaggctgggctcggggtgcatggttttgctagtagcacctcggccacataaggaccggt

SEQ ID NO: 43104 - DNA, 1501 bp, Oryza sativa
ccgcgacgacagagtcgcgggcggcgagagcgaggatgtcggagcaggagacgacggaggcgccgcacgccttctcaaggcggtcgcggatgtcgttgacggccttgaacgctgacgggcgcagcgtgaggttgggcggcgcctgccgctcgccggggccggtggcggagccgtcgagcagcacggaggcgtcgcagccctgcacgaagcagtcgtggaagtggagccggagcaggccggcggcgaggccgatgtccttgcggacggcgtccctgacgaacttcctcacgacggactccgccttggggcagctcttcctgtagaagtcgaacgacaggccactcaccaccggcggctgccgcgtcgcgtcggcgttgccgtcgccggcagccgccggagcgcacaggcaagcgacggcagctaccagcattaccagcgtcgtcgcagaagccatttcctcccgtaattgtatttctactgctctaagtgtaagctcgtactgaacatacgcagctgtaggcttcaatttataggggagtatattttgatatctccataggatttcctctcgttgtttgcatgttactagaaaaattttgagaagatgtattaacatatgatatatgttcaaattcaatttttacatctcacagtcaaaaaacaaatttgactgtgagtatatgttcactggctgtaatttaattttttttacgagatgtagaatttgaactagtatatttgtagagtgatatattatatattaatatatcttctctatagtttttaattttttttcatgatcatttaagtgacatgtaaataacgagggaatatttatggatggatcaaaatagtttcataattgatagggattttgtttttggacatttaaaatattattaatcaaacttgtcatgcatgcatgttgacgtaggtgaatgcaggatgctttgtgagatgcaagatatgggcgagaagagaacaaccgatcctatctccctacgtcctgggtgtcggtgtactgttgattttatcggtttctccaggagttgggagtgcagggtagcgctcttggccaaacacgtcgaccactctgctgttcctgcccataccgtgtacacgtttgctataaacgcagcaaactaagaacctcggtggcatgatctgaaagtgctaagaattaagtgaaaaatcttgaagatgatgtgaattgaatggcatattctgaaaattctcatctactttagcatcatatgatcgagtaggttgtacgtgttcgttcagatatatcgaataatctgagtgtcatgcatggtgcacaaattgaagtgtggttttagccactttcattgaccaagcagtgaggcattagtccgacaacaatcttgttggttcacatatcactgtgcatagaaacaattctaatccctcaaggggatatcttcttgttctttgcatatcacttaaatggttataaaaaaattgagaatgtatattaaca

SEQ ID NO: 43105 - DNA, 265 bp, Oryza sativa
gctattgagaatttgagatatatatccctgtgacatggttgggtttttaattcatacgaggcattgggtggtcacctaaaatctttcaacattttctggacaaaattaactacatatttttttagaagctaagactaacctcctatgatgatataagatataactcttaatgagcacaatgaaagattcatttacacgatcatgtaaatgttgcaattattagcatgcataaaaatgttgaaacatagcactggctaaggggcta

SEQ ID NO: 43106 - DNA, 1328 bp, Oryza sativa
gttcctggtctggaggttatatttgttcaactggggttggttgttcaaatgtggctgggcctatgcaacatgggtatgttgtatgctgtttgtttaatattgattaattattcaactgttttactattctcttaaatatttgttaaatgctgttttctgcaaatgaactatactatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttctcggtcaagttgcctgtggagtggagtcgccatagccgttccgtcgtttgttttagttttatctttccactgcgtagaatgtttttctttgagaggaactatccacctctgtaataatttattatttgcgagtattaaatagttatttatttgtactctattatgaatattgtcattgtgtgcctcggttgattcctggacgagggtttaacatacatgtaagcgtttggaattttggatagaaattccgggcgtgacatatttccattgatctatttcacctttgggcattaatgtgtaataattgactaagttttttcggttaatagtaattacacaactcatgctctaaatccatatataaatcatctgagctccgttttaacccattcaagttgtaatgaattcgctaaaatgtctagaatccattaaaattggtttattttgttgtttcagtagactttttgcatgtattgttgtatgctttgtttgtcgtttagaatccggcagttccaacactccgattttctacgaagtggtcaccgaggttcctatggctcaagagcaaggcaagtcatacatacaacattgatcttgttgaagctattttataaaatccccgcttttctattaaattgtattattttataatgccatgtgggatggatgcctgtcgtactcaacgttttgttaccttgtgccattgataacttggtatataaatgactagatgattggtttaagaatgctgaggtcaattaatttacaatggggttcactttaaattagtccttaattacattatgatgatgtaccaccatggtaatggtttaattaactaaaatatgctttaatggtgggttgtgggtgcatggtgttgcaagtcgtacccatagcaattaaggaccggttcttgcgaatccctgaagatatacacgtacttaccacatgctagcatgggctccaggctgaatctagagtgtatcttaacctcgtcaatatatcatggcaag

SEQ ID NO: 43107 - DNA, 1501 bp, Oryza sativa
atttagtattatcaatattaatatatttgtctataaacttaatcaagcttgaaataatttgactttgagcaaagtcaaaacgtcttataacctgaattggatggagcatttttttgaaaaatagattaatatgattttttaagcaattttcgtatagaatttttttgcaaaaaacacaccgtttagcggtttgaaaagtgtatgtgtaaaaaacgaagaagatgagttgagaaagctaggaaagaagtcagtctaagctcgtcggcatagcacttaatctgctttacctgagtggtggccggtcctggccttgtacaaggggctgacggcctgaggctgaaccccgtgaaacaccaccacctcttcttcaacagttcaactcgagcgggggcgatggaaaaagcaatagcaggggacatgaatattccaactttccaggacatctttctgaattctgatggtggtgggcaatgtgagactgaaaaaaatcgatatgggagagagagagaggtcagaaatggagatggaggggatgataggtggaacccactctattttttttaatgattgggatgtcacgtgaacaccaagtcaacgaaaaaccgcttttaaaaacagttgatgtagtcattttaaacggttttgatagttagaggggtcgatttatctagttttatggttgaggaatatgaatcggattcaatttatatttgtgtgagtagttaaatttgcttgtgtttttctttcttcatcagcttattcttatttttcaatgatgataaactgatcagcgtagccgccggcccgtcgcccacccttaaacaacgacagctaatttatgcatgcatggattccgatggaggagctgtgtgcaccactcattcgtaagacttctttcgaataattcaacggaagaaggttgaaccatttgaagcgaatcacacattattgatctttctctccaaagaatcgtgctagctcgttggaaaaaaggggaaaaaaaaacggcgagcctagctataattcaatttgcgagattacacatatgtgaaaaatcgccaagttaagggtttttctttatacataactaaatttgctactaatccttatatagccgcctatgagcatttgtgcattgtactatgcaccaacctccacttgtaaagtttcaaccaaaaagaaaaaaaaagccatccacttgtgctgccaatttgctcaatcccgacaagctcgctcgatcgttcgccgcatcagccagtctcagtccgctgcaatttgttcgcgcatgcgttcatataatagacctatcatagatttttcgacgattccaacgacctcgtggaaaaatcgcagatgcacgccccaaatccatcaatttcatcacgacactcgcaagtagtgcgcgtccgctataaaagcgatggaaatcctccgaggacggcacacggttgatcgatcagtacgagtacgacgagagctaagtaaacttagctatatcgat

SEQ ID NO: 43108 - DNA, 1501 bp, Oryza sativa
tacttcgtgcgaacgatgaccaaaatagcttgacaatgttaattttacgaagctgatgttgattagatgtgacgtgtagcgagtatacataagacatgcaatatttatatatttggtcctactttatccttcatcatggaaatgatgaatttcatatatattctcactcttatatcattgctctgttttaatctttttatacgatctcttatccattctattattattgaagatgtgtatgtctaataataaactttcttagatatatgtttacatagatcttattgagcccctaaataataagattagccacgtaatatctttttgtcttcctccgcacatgccagacaagttcatgcaccaaaacgagtattttacaagtttgtgcactagattgcacccacttgacaagttcatgtaccaacgatgtaatttactccattatttttgtgatagaagttctcataacacatatcatctttatcatcgtaaacacaaccttatttatataaaattgcactctgtactccctccgtcgtaaaatattcgaaatactacgtaagaacgtagtagcggatgatatgcttctatattttgtaacggaggtgtaacggagggagtagttcgcaaagttcttatagttagactgcgaagctcaaaagggaggcgtgttgggcacctctgtaagatcaaagtgtgttttgattcttattctgtgatgaacaattggcatctgtgattattggttttgatatttggagattatcgtcgaagtggttttggagataatcaattttcaggtgataatcggattcactgttattttatgtgaccggtccgaccgggtggtgtatgtcggtcagaccggtggtgatcgagcgatcagatcggccggcccgcgatctgaccggccgacgctgtgtcagtttcggtttcgggttgtttctttggatatctgtgattgtttcatggttatggcttctagatggatactatacgtatataatactgttgtttgctaacaatgagtcaagttggggatagcttggtctcggaatatggtttctttgtttatttcatgtgtaggtgactcgatgcctcgggagagtatttgcggtgatggaccgggagtcggcttggtggtaagacgatgtccgtggtggtcagatatcatgcgggatactaaggctagagttgatgcacgtggttggtgaagattccatatggcatacgatggggtattgtgtgcgtatgggatgcggagtcgaatttggaaggagtccaaatttggtacaattgattatgtaaagtttgtgtcttgtactagagggtttcctaaggtgtctaggactcttagtatgagcttggttcgtggctttaggctgcctacctcatgtataaatagagggggagcgtgaggcttcccggtatcgtttttgagagcaattgagttgctagtttagttagggttttgagtttagtcgagatttttgtaaggagt

SEQ ID NO: 43109 - DNA, 1078 bp, Oryza sativa
ctaaagatcccccctttatatatgccttcttcctcctccagctcgagagcaagcttcaaaatttctcaaagaaagaggggaggtcatgccaaaatttcttgtgaaatttttttagtgattatatacaaatcggaggtgtctaaaaggttagtaacttcatcctccaatgtttttgttgttatattacttttggagctatgtttcacacattttttttgtctccaaaactttgttgtaagttgatgagagagaaaatttgtgtggggaagaagaatatatagaaattttattctcatagattaaaatatgatgaaaattaatcttaaaaaatagaaaacaaactaaattgaaaattaagataagtacaacattaatattagtttagatcttcaaaaattgttaataagaattgcttgtcgaaagagtttttaattattttatcattactgtttgactgtcattattgtacgaaaatttatttatgtacgattttttttcatttcatgtagatggatcggcaatggatgtacgctgaccggcggtccaaagagtttatcgagggcgtgcattatttttttagagtggccgaagataacaagcgtaacggttttatttgttgtccatgcaacaagtgtaagaaccagaagaagtattctgcatccaggactattcatttccacttgtttgagtcggggttcatgccaagctataattgtttgagtcggggttcatgccaagctataattgttggataccactctggagttcttgcaatggaaggcaaaaggtggtgttagtgacaaggcatttggcgatttattgaaacttgtcaagaacattcttccggagggaaacaaattgcctgagacaacgtatgaggctaagaagatagtctgccctctaggactagaagttcagaagattcacgcatgtccgaatgattgtatcctatatcgtggtgaggagtacgagaacctagaagcatgccctgtttgtaaagcactacgatacaagattagacgagaggatccatgtgtagttgacgggcagccaacaaagaagagaattcctgctaaga

SEQ ID NO: 43110 - DNA, 1029 bp, Oryza sativa
ccggcctgctcgctaggtttctcttttttttttccatcctctttaatttgcggacctcaaaaatcgtcgtaatgcatccggattcacggataaccggcaaaataatcacgtggccccaccctttaatgacggaaaaaaaaaatcaaccgaaaaccttacttattttttaattaggtatagatatagatatagatttgccaatgtagagtatagtgatatctatcggtccaccaaaaatcaagctaaaatttgacatacccactaagattaaaaaaagagagacaaattttgtatacaatatgctactattcataagtttgtcttttctatatgtcgatgtgtgagttgagtttggatctaaaattttgtggagttgtatagatatgttgtacgaacattatcaaattttatataatttttttataactgtttggatgatatttttttaaaataaccgtttgggtggattataaaatgcagctaggcagctagcatccatcaaaatagtttccccgctttatgtacgctcatcggttgctagtctgttaatgctagctgcattttataatccgcatgttagttcagagatcaaactttgatatttgaaggaatgaataaaataaaatttgtttgggaatcgattgcttatgcaccctgcgaaaaagtggcggttcagccttcaaaattttttgggcctactaacttcgatgggccgttttttttagcccatgcagaagacagaagtgtaggacattgacgtgacaacctaaccatgcacatattggatgcatgcgcatattggatcacatagatatatgcacagacaggggtggatccaacgtgggtgcggggggtttggagtcccccctacacccacaaggcccatggatacctcccagagcatcccctttaatttttttaaaatgaatgataaacttaaggcttctaaatggctggaggttgaacaaactgtgtaattgagcccccctcctcccaatttttgttcttggatctgcccctgtgcacaga

SEQ ID NO: 43111 - DNA, 1501 bp, Oryza sativa
gtttaaaccctagagatgataagatagatatacccatgaatgaattagcaaagcacatattctttctctccttttctttttgttggtaactcatatattctttctcagcatcagcattcgcaactttcggtgtctgcatcgtaggccggtggttaaatccaaagaaaagaagaggaatatattcctattgcatcactcgccctaacaatgcacgtcgttgatttcgacgtaaaattgtgctcgtagtaaaagccaaaattcacttcactaatccggcaaactgactgagattagatgaacgctcgagctaattattaataagagcctaattaaccaaccagagggcactggcactagcaaatctcggattaattttaatcttaagtttatgcacaaaggttttttttaccgagtacaaaaagatgagatgaaactgtaaaaagtaaaggaatggcgcggttacgtggcggtggtaaacgccgggggagcgggcggtgtcggcgacggcgaggtcgagagcggccgcggcgtcacgttcttgccgccgccgccgccgccgccgccgccgacggagagggagcggaagaacgtcttgggccgcggcggcgcggcggcgtccgcgccctggcgagcggagcggctgcggatgctggccttcccgccgggggcggtggcggtggccggggggtcccccttgcgccgcaccgcggcgccgttgcccgggatgacgcaggtgaagacgaccccgatcttggcgaggcggttgacccagcgcgggatgcgggcgcggacgaggcggcggcacgcggcgtcgcagaagtggttgcagttgcgggagacgaggttgtaggcgtcgccggggaagtccgcggcgaggtccgccatgaccgcgcgcacctcggcgcgcgtcagctccgtcgtccccaccaggatcgcctcccggaaggcgtaccccgggcacctcctcggcgccacctcgaagatcccgctccccgccccgtcgtgcgccccgtacgcgtactccaccccatgaactgcagcacaccacagacatagcacaccggcgtgtcagcgccgtcggtggcgaaccaggatcgaaggcgaggaaagcagagcgtacatgccttggacgccggagtggtagacgccgaggccgagccagcgcgcgtagccgttggcgggggtgacgtcgtacacgttgaggtacaccggggacgacgacgacgacgacgacgcgccgcgaggcagctgctgccttggggcccggggcgtggaggcggtggaggaggaggaggccggtgccagcgccggcgagggcgaggaggaggaggagaagggcgccattcgcgcggcgcgccgtgggtgggcgagcgggcgggcgcacgcacgcacgtcgcgcgcgtcgttgtcgcgccccgcacccgcgccgcgcggcgtcctcgcgatgcccgtgtgtgtgtgtgtgtgtttttttccagtaagcgctacgctactgctggat

SEQ ID NO: 43112 - DNA, 1501 bp, Oryza sativa
ctaaatttgtgagtgaataatgataaagttcactctgacaaaaacagtggggaaaaggaaaatttgaggcggtgcaagcccagcaattaacatatacatagcgtgacgcaatccagtgtttaaatttgctttttttaagaccttatcttaagatgtcgacaatagtcgcagcagaacagtttaaaaagaggctaatttgagttggttgggatgctaatactttaattttacacatgatttagccggccgggccctctctttccggcggctttgatatctaaacatgaatctcactgtcaagaaagttgcaatttgccaacctcccagagactcagagtaacaggtaagctgaatttgctggggtgctatctctaatcgtgggaagaaaaggtgaggccggtgacgaaaaggatggaataatggctggggaaaaaaaaaagcagtactatcaagttggttaaaaagaaggtacatagatggtgactacacagctatagccaagccaaagactggttaattagtcaatgggtgactgcttaattgctcagggatatctgttctttgattaatcctggaatctgactgcttagtgtgacctttttttttctcagtggatgcatagtgccatgtgtgatatatactcactaggctgtgtttagatccaaagtttggattcaaacttcagtccttttccatcacatcaacctgtcatacacacacaacttttcagtcatatcatctccaatttcaactaaaatccgaactttggatccaactaaacacagccctatatagaatagcaccgtgctcttctgtcgcaagcgaagttacttagaaattgtcctgaaagctctgtgaccgaaccaatgtctttggatcttttattctgtggtgtttcaggaaaagaaaattaagctagaaagaggattgctcacttccacatacgtgccgctttcacagggagacgacatggataaaaatcatcagtgacaacacaaggatgaactgaagagactgaactagagagacagagaacgtgattaaatcaataaatagcaaagctagtgaaaagtccaaaataaaacaccggtagtttctacatgtaggaaaaggaactgctacgagagtggaagtgtggtgtcctactttaatttaatttgttagtatatcgatagagttggtgactgaaatattacataaacatttgatcatcattaagggcatattctttggtagcttaattaaacccgcttgtttgtttccgcgcaagttgcagtgtcactcactgatcgatcatctcacattctcactgtacagtgccgaacaacgatggctataaatgaggacaccggctggcgcaagttctccacaagccacctcgatcgatctccattgaaatcaaggcaccttaataatttctagtaccatattaagctaagaacagtagtgtacatggcttctcgtagaagtgcagcagctagtccggccatggcagcagcag

SEQ ID NO: 43113 - DNA, 1501 bp, Oryza sativa
ggagagaccttcttggaaaagaattgggttacccacgtatcgtaccaagtctggtatgttcgagtcctactcggagagcacccaacctgcggtataaaagggaccccccgggaagggcatagatcatcgaatctcagagccaacacaacccacacagcctacgaagtcagagcctgcaaggagccaagtcgacgagagaaagtcgaatcatctcgactacaatctcgccaaatcccttgagttccgtcttttcctttgtaatctgtgttttccactatataatcccatatcaattggattagggctattacctatcaaggggcctgaaccagtataattcttgtcttttgattgctcgatgtcgtactacgtagatccttataccagcgtaccccaataccctctatatccggtctacgggtatcccccgtcgacacatacctatccttttcaacagctccggagagtattctcgcgtgtgagcatactctcggtcactcagcatgtagtaggcttgtctttcccgatcatcgacaaggtcgaggtcggcgtcgttcaggagacgtcgcggagcgtcgacatcatccattgagacatcagctaatgaaccagtactagactcgtcatgatgacttgatgaagagccggactgcttgaacagacaaggcagttgcctcctcattctgcacaatggagctagaacggactatctcggcgggggttagaaatagcacaagtttcacccgccggttagtttcaccaaagcaacttgtatatatgcagctaagtgtttgaatttgagggaaaactatccaagcttgaatgaacttgagagcaaacttcggggagggaatgaaaatgtgttgaaatggggttgaattccctctctcggtcgtctggctttaatagggtacccacaacggtcagaaatgacatgtgggacccactagctgttacctgccaaaagtggcaggtagctgttatatggctagttcgggcgaacccctggtgggcccaaccggccccactttcggccgttggattccaacggtcagtgtggtcgtggcacaatgaattttcgttgaaaattttgttttggtttgtgttaacgaccaaatttggtaatatcagcatcggaaaagagaattagatcgaagtggagtcgaaggcggagatcgattcgagaacagagcaagaatcgactggaatccaaatcggctacgattaggatcggctgggtccgagtaggactgggttaagtgatacagctgattctgacaatacgacttgtatccgacatcgggtttgagttgacgtgcttcaagatgattgccatacatggatagagtcatgggaaggcaattgtatctattaattaggatattttatgtaaattccttagagataaatatgggcaaaagtctgccgcaaagacttatgatatcttagagtttattagagataatagtcgtgtccggtatggacatatcttgtaattctc

SEQ ID NO: 43114 - DNA, 1501 bp, Oryza sativa
tgagagcttctaccagcagtactacgagaactacgtccgtgccctcgacaaaggggaacaagccgacaggtaattccttaactgtgctccaggtctataatgaatccactccctttcttgacatatccagtcccatgccaatgtcacctgcagggctcaacttggtaaggcctaccagacagccggagttctcttcgaggttctctgcgctgtcaacaagaatgagaaggtcgaggaagttaatccggaggttcgtattcaacatctactcaaattacggtcgttctttgtcaacgaaaatctaggtcttctcaaatgcaatgagcttctctaattcccaatgtgcagattgttcgcctgcaccgggatgtgcaagagaagaaagacatctacacgccattcaatatccttcctcttgatgccgccagtgcatctcagtccatcatgcagatggaggaggtatgtacaattcacaataacggtatctgaaaaacaatggaaccgtgtactggttcagtgaatgaaactggcgtgctaactggtttggaaccttaacagatcaaagcagcagttgcagcgctgcggaacacgcggggcttgacctggccttccacatttgagccagaaagacagaaggggggtgatcttgatttgctggattggttgagagctatgtttggctttcaggtttgctagttattccacacgagtcaatttcagtcaattctattcctaagttaacaccagcttatcttcttgtgtgcagagggacagcgtgagaaatcaaagggagcatttaattctcctccttgctaatgtgcacataagacttgagccaaagccagagccacttagcaaggcatgttcctttgccactttttactttgctgatttgactatatggatatcaatgtggataatgaagtaagaagcctgggatcagtatgtattcattgtctgactttattcattctagtaaacaaaagcctcagcctttgatcaaaacaattttgtttcttttataatgatttagtatattcaatcagctgggatttggagtaacctcttgcaaaatttgtgccgacaatattgccttctatcacattccaaaagttatcactgtaaaattcaattgattgaactgattaggtgcatgtctttcaaatgtgcagctaaataatgctaaatacatccttcatttcctgtgccacattccttcttttgtttcctctataattgactggagcttttctttcaaccctgaaacagcttgatgatcgtgctgttgatgaggtgatggctaagctattcagcaattacaggaagtggtgcaactttttgtcacgaaagcatagtttgaggtacaaaaaatcccttacctttgttttctaaatagaactgttattattctcttattgtacattgtgttgatgatttcacaactgcagaagtcctcaaggtgcacaaccacaggaaattcaacaacgaaatattttgtttc

SEQ ID NO: 43115 - DNA, 1501 bp, Oryza sativa
gagaccggtgtaggtgacccgcagcgaacctcggatctcggagaggttatcccgagttccgacatgcagtcctcgagccctttgcgctggcactcgttgccggccaccagctccctcatcttcgtgaggtcttcacgggcttcggccagttcccgcgccggacgctcagcacgcgcgttggccgctaccgtctccgccctcacctccgagacctcgcagccaacgccacgagcaccggcctcgagaagacgccccatctcgacatggagctcctcccaggtgaggacggcctctgacagaccacggccgccgacgggatcgcccacggagccgcttggcgtcgcctcccgactcccgaccacgggcacaacatccgttgacgccgtgacagcggacgcgctagacgttcccccggacttgccgcgagcagccttcgacttcgcctccctgttaaccgccatgagtcaaaactccgctcgaacagaagacataagagtctagaaatccttcacttacttctcgccgaccgtcacaatacgttgacgtcgagcaggcgggggaaatacgtcggaagcctacaagacaaccgatatagagtgagaacaaattctcctcgctgcacaacctaacgacaaggaggaaattaccaagggagtttccgccttgcggcgatttccgagtacagacaagaatttcctcgccttagtcggagttttgccaccactagtggtggcagcgtcggacgcctcctggacgaccttctccttcagagacgtcgccacctgatgatccgcgagcggaccgatgacatcagtcaagggaagggcctacgctaaatcacgtcataagccgattttgagtaaggaaggcggacgcttattaaatgaactcacattgatggcttcgtcacattctgccgctcccctttcacaaaggggcgcgggaatgtcgcttgcggtttgtcacgcccggaaattcactagtaatttccgaacttatttgtgcataaaaccctcgtccaagaatcagctgaggtacacaaactgacaatttaatatacaaatccatcttaataataacgttacatacttacaaaagaaaagaaaaacagcagcgaaataacgatctaacgatggcttcagctccactcccacaggcagctcaactggggtataagccaaacgtcttctccttctggatcctttttcttcaactgaggtttgatgattattgtaagaatgagcatatgacatactcaacaagccacacaacaaatatgcaagtgcacaaggataccaaaggatggcataatataggctcatttgcaaaggcagcatttagcaaacatttaagagaagtaaaacagtagagtaattaatcatcaattttaatcaacactaaacagcacgcccatgctgctcaggcccaaccaaacctgaacaaccaaccccggtcgtacagatctaacctccaaaccaggaattatccattccaaaccagg

SEQ ID NO: 43116 - DNA, 1501 bp, Oryza sativa
ccccggtgtacctcaacgtgtacgacgtcacccccgccaacggctacgcgcgctggctcggcctcggcgtctaccactccggcgtccaaggcatgtacgctctgctttcctcgccttcgatcctggttcgccaccgacggcgctgacacgccggtgtgctatgtctgtggtgtgctgcagttcatggggtggagtacgcgtacggggcgcacgacggggcggggagcgggatcttcgaggtggcgccgaggaggtgcccggggtacgccttccgggaggcgatcctggtggggacgacggagctgacgcgcgccgaggtgcgcgcggtcatggcggacctcgccgcggacttccccggcgacgcctacaacctcgtctcccgcaactgcaaccacttctgcgacgccgcgtgccgccgcctcgtccgcgcccgcatcccgcgctgggtcaaccgcctcgccaagatcggggtcgtcttcacctgcgtcatcccgggcaacggcgccgcggtgcggcgcaagggggaccccccggccaccgccaccgcccccggcgggaaggccagcatccgcagccgctccgctcgccagggcgcggacgccgccgcgccgccgcggcccaagacgttcttccgctccctctccgtcggcggcggcggcggcggcggcggcggcaagaacgtgacgccgcggccgctctcgacctcgccgtcgccgacaccgcccgctcccccggcgtttaccaccgccacgtaaccgcgccattcctttactttttacagtttcatctcatctttttgtactcggtaaaaaaaacctttgtgcataaacttaagattaaaattaatccgagatttgctagtgccagtgccctctggttggttaattaggctcttattaataattagctcgagcgttcatctaatctcagtcagtttgccggattagtgaagtgaattttggcttttactacgagcacaattttacgtcgaaatcaacgacgtgcattgttagggcgagtgatgcaataggaatatattcctcttcttttctttggatttaaccaccggcctacgatgcagacaccgaaagttgcgaatgctgatgctgagaaagaatatatgagttaccaacaaaaagaaaaggagagaaagaatatgtgctttgctaattcattcatgggtatatctatcttatcatctctagggtttaaacttcaaagtaactttttttatagaaaagaacggtgtgaaatccgtatatttcttaaaactctatttgtctgatgtcttcttatttttctaattgtgtactctctctattctattttaagtgtagttgtgatttttcgtatccaacattcgaccgttcgtcttatttaaaaaaattatattttttaaaaaaaagccaatcacaatgtactattcatgttttatcagaatattaattataaaaaattttaaataagacgaaaggtcaaatgttagacacggaaatctaca

SEQ ID NO: 43117 - DNA, 1501 bp, Oryza sativa
caagagtttcgtcctcgacgtcatgagaggcgcgtggttcaaactcgagtaccggaatcattgccagtgactcgggctgcccatgctgctagacatcctcatcatcagcatctctacaatcaacaagagagattcccgaaatcaatagtgaacaaggatggtaatcatgcacgcaaaggcaactagaatttaaagtttacaagtcagaaaaaatacatgggtcctactcttcaaaaagggggaggatagactcccccagatcaccgacttcctccatcacctccttccgtgcgttacttgccgctccctgatccaagacctcacgcaggtcgagttcaggacgcgacaacttcacgcatgcgaggacgtgacatgtcccggtatagataccgttagacgtctcctccatgatcctggccgcgtgcttggagggaatttccccatcgccgtcgccatctccgcaagggaagaggtcaacgagaactcgtcgggattcaccggaatcgtggacttaatgctgcactcctcggcgagttggtggagaccggtgtaggtgacccgcagcgaacctcggatctcggagaggttatcccgagttccgacatgcagtcctcgagccctttgcgctggcactcgttgccggccaccagctccctcatcttcgtgaggtcttcacgggcttcggccagttcccgcgccggacgctcagcacgcgcgttggccgctaccgtctccgccctcacctccgagacctcgcagccaacgccacgagcaccggcctcgagaagacgccccatctcgacatggagctcctcccaggtgaggacggcctctgacagaccacggccgccgacgggatcgcccacggagccgcttggcgtcgcctcccgactcccgaccacgggcacaacatccgttgacgccgtgacagcggacgcgctagacgttcccccggacttgccgcgagcagccttcgacttcgcctccctgttaaccgccatgagtcaaaactccgctcgaacagaagacataagagtctagaaatccttcacttacttctcgccgaccgtcacaatacgttgacgtcgagcaggcgggggaaatacgtcggaagcctacaagacaaccgatatagagtgagaacaaattctcctcgctgcacaacctaacgacaaggaggaaattaccaagggagtttccgccttgcggcgatttccgagtacagacaagaatttcctcgccttagtcggagttttgccaccactagtggtggcagcgtcggacgcctcctggacgaccttctccttcagagacgtcgccacctgatgatccgcgagcggaccgatgacatcagtcaagggaagggcctacgctaaatcacgtcataagccgattttgagtaaggaaggcggacgcttattaaatgaactcacattgatggcttcgtcacattctgccgctcccctttcacaaaggggcgcgggaatgtcgcttgcggttt

SEQ ID NO: 43118 - DNA, 1501 bp, Oryza sativa
aactctatcgatatactaacaaattaaattaaagtaggacaccacacttccactctcgtagcagttccttttcctacatgtagaaactaccggtgttttattttggacttttcactagctttgctatttattgatttaatcacgttctctgtctctctagttcagtctcttcagttcatccttgtgttgtcactgatgatttttatccatgtcgtctccctgtgaaagcggcacgtatgtggaagtgagcaatcctctttctagcttaattttcttttcctgaaacaccacagaataaaagatccaaagacattggttcggtcacagagctttcaggacaatttctaagtaacttcgcttgcgacagaagagcacggtgctattctatatagggctgtgtttagttggatccaaagttcggattttagttgaaattggagatgatatgactgaaaagttgtgtgtgtatgacaggttgatgtgatggaaaaggactgaagtttgaatccaaactttggatctaaacacagcctagtgagtatatatcacacatggcactatgcatccactgagaaaaaaaaaggtcacactaagcagtcagattccaggattaatcaaagaacagatatccctgagcaattaagcagtcacccattgactaattaaccagtctttggcttggctatagctgtgtagtcaccatctatgtaccttctttttaaccaacttgatagtactgcttttttttttccccagccattattccatccttttcgtcaccggcctcaccttttcttcccacgattagagatagcaccccagcaaattcagcttacctgttactctgagtctctgggaggttggcaaattgcaactttcttgacagtgagattcatgtttagatatcaaagccgccggaaagagagggcccggccggctaaatcatgtgtaaaattaaagtattagcatcccaaccaactcaaattagcctctttttaaactgttctgctgcgactattgtcgacatcttaagataaggtcttaaaaaaagcaaatttaaacactggattgcgtcacgctatgtatatgttaattgctgggcttgcaccgcctcaaattttccttttccccactgtttttgtcagagtgaactttatcattattcactcacaaatttagttggactgcgtaccctataaagatctctatctctactataaatgcgtaagaaaatgaagggttcctgctccttggaaaataatgaaacaatatgggctccgtacgctggggcctttgagtttcagcagttttcaattatcttgacatcatatatgagtttttctcttttttgtttttgaaaaaaaggacatcggatcacatgcgtactcaaccaagagagactagtccgttatcaaaatgtaccacagaactttgcaaattggtttttttcttaaaaaaaagcatatgacaaacatacgttcacaacacgcgcacggtcgtc

SEQ ID NO: 43119 - DNA, 1501 bp, Oryza sativa
ttttacgaaatacataaggagttgtataagaaatctctttaaaaatactcgcatgctaatttgagttgatcggactcctaattgcagctcttgattttgtaaacaaaaatatacaagcgaattccagcaatcaatttcacctaagctaaactgtagcacagtaataacattaaaatagccttcacccgttgcaatgcacgaatatttttttctagtatataaaaaaaccaacatctataatattagtaccttttttcactagaaccgacacttataatgtaagtataggtgctggttcttttaaaaaatcagtacctctactatttgtacctatagttcttaaagatgccggttcttatttttttcatcgtgcggaggtagaaatatgccgataggtgtcggttttaaatgaaccggcacctataagactggtgcctacgagggttttgtagtagtggtatcgaatggggtagtgacaatagcctagcctacattaaacaatatattcgaaaaccaaagaacttattatccggttaatattccttttaaaaatataaattatcctatggataactcagtgtatattaacacgtataattcttactttgcagatatagatgagtgcgctcttccgggtattatgagcaattgctcctttaatagcgtatgcgtaaacagaccaggaggctttgattgtccatgcaaacgaggaatgacgggcgacggcaaaagaggaacatgcaccgagaatttcccaccagcagcaaaagccgctgtcggtaagctagtcggcacgcatttaaatttggatttaactaataataagtcatcaacttgttctttcataggctagagtgttgcataatatttgtttgctctaataattcacaaaaaaagttgataccaaattcggaagatgattgttgtcagtctttttctacatttcaatcttgaatttcataagttaaaatgttccccaagacctagtcatcttaaaacaagctaccggtgtttcaggaatatacaagtgtcaactccttctgcaaacatgttggaatttctcctcataatatcatttatgtcctttgttatgaaatttaaaatcttacagagaaacataatatataagtcataattttatcctcatgtggattctgaaaaaaagttcaatctagctagagatattcattttgcttttatcttgcatatatagtattattgacgacttgactggtatgttaattaaggattgctgaactgtcaaataaaattgtttaattactaatgctgacctattttccaatctcacgtgcaggcctttcttccttcattgttttcatcgtcctaatttttatggtgaaacaacacctaaaacttaagaagttctacgaacaaaatggtggtccggtattgaaaggtgtgagaaatataaagatctacacaaagaaagaactgaaacaaataacgagtaactatagcagcgacattggagaaggagcct

SEQ ID NO: 43120 - DNA, 368 bp, Oryza sativa
ttgtgaatgctgttgtgaaactgggttcgatgtttgaaaaatcagcagctgacgggatcagctaggcccgggtggccgtttgaaatgttgttggcccgggtggccgtttgaaaagctgttggccgggtgccaacctgtttcaagatctaaagactgatacattgcacatactccgaccggacgagatgcactgtctcatccgtgtcgtttgagaagcactcacttagactttttagaaaagagttcaaacaaaatcaattacgaaaaaaacagcctttccttgaagcctgcattaaacacttatttcccctggcttgctgagtactcccgtactcacccttgctctatataaataatcctcccccagt

SEQ ID NO: 43121 - DNA, 184 bp, Oryza sativa
tttatggcaattatgtcagaaagaagatggacattgccattgattccacggtacaaaattgattttgttgataactgactgtgaatccaaattaagatatacaggctgacaactagggatgaaaacggtacaaaaacggatagaaactacctttatcattttcgttttcattttttttttcaga

SEQ ID NO: 43122 - DNA, 1501 bp, Oryza sativa
ttctctgctccatctcctgtttctttctctctctcttttttttctttctttttttttgtttttttagtttagtaagctatgtgaggaagaactctgatcgaggttagtttggtcacagtgagttctggagcagcttgtgtatacggtagcatcatttagagcataatagggttgcagttgagaccttcaatttttgttctgctactttaattagtgtcatgtgcttaatttcatcttcaagcttttcatgctcccatggtgataagttaggtttatattttttattactactgctcttatttgttagagttcgatgtgcacgtagggcttgtttggttaagtgccaaaggctaccgtgttaaaacttatgtgtgcctcaattatttttaacaagtcattagaggggagagattcccacctgaattttccattcatgcgaaaatatgtagtagggcgtgttaaaaaagtctggagttactcagttacatagattgcaggtgaagagaattcgatatgccacattttactagttgctataattgttacaattataattatagtccggagagattccactctcaatggttgatatagttgcgacatatcaccctttactaggccttatacccactcgcatgttatatactcaattttccttttttaacgttgtcacgctctatgaccaattaagtgttggtcaacttttgtatcgataaaatgaggtttagtcgccaaacgaacagctacgtagtctccagcacacttttgacacgccacactatgcgtcgctaattttttttgaaaaatattatattgtgaggtatataataaaatatatttgtttgaaagtttttttatgatgaatctggtgatgacatttttacaaaacacatgatggtgtttgaaactcatgaagataaagattaagttgacgcatgtaaaacgataaagctattagcacatgattaattatgttttaattattacaaatttgacgaatggatatatgtaatattttaaagcgatttctatatggaaagttttcgcacggatcgcaccatttgaaaaacatgctaacaaaaatcaaggtaaaatatatatatcctcatgggaacagaaaagggtataatcttacacactcttcatccagggtgtttacagtataactgcacgtgttttaaaatgagatctctcataagtccaagagagcacaaatcaaagccaagcaaatggtgtaataaataaagctgataacaacagcgacaagaaagtggcaattcccggtccataccaattcaacccaaaagtcagcgaaaatcatcccagtttcgcaaatttttcaagacatttctgtccactaaaaccccaacatcccccacattggatccaaatccaatccaccaccaaccctgacagaggataaaatcgatattgatataggtgtatttagattcaggagtgaaaaattttgacgtgtcacatcggatatacggacacacat

SEQ ID NO: 43123 - DNA, 1501 bp, Oryza sativa
cttatattacaggatggagggagggggtaattaatactctaggtggcatctttctctttcttcgtcgtcataaaagctctacgtgacatctttttccaaatggtgacaccacatcgtcattcttgcccttaaaacacacacccaaaaaaaactattcccccgtcccaaaataagtgtagttttacactattcacgttcaacgtttgaccgttcgtcttatttgaattttttttataattagtatttttattgctattagatgataaaacatgaataatactttatgtgtgactaaatattttcaattttttcacaaattttttaaataagatggatggtcaaacgttgggcacagatatctatggctgcatttatttttggacggaggtagtattgaattccattgacacggttctcgttctgtcaatcatacgttgatttgacttgactattcggacaatgtaatttattactacatccttcaataaccaaaccgtggtaaaaataccgaatgcaaaagagtgaaaacgttaaggcccaaaacgacctcaaacttggcatgtctattttagagttgggccaaattgttaagctacacatgatggtctcaaagaagaattggaccaaacgtgctccctcttattatctttttttatttcacaaaccatgatattccctcgaaattgcacttaaatttagaaatggcgtcagtactgcttactaatttagtattttttttcgaagggctcacctaactttgatggtagcctgtccaaaatctgaatggaatttgattgccctttggaaaagatggacaaatccaccctgaaaaacaaagtttttttttaaaaaagcaagatttgtttgaatattttttatatatagaattaaacaactatttatttcatcatcagtccactaaggctgtgtttagatctaggggtaaaaagttctggcgtgtcacatcaaatatatggacacatatttaaagtattaaacacagactaataacaaaacaaattacagattccgcctataaactacgagacgaatttattaagcctaattaatccgtcgttagcaaatgtttaatgtagcaccacattgccatatcacgaagcaattaggtctaaaagattcgtcccgcattttacacgcaatctgtgtaattagttttttaaacctatatttaatactctatgcatgtgtcaaaatatttgatgtgatatggtaaaaaattttgacaatggatttacacaggcactaatttattattactcattccattacgaggccaccttttctttctccttaataataaaaaaaaccccaaatcggacgcattttttaattattatgcttcgccatttctccgcacttgctccttctcctctccttttcctcctcttccttcccttcccttggcttcgcctccactcctccgctcactcctctccccctccacgatctcgccgggatctccacggcggcggcggcggca

SEQ ID NO: 43124 - DNA, 1501 bp, Oryza sativa
ggtcggaaacgccgccgcggccggcggttgcgtcggcggggctgggtgagctcctcctccttgtgtcgtgaacgccgtgtgcgcgagacaaacacccaggattccctcactggagacgacgcacgccacacacaaccatcatcatcaatagcgttcacaacaatcatggcgaaaactacaggaaacgataggggaactcttttaatcacccggtggacatcttgcacgtgttctaaatagttatgaaaaaatttaaaaaaaaaacatgatagatcaatatgtaatatatcactccacaaacatgcaatttaaaattcaacttttacaagttgttatttttgttacaacttgtagatgttgaatttgaacttacatgtatgtggagtgatatactacatatagatatatcttgtcaatttttttgaattttttcataatcatttagttgacatataataaacgggtggacatccacccaagtgattagaatccatctacgaaacaatattcattccttcaggaaaggtcctctcgtttttttcgcgtcgcttaaaaagttagcaaagattcttttaaaaaatcagctagatagatcaatatgtgacatgtcacttcataaaatgtatgttcaaattcaacttacataactagaagaagaaaaaatagagtaaatttcataaaatcatgggtaatttttggtcaaattattataaaactatatatttaatatgatgcatcaaattaccactaaaattattacactactaaagatttaaggtgaaatattgtaaaactacagattttagcaaaaaagttatcataaactacaaatgtactccctccgtttcacaacgtaagactttctaacattgcccatatacatatagacgttaatgaatctagacatatgtatatctttagattcattagcatctaaatgaatatgaacaatgctagaaagtcttacattgtgaaacggagaaagtaatatcaatttaaacataaaacttggacatttataactataacatagcactagaattaaagatttgaactccaaaatatatagttttgtgataattttataattaaatctatagttttacgacatgtagtttcgtgataaatttattgttaaatctgtaactttgtgatacatcactttacatgtagttctaataatttagcctaagtatatgtagttttgtgaaatttacttaaaaaataataaattcgactctaaatataacacgtaattcgtagtcagtttttttcgtttctaattataaaagtcgaattcgaatttacatgtttatagaataacatatcatatattgatctatcttactaaatatttttttcaaattttttaataaccttttaaacatcatacatacataagacgagggggatatcctcccctcccctctcgaggaaaaaaaaaagaaagaaaaaatccatctccaagtctatctaaggttgagaggtcggcggcggcgag

SEQ ID NO: 43125 - DNA, 329 bp, Oryza sativa
atatatactcctcctgctgctgttttatgtcaatcatgcaaattctgtacccttgctgctgctgttttttaaatttgcatgattgattcagtggttatatacctctacacttgttctttttttatgcataaaaacagattttctgcacttgctcttttgatgttatgattttctctttttatcccttcatgccaatgattgtaattgatgcatatttctcaacaaaactgaggccatatctttcatagtataccccgtattacattggatctaatgctatttaatctaatgggaggaaatttataatctttttcgggaaagttaaacca

SEQ ID NO: 43126 - DNA, 1501 bp, Oryza sativa
ttacaacaaaaaataattcgtagcaatatattgcactattgcaatgataatttttctgtggcaaataattatattttattgcaatgatctacaatcgttgttttatttagtacttttgttgcaatagaaagtaagatgtcgccacaaaaaatcgtactgttacaaaaaacatgttctatcgccataattttaatttttgtggcaatttacatagtacttggtacttttcactattttttgttgccacgatcaacaaattcgttacaataaaaaattatcgtctcataatttaacttaatttttttcatatggacaaggattgagacaaattttatgtggaaattatagctttcaacgatatctacaattttgtaggtgataagtttttcatttgaaatcttttagatattcaaaattatgattcaaatctcagttaggtaggcttaaatggaacgatatgtattttctaacagaattgatgcctaggtgagttgataaaggagagcacgcatgaaggataggtctggggttcgaattctagccaagacacgatataaaaaaaataaatagataaatagataggatgctagattaatatttgaagttttaatttggtacgtaaaactaatgccacatatggagtggtggcaataatgtttatcacaacgatgtgaagtgttgcaatatgactttttgccacatccattccgtggcaagatctaaatttattatcactaaataaaaatcgttgcaataacctattactacgctatttattgccacggctagcaacgattttaaaattgtggcaacatgtatctattaccacaattttagtattgatgccacgatttttttcatggcaacaaatgattttttttagtagtgaaaaaataggacatacttttcaaaaaaaattaataagaggaggtgataaagtgtagaaaagcacaataagaaattacatatattgttggtttaatatggattttaaatatatggatgtactttaaaaaaatataatcagcttaggagagaaaaaggaaaaatagaagagaggataagcagcagaaaactaaggggtggtggcagtagaactccaaacctaccattcagaagcttcgttggctaaccaactgggaattgtgatgcttgtgtcatagggcgttgctaaaatttaataatatgaatatttttagtgaggcaacttccaatcggactcgttaaatggacggtcaaaacggatcgttcgcgtggataaaccggaggacggacgaaatttactaccggaaaccttgcgtattttttaattaggtatatagattttgttatgagttgttttatcactcatagtattttaagtgtgatttatatcttatacatttgcataaaatttttgaataagacgaatggtcaaacatgtgagaaaaagtcaacggcgtcatctattaaaaaacagagggagtatatctacacaatttgcaaatttcaactgaacact

SEQ ID NO: 43127 - DNA, 1501 bp, Oryza sativa
gaggagttcctggttgatgaaggcttcggtgtctagctcgtgcctgccgtcaagcgcctgtggtcgtcgccctagtcttccgctgcttctcgtttgtctttgtgtgtgctgtgccttcgtcgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcaaagcccccttgaccctaggacgagccgtagatcccaagccttagcagtattttcgaaataaaaatcctttgttatttgtgaaaatcctctagtctctctctgtcttgctgcttcatttatcgccaaaatctgatctctaaaatgttgtttttcttttttgttttttttagatggccggcagcgtcacccatcgtggtttggacatgactggcttcgtcttggagctgcggggcatgtgcattgtcctggggtatccacatggagtggactaccaggccaggccgcttccggagcaggagggtgacgatgcagagccccatgctggttgggaggtcactgcagtgatcctctctggctctccctagcggacttcgctggcagtcaccgcgggtggagattccttcccagccgcctgccagagcgccgcactcctcgccatcggcactcttcaccagcgctacctggacgagttgcagcactcgccctaccgctaccaccctcgtcgcggaggagcccgtgactacgccaccttccgggatgctagctcggaggatgacgctaccatcgtgcacctagcgcgcatggtggaggcgtacgacgcggctcgtatcgacttccatcagatggtgcgccgtgggatggtcgagaacaacttgaaaatcctagagctgcgtcaggagaacctgcagctcaagaaggacctagacgcggtggaggcgcagctgcatcagctcaagatcgcccagggggaggtctgccgccccaagcgtcgccgcgtctgccgcagccagaagatcaccgcccgcaagagcacctccaggcccgagcttgttcgtcagtccctggtgtggtcttgcttcgtcgagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttggagttgtgtgaggcatggttatgccagtgtgtggcataactatgtcggagcctgtctttattttatttgcctaagcaacttgaactttaatgaaccaatttaatagcagtaataaattcaagaattatggaagtcgtgggtggttagttttaattgtcagctctctctgtttgctggtctgtgtggggttttcaga

SEQ ID NO: 43128 - DNA, 1122 bp, Oryza sativa
cacggctggaggctaagatcagagcttattcaaccaagacaggccaagggtccagaagccttgtcacccgaggacatccctccgacgacaaggctgagggctagggagagtgtacaactcaaacggctaactcccggcacaccctggccatcgaggtgcaacaactcttcagataagacgagaaccacacctcgcggcctcggagcgtttccacagcttgatctttctttacggacagcattgctctctcgagttccgccacttcaaaattcgtcttccaatattggatacgacgatcttgggtcgcaagggcatcctcgagatctgctgaacgtaatgtcgcgtcccaaaacgactctaaaatacatcctcaaaattatgccgagaataattaaaatccatgtgaaagcctccaacaattaaaatgtgcaaatttaaaagtcaaataaggcttggaggatttttgtatatttcctaaaaacctaaaatgcgtaaataaattttagtggaattttcagagcacaaataataattgagaagaaataaacaaagttaaaatggttttataaaaaaaaaaaccctaaaaagtcttcttttccccccttcccttcttgggccggctcggcccagctccctccctctgtctcctctcccccgcggcccatcggccttcccccgcgcgcgcgccgctgacgagcgggcccgcccgccaccctcgctgacgggtggggcccacccgtcatcccctacctcgcgccgctcccgccgcccgcccgtgccctagcgccgccgccgccgccgaatccgtcgcatcccgccgtccccgcgcgccataaagagggggaaatcactccccgtgattccctccctctttccccccacttttccctctctctctccctcggattcgttcggatttactcccgcgaacttcgccggcgcatcaatggcggccggatcttctgcggccgattccccctcatccgcccgctctctctcactcccgtccctatttaaacgctccccgtgcctccctcctccgtttccgccactcgccgctgtctctccccgtcggaatcgagcccgcgccgtcgtcctctctctccgccgtcgccaccgagc

SEQ ID NO: 43129 - DNA, 1501 bp, Oryza sativa
gtccaattcttctttgagaccatcatgtgtagcttaacaatttggcccaactctaaaatagacatgccaagtttgaggtcgttttgggccttaacgttttcactcttttgcattcggtatttttaccacggtttggttattgaaggatgtagtaataaattacattgtccgaatagtcaagtcaaatcaacgtatgattgacagaacgagaaccgtgtcaatggaattcaatactacctccgtccaaaaataaatgcagccatagatatctgtgcccaacgtttgaccatccatcttatttaaaaaatttgtgaaaaaattgaaaatatttagtcacacataaagtattattcatgttttatcatctaatagcaataaaaatactaattataaaaaaaattcaaataagacgaacggtcaaacgttgaacgtgaatagtgtaaaactacacttattttgggacgggggaatagttttttttgggtgtgtgttttaagggcaagaatgacgatgtggtgtcaccatttggaaaaagatgtcacgtagagcttttatgacgacgaagaaagagaaagatgccacctagagtattaattaccccctccctccatcctgtaatataagagcgagtataatagtagactataaaccggctaaatactgaggtggaggagaaatagaggagaagcgggttgtcaacttacagccggcttggacacaaaaacaaagaaactctgtgagagagacaagtgggccatatattaattgtaaagagctattccctccgtccaaaaaaaagacaaaccctagtttccgtgcccaacgtttgaccgtccgtcttatttgaaaaaattatgaaaaaaattaaaaagacaagtcacgcataaaatattaatcatgttttatcatctaagaacaataaaaatacgaattataaaaaaatttcatataagacggacagtcaaagttggacacggaaacccagggtttgccttttttttggaccttagggcagtcccaaacctccaactaggatggtgtctatagcattaactatattgccatgtaggacttttaacttatgtggcactatattaattaagagagagagtgaagagaggaagaaactgggtctcatgcaagacacagcttcaacacgagaacctatgcgccaggctcttcaatagattgaaccgcaagaatacccacgatttttcggatcgggaaatgggtcgaaccgcgcgaaatggtcgcctcggaatacagggcgcaacgaaaccaaggttctttgttggcgtgttgcgaaagccatatgaaccgctatttagtccttgaataaagaaaggtagtaatttcatctagttgcattccatcgaactaaggtgggattgaagaaaggggtcttcaacttatcttgagccatcagtcagattaaaagcagcgccctgccgccagctcctgacctctgttcctatgggaaaaagcattttggagatttgct

SEQ ID NO: 43130 - DNA, 1501 bp, Oryza sativa
atgtcgctgccatagtcgatctatttttctctggaaaatctgagtattattgttacaaatgaaagtttttattttaaaaataaaagtgttttatatcttcggctttttaagtatgctttatagtctaattaatcgatttggaaaaatccaaaaaatatcattaacaagatccgatttttaaaaaattgtcatcgatgagtataaattttatgaaatccattgtactgtcctagaaatgccacggtgttatggttccattagcaacctctgttaagtgctataggataaacaatgcatttaatggtacgagatagatggaaccctaatggtgatggtattttgaaacaaaatcgcttgtacaatgatattttatgaaacttgcacccgtcgatggtatttcttgaatttgggtgtttgtcaatgacattttttggattttctcgattgattttgtgacaacatgttctttttagctaacagataacaaataaccacgaacatattttttaacgaatgtgatgatgttttttttaagaaaaactttctttatcaatatttcttcataaactctttgattcgatcttttgatttttctaatatttaactatttatttgcgccatcaagtaattttcataacatagtttcatccttcggcatttcagaacacaacttgagttgttctgatatcttgtttttatcaaaaaccttgctttaaatactttctccatcctgaatatagtaatttctggcatccaaaatttatataaaaaaagtataacaacttatataccaactctctcatcttaacccaccacatccatctctcattaatttatctacatgctttattgtctcagctgatcacaaccataactgatttagtttcacctttctctacaatctcaacgaaaactctaaaaatatcttctctgtcccaaaatagtatagacatgccccacaatcaggttcgtagtattattttgcgtctaatctaacactatatcaatattgttatattttaagacggaagaatacctatattttataatggagagatacattatattttacagcctaacaaaactaaaaaaaacaacttgatttgttgcaataaaaaattctactgtaatttttacaatatattgttaggataaaaaaaaccattttgcaataaatccacttttttgataaaaaccaaaggatgtcatgtcagttaaagctgaattagtaattttctgctgcttacaacagctcaagccaccaagaaaatccccaaaataccctccctctccctctccctctcacgcagctcgctgcctcactctgctgcgtactcctcttgctccgctcggcgcctctcctctcctcgcgtcccctctcctccattctcatccacctcctctctctctctctctctctctctctctctctctctctctctctctctctgcgatccgaggcgcgaattgtgaggagagggggggagcttagctgcggaga

SEQ ID NO: 43131 - DNA, 1501 bp, Oryza sativa
tcatgctgtttaattaaatataataactctcagatcacaatctgttatcttaataaagtagtattacaactctcagcaaaatgcagtgcaaatctttaataaactagtatcctttttttcccttctcaattcagcaaaatgcattgcatactgttttatttaaatataactctcaagatcacaattgattcaaagagcatgatcacaaattcaagatcatggcaacctagctttcatttgtttttggaggttttcttttcttctgaattggaatatttatatgcataatgtagcaaaacaaaaacatgcaaggaacataccaacatggactgccaagtggttaagaaacgatctgacattgcaagtggcctgattagacatgcaaacaaacagtatttacacgtgtcgcttaatcttggtcggcacatgaacagcgcttaaattctttaattagtctctgaagaaggtcaggtctcctctgccactggcaaagggcagcatccgaaaaccccatgtgaccatgattgcgagatgtcgatgaatcataagacgatgttagtggccaatgagattgcagaataattcagggcgtgccacgtgtccctaatcagcatcaagatttttagagtacagcagagatggtgttatttcccgataacttgtatgtcggcgagcagggatgcaagtatgcaactggaccgacccattgctgatgcatcttatcataagtttgaattggaggaattttagacatttttctttctcgtggatatttacgcctttcttgacctcttttatgtgaaaacgcttgtagcgcagtggtagagccttcagtattggggacaccgaccaagctagggttttgcgagaaaagaaagaaagaaagaaagaaaaacactcctgttagtagaagtgtgctcatatggcttgtttggcaactcgaaggaaggagattgggagtttacatgaaaaaattaatggtgagattaagaccaaaatttgatttttaatcccaaaagatttttctcgactcgtcggtctgagtttttttaatggagcacatgggttctaccgttttttttctttttttttttacaaattttatccattccaaatggaaggcctaatgtttgtagcgtggatcttttatattttgttccaaaggattggtcaaagaacttaaacagcaaaggatgaaaaaaaatcctaatttaagagaaagagttacaagtgggaacactttttttatttactggttctctgtgttgttcattattttttcatctttttggagaaaaagtttttcattcgtatatttagcatgacatgaagaaaacctaagtattcttaggcccatacctatatttagcccatcgaaacgagtccatgaatggccggaatttccggtccatgcatagttgggcaaggaatacggccatctaacaggcccaatatgagcccattaggcccatctggcccacagctcatctgcatataaacc

SEQ ID NO: 43132 - DNA, 231 bp, Oryza sativa
gggaaaaatggaggaaacggatgaggggaagatgggagggaaggcgggattgagcctgagagaggtggaaaccggccggagacgtggagctagacgtgggggtggtggcagcggttcggtgccgattccgtggggagagtgggggaagaggaggtggggattgagtccacgcgctcacgggacggggtggggcgcgggaggcgcggcgtcgtggggcggaaccagcggcca

SEQ ID NO: 43133 - DNA, 1501 bp, Oryza sativa
cacattagcaaaaccgtccttcaaaactgctaggaaagtcaaatcacactggtttcaatagttcgagagtcgtcctatccgatgtttttttagaggggtacgaattatattcggcctaaagggagccaagtggactttatccgatggtaaaagcctgttgctgaaatgccggcccatatacgcaaatgggccatcttgggccttccaaacggcctgatctgtcgcagcacaggacagctgctgctctgggcgaaaaaaaaaaaaacccctcactggattggctctcatctcatcgatcctgctcacccttcctctctctcctcctcctccccaccccaacgccatggctgccgcggtcgcctcccatcggttcctctccgtcgccgaggcgggcgccgccttccgctggaccccgtcccagctcgaccccaaggtattcttctcttccttcgctgtacctggcagcctgagccgccgtagattggagatccatcccgacttttggaactccctttttttcggtttgtcgtctagttgctgatccaatttatttattttctttttcgagaaattaagccatattctctgtgttggatctctttcacgcactgtggtgacacaaatttgaggttatctgttgagttgaagtgtttaacttgatgggtagatttagcttgctagagaaattgttggtagttgttggtggggaatttggaattcggttcatactttccagattttattgtgttgcattgtgctatttgtaggattaaggagtcaattaactcacgactaggggcactagggggaattcttggcagtttgttcatagagatttaattcgcccttttcagtttgcttatgttgcattgtgttgtactccctccgtttcacaatgtaaggggagcgctaacatgtcccagattgatatcgaatggaatgaatctacacatatatatctatctgtattcattaacattaatatgaatgggaaaatgctagaatgacttacattgtgaaacggaggaagtatctaggattaaggagttacttttgtgtactgttcttacgaataggataacgtaatgtgcacagaggaatttggagaagtttccgcatctggtgctctattgttatatgatagtaaattacttggtggttcatgggggtctcattgatgttgtgcgtgcccttgctggatttatcatgtctatgttcagagcaccattcactgaaaacctatggtccagaaattcgtgcttgttaggaacctttatatttcgagtgttgtccagaataaggcctaaaagtgcatgatgtatacatgtatttacatggtttctgtgccaatagtgtcttctgcaaggtattactgggattgtttttctccttaactgaagagaaaaccaggtgaactggtgtttcagaccagcaagtaaagtgtgtttactctattgtactgtattggctgctatgttctttgttttatgaccaatcatcc

SEQ ID NO: 43134 - DNA, 1501 bp, Oryza sativa
agctccgttgctgatcggggaaagggcaggaaaaccgaattcctaaacgcgcaagctcgaggacacactagcattacccaagctcggggggcggattggattgggcgacggcgatggatcatacctcgaggatgtactgggcggcggcgacgcggttgttgagggcggcccactggagcgcgtggtagccgagggcgtcgggctccgtcaccggccggccctcccgctccacgaggcggtgcagcttctcgaggtccccgtacgccgcgcccgtgtacacgtcgtccttgagcgcctccgcatccgccgccgcctccccctcctcccccgcgcccgcgcccgcgacctctccgcctccgatggtggcggccggggcggcggcggcggcggtggtgtcctcgagcacctcgatctccgacgccatggagggagggagggagggagggggaggagggatcgggggattgggtcgcgcgtggcttggctttggcttagcgacggtctcctcttctcgggggcgttttgactgggtttttcttttttttttctgttttgttgtttgggcggaggaagacggccaataccgcaagagggagacgtgggaaacgaacaagcgggttcaaggaagaacgagatgccgaaatggcgattgatgattccttcttggcaacgccttttttgttttttttttcagatttcctttgctttactcggttcggaaagttaccacgaatgtagcttttgttcagtcatatttaagttactcctctcataaataaggttgtaattctactatattgttgaagttttataatcatttatttatacacttatcacaattaacttagaaaaaaaagtatgagcattacaacaggtaaagacgttttctcaataatacaacagttattaagaagatgagcaataaattaaaatattaaaatcgttataatacattataattgaaaaagttaatgaaaatacttccttgtgattttatagtcagaaagttcatagagggaggaggaagaagggtttgagatagagaatgacatgtggggcctacgatatatttttgtgtatgaatgatagatgtgtctcacatatatttttttaaattctaatgccacataagtatcgcatgggatgaacaccaggtcaacaccgccatgtcaacgccacattagcaaaaccgtccttcaaaactgctaggaaagtcaaatcacactggtttcaatagttcgagagtcgtcctatccgatgtttttttagaggggtacgaattatattcggcctaaagggagccaagtggactttatccgatggtaaaagcctgttgctgaaatgccggcccatatacgcaaatgggccatcttgggccttccaaacggcctgatctgtcgcagcacaggacagctgctgctctgggcgaaaaaaaaaaaaacccctcactggattggctctcatctcatcgatcctgctcacccttcctctctctcctcct

SEQ ID NO: 43135 - DNA, 1501 bp, Oryza sativa
cgacgtcctcgagctcggcgacggattgcgcgtggtcgcggcgagagagagcgcgcgctcgcggcgggagagcgaggagtgagctcgaggttgaggaggaagtgaggtcgaggtgatcagtgtggtgaggcgagccatgggggcggtataaatagggagggaagtgaagcagaaagagtagcgagctcagttcaattcaattcccggcttgtttgaattcaaagcaacccagctccagggtggggcccgcctctgtgcctgatcagtctatgattcctggggcccacctgggtcgagccaaatttgttccctctgatttgtactccctgtgacactcctccctctcagaaaatgtttgcatttctattgcttacgtataagcatttttagggttggatacagttattaagaaatttggtatgattaaatgaggggagtgttgtgattggagaaaaattagaggtaggtgtgaaaattgaatggtggaggattgtgattagttgagaagagaatattgacggagaagttgttatattttgggacaaattctaaatgttagaagtggttatattttgggacagagggagtaattagcaaagactaagaatgaagtgaaaaaaatatccctttcagacatcttattggttaaattttgaattttgacttgctcagattcccctactaagcacatgataggttgaaaatacctgaatttccgtggattgaaatcaatgtctcgaaaatactcatattgtgtaatgtttcaaaaaaaatactcatattgtgtataaaatttggatcctacaaatacttatatttagaaacggatggagtacttagcttagcttttgtttgccattttccctttttgtttacttattagtagtagaaagtttgattataaaaagatagaggacatgcagaagtcaaggctagtgtcgacaatattcccctagaacatccaaatcatggcattgcattatccagtgaaagtaatcacctaatccagtgacctatattaagggaagaatgaggttataataattaatctagtttatttagttcaggcctaactctagacttatccacagtgcaaccatgttagttcagttataatgtcatatggtaggtaaaccagagaaaactaatgtatgctctcaggaaaaaagagagcatgctactaagctctgaacttcggattccccacaagaacccaaactagcctacaagcattttcttgtgcaatggtactactactgaagtttttttttaatataaaactctctgtttttatcctagtcatggctagggtaatcatttttacaatgaaagtacaattctcagtctctgcattagggttcctttgaaacgcgggataggaaaaacatagcaataggaacaaacataaatcaagtgtcatgagtagccgaatcctataggaaacgaagataccgggaatttggtagagaagatgtttggttacttcataggaaaaccacaa

SEQ ID NO: 43136 - DNA, 643 bp, Oryza sativa
tctggttccttgggtttttattagagttttcctcgttttgcgtgccaaggtgtagtttccgttgtttcggaagttcgtagtcgcgaggaaaagagttcagaagatcaaagtgaagaagcaaggcaagtcacacattccccttgagaattttgatcctaatttacaaatgttttatcgtttacaaataaaattgcatgtcttgctaattacatgggatccgggtattacctatctgcttgcttgtgccatatttacttgatatctgtcctttgtcaaccttgggtaataaatcaactagctcatgttacttatgtgacctagctagaactatatgcttagccatgcttaattaccactagcccggttgatgggataattatagtattagacctttttagtgtcagaatgagctgcatgctcgagacatctggccatgcttcatggtcgtaattaccccactaaaatgtgacttcatggtgggctgtgggtgcatggttttgctagtcgtgcccatggcaattaagaaccggtcacgggaaaccctggaagaatttatcgtgcttaccacaagccagcgtgggcaacagctgggcttgtagtgtagctttcctctagccgacgcatcaggcaagggtgggtgtga

SEQ ID NO: 43137 - DNA, 293 bp, Oryza sativa
atctctttgattttgggcatctcttgtattcttgtcaatgtagccaggatcttttctgcataacaaaatagtatggccattcttcaaacaaatttttaaatgattgaatcaaatatctttaatgtgaaataaaagtagtatgtggtgggcatgttacaattttatatagatgtgcaaggccagaacataatgcattaaagagtgtaggcaaaataacaagatcctcaatgtttcaggacagcacactaaaacgtggtattaattgataaatagccaaattgctctgttccagc

SEQ ID NO: 43138 - DNA, 783 bp, Oryza sativa
ttaggacgaattgagaggagaaagggcggctagggttcgggctcgggcggcggcgccggccggaggagggagacgatcccgacaggtgggccccacctgtcggcctccgcgagaggggcgcgggcggcagcggcttgggccggcgtgggccgcgcgcggaggagggggaggaaagagagagttgggccgaattcggcccaaggaccaagaaggggaacttttgaacttttttgaataaaacaatttgtaaaatgttgtttcaattattaaaaatacttcccttgctcaaataattcccagaaaattctagaaaatagaggagcaagcatagtatttaataaaattttatctagctcatttttatgttgaaaattttcctagaaaattagggtttagcttgtaggcttttaaaataatttctaaaaattccaattaatcaacaatttatatatttaagatttttagggtgtgacaaaatataacaccggtaagcgagcctcatgggttagcgactcaacgaatcaacctaccgtgacacgggaccactcaaatggtcaaccgaacaggtgaacggaaccggcagctcagaacgactcaaaacgaccgaacgaacgagactttggctacactacgtgctaacaatgattaacgactaatgaacagctgtggcaaggctggtagaggcttaggaatatggctgcggctagacaacttggctaccacgtgacgagcagcagcgagatagcgacgacgacatggtttagcagcgacacgcccacaaca

SEQ ID NO: 43139 - DNA, 690 bp, Oryza sativa
gcccatttggaggtgtttaattgggtttctgagtccaaaactccataagttcagatacgagtttgattctcatcctccttcatgtatatttcctctcaactttggtagtttgtcacctgcatatgaatatacaccaacactcgtggaaattgttagaaataagccctaccgctaagttggatgttccacgtttatggtcttatgcaggtattgacggcgttaatttcgtacttaacggccgtcaacatccacctctactgtcccgcagcatatatgcccagataatgatatttactaatttaagcaccatgcttacattaataaatactactctacacctctacagatgatataaagcaaccgataaatcggacattaaatccacaccattgcacctctctggtaggctacccacataattatattggcacaaatataaagtaagagtagtattcatactaggtaaagtactgagaatataagaagtatttcattaattccaacagtattacggaagagaatataaaagctactagagccataccgaaactcttccgaagactccgaggactattctattctactccacttagcactaaaactactaaaataaagtatgaagaggaatcttgaacttgcttgagtatgttgagaatgaagtgagctcctccttttatagggtcggtatga

SEQ ID NO: 43140 - DNA, 313 bp, Oryza sativa
ttcctgcagccctagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcgtgacttagcagatgtttcttgtatcaacaga

SEQ ID NO: 43141 - DNA, 1501 bp, Oryza sativa
ttcagtatggtaagcttccttgattaaaagaaaagtttatatcgtaattttgtatttgcagggttttgccatcggctctgcagccttggtgtcacttgcactttttggtgcctttgtgagccgtgcggctatctctacggttgatgttctgacaccaaaagtgttcattgggcttattgttggtgctatgctcccatactggttctcagcaatgactatgaagagtgtaggcagcgcggcgctaaagatggtggaggaagtccgcaggcagttcaacaccatccctggactcatggagggcacaactaagcctgactatgcaacttgtgtcaagatctccactgatgcatccatcaaggagatgatccctcctggtgctcttgttatgctcaccccacttatcgtcggaattctgttcggcgtcgagaccctctctggagtccttgctggtgctctcgtctctggtgttcaggttggtaaccattctgaattctaggattacaattgcatccaatggtccgtgctccttatccgtttcaccttctctcagattgccatctccgcatcaaacactggcggtgcttgggacaatgcaaagaaatacattgaggtacaatatctaccagtatccatttccttttcttttgggttcaatcctgcatgttaccttaactttcttttcattgttctgcataggctggagcttcagagcatgccaggacccttggtcccaaaggttccgatccccacaaggcggccgtcatcggtgacaccatcggagaccctctcaaggacacttcaggaccctctctcaacatcctcatcaagctcatggcggtcgaatccctcgttttcgcccccttcttcgccacccacggtggtatcctcttcaagttgttctaaaccggcgacgttgggtgtaacaaaggccatagttttttggggatgagcaaaatatgtagactattttgtcatgatttgctccttgagttgatgactccattgtctacttgatttcccatttttgttctagttccaggttccaaccttgtgttttgatcccagaattttctctggtcctctttagcttttgtctccagctgcataagtcatcctgtggcacagtgaacaaggagcattggaaaatttgccattttctagcgataaaatgatgaggatgatgatgatgattgatgtcgatgatattgtcttttttttaaaaaaaaaatcttctaattttgcagcaatgggtattgattgacgtgaagcatccaaattgttgcgctgttacaaggttctccccactcattctctcaatgctttcctaaatgtaatttttctttttatatccacaaaatttttctccttttcttccctatttattcttgacaaataaatggcacatcttataaattaaatactattcttacaaatgaattgacttttgaacacaaaacccattcatagtggcaacccaattaatccattcgagcacgaggaa

SEQ ID NO: 43142 - DNA, 412 bp, Oryza sativa
ttatatttctgtatagtcgatctgatcatggaatatatttcacgttgtgttatgcgatcatttgaaagtaaagtattcgctctgggtccttcggaacgacgagttgctatgattaatttgaatatgttctctgactaagtatgcacttaagctgcaaaaggaaaactttcatgaatagctatttactgaagatgagacattactagcattgccacgtgatcatatttttaatctacatagtctgcatgctcataggtggttgccattgattatctgagaatgcaaggaacatcgtttatgttgtcaaatacaatttcatcccactcaatgcaaagaaattcccttgatctctctccaactgtttcgattactttgttttctttaatggcctcaaatatcccacatttgcaga

SEQ ID NO: 43143 - DNA, 1501 bp, Oryza sativa
taataaataaagcgtccaaaattctctttttgcccactgcacaatacacatatgcacctttgcctttcgcatgtgtgacaaagtgtagtgtctgagacatataaggtgatcacaaccgctgtagagctaccactttgccacaaatcaaatcatatatggagatgattaattttgttaataacatgaaaagaaaattaaatatgtgatgcagtgagagaataattaagtaccatggattgtgtttttctcaacactaattagctctgtttaagttgaaaccgagagttgattacgtaataattataatgtatctatgttatgtcgtatttggattttgtactatttgttcgtataggtgaaaggaatcattatgttataaatgtgagcgcaatattgacgaatattgatagaactcttactacgacaagggtgataaaagggaatttaaggccctctctttttttcccgattccatattttggaattttgtttgcatgctttccaagtttctaaatagtgtcttctttaaattaaaaacattctaactttttagaagtcaattcattcatttataccctcaaaaaaatatcacataaattatataattcatccatttcaaaaaaaatatcacataaattatataattcatcaatttcagctatcctaaaccttaagtactacatttttttttcatgcgagtcatggtgataaattattaaagtcgtacgatgaatatgtaagaggtactttgaacaattgtaaataggtgtcaaaattaattgctattaattagacatctaatggcttgcaagccacaaaattaatttcactcaacatgtatataaacatggacgaagctggaacaaatattaccatatgtcccatacatatatattgcacagttaatattctaattacatgtgttaagcatttaacattccttaaaatgctctcaagctgcgacgtggtgctctaataaattagggcaaatattagaaattctaagaaaaaaacaaagtatctatttcttgattttcacttaaatcggtaggtccaatattacaaaccgttagattaaattgatcttagaacaaactaaatagtacgaggtcccatctctcctcccgcggcataggtacggacctacgtgcatgggtacgtacgcttcccctcccttttccattttttctctttcttcctttttttcccatgcatatgcttccctctctttattactatatcatgcgccttcatgagacgatttaatcaaaagaattttgagtatcttgcactcgcatttttcatttgcggtcatactacacggtatgcgtatagatggattatatgataattaactagcaatagttttttatttactcaagaaaaaaagaaacatgattcaaaatcgtaagtacttaatccatctcctacttaagtttgtgaatggttttttaagatacgttaagaaaaatagaacccttaaattattataaaataatat

SEQ ID NO: 43144 - DNA, 1501 bp, Oryza sativa
ttctctagcaagctaaatctacccatcaagttaaacacttcaactcaacagataacctcaaatttgtgtcaccacagtgcgtgaaagagatccaacacagagaatatggcttaatttctcgaaaaagaaaataaataaattggatcagcaactagacgacaaaccgaaaaaaagggagttccaaaagtcgggatggatctccaatctacggcggctcaggctgccaggtacagcgaaggaagagaagaataccttggggtcgagctgggacggggtccagcggaaggcggcgcccgcctcggcgacggagaggaaccgatgggaggcgaccgcggcagccatggcgttggggtggggaggaggaggagagagaggaagggtgagcaggatcgatgagatgagagccaatccagtgaggggtttttttttttttcgcccagagcagcagctgtcctgtgctgcgacagatcaggccgtttggaaggcccaagatggcccatttgcgtatatgggccggcatttcagcaacaggcttttaccatcggataaagtccacttggctccctttaggccgaatataattcgtacccctctaaaaaaacatcggataggacgactctcgaactattgaaaccagtgtgatttgactttcctagcagttttgaaggacggttttgctaatgtggcgttgacatggcggtgttgacctggtgttcatcccatgcgatacttatgtggcattagaatttaaaaaaatatatgtgagacacatctatcattcatacacaaaaatatatcgtaggccccacatgtcattctctatctcaaacccttcttcctcctccctctatgaactttctgactataaaatcacaaggaagtattttcattaactttttcaattataatgtattataacgattttaatattttaatttattgctcatcttcttaataactgttgtattattgagaaaacgtctttacctgttgtaatgctcatacttttttttctaagttaattgtgataagtgtataaataaatgattataaaacttcaacaatatagtagaattacaaccttatttatgagaggagtaacttaaatatgactgaacaaaagctacattcgtggtaactttccgaaccgagtaaagcaaaggaaatctgaaaaaaaaaacaaaaaaggcgttgccaagaaggaatcatcaatcgccatttcggcatctcgttcttccttgaacccgcttgttcgtttcccacgtctccctcttgcggtattggccgtcttcctccgcccaaacaacaaaacagaaaaaaaaaagaaaaacccagtcaaaacgcccccgagaagaggagaccgtcgctaagccaaagccaagccacgcgcgacccaatcccccgatccctcctccccctccctccctccctccctccatggcgtcggagatcgaggtgctcgaggacaccaccgccgccgccgccgccccggccgccacca

SEQ ID NO: 43145 - DNA, 1501 bp, Oryza sativa
tgcggtggcggagctcgggtgtggcggcgagagcgcggtaaagggcacgggagaagcggggcaaaaaaaggaaataggtggaggaggatgagggtagctttataggggtttgggaggggcggacgtggcagggaggtggccggattcttcgccaacgacgtggggaggtggagagagagagagatgggggatttcgaatccccgccatttgcgggcgcgtgcacgtgcgggagaggcgggggagtgggcgggtgacgtgggcacagagcgtgggcgcacatgtggaagaaggggagatcaactccggtcagaccggcggatcaactccgatcaaaccgatcgacattgattcgagggtaacttttaattccgctataaatttggtttttggtactataaccattcaccgccttttttggttggcttagttattgctgtttgatcctacaaacacctggtgacagcttgccctcacaaaatacaagatttcgtgaccaggtgacagaaatttgatgactgaatgctgtcaccaaatctctttgtgaccgcctttgggcttttggtgatggtgaggggcagtcgccaaaaaaccattctctggtagtgaacgacgtactacagtatacagactatacctaccgtttgatgtttcaacgagcacactttgaattttttatgggcgaaccggcgaagtcaaacgtgtgaacatgtgagctagtcatcccagtatatgcatgatcacaaattcaactgctgagcaacctctaccacttgaaaggtagaattcaaagtgtgaacaatttcgtcgcatacaacgtccacaccatatacagactacatcaatattgtaggagatgaacaaattttgtcgcaataaaacgtgggaacatgtgacctagtcacctagaattaatcccagtatatgcatgatcacaacctctaccacttggaaggtagaaatttaaagtgtgaacaatttcgtcgcaatataacgtccacaccatgtacagattacggctttgtttagattccaaaaaaaatttagctaaaaatatcacatcaaatgtttatacacatgcatggagcattaaatgtggacgaaaaaaaccaattgtatagtttgcatgtaaattgtgagacgaatcttttgagcctaattacgctatgatttgacaatgtgatgctacagtaaacatttgctactgatggattaattaggcttaataaattcgcaaagcagtttacagacgaaatctgtaatttgttttgttattagtctacgtttaatacttcaaatgtgtgtccgcatacttcaaaaactttacacccaaataactaaacacaccctagatcaatattataggagatgaacaatttggtcgcaataacacgtgcgaacatgtcacctagtcacctagaattaatcccagtatatgcatgaccacaactactgagcaacctctaccacttggaaggtagaaggttcagcgttgtactatgc

SEQ ID NO: 43146 - DNA, 1501 bp, Oryza sativa
tcattacaaggataggtttcgaaaaaaaaaatttggcatattcactttgattcggaattaggtctttaattgaaatgtcagtctgtatttttttcctacatatgcagattagttcaacaataaagtaagatatctgcagtagataaattcccggtttgatcttaaaagttgggcagaaaaagtcaagagtcagtcagttaccttgtatttgaagtatttctgacggaatccatctgttgttataccacagactacacatgttgcagcacagtatggtcaaacatcatatctttatcatattgttgcaaaatggaatgctgatcctgatgtccctgataatgatggaagaagtcctctccactggtttgtacctttcccctgtacattttttttcaaagttcaaacacaagccttgtggtattctttatttttgtcacttaatgtgttgtctaacatggcttcatggtgcccctattgatgattcaatattgttcacatttccagggctgcttataaaggatttgcagattctgtacgcctccttttgtttttgggtgcatatagggggcggcaagataaagaaggcacgtgtttagttagtttttctagctcttcctaaaccctatctttatactgatcatgacaatctaacctacaacaagcatttaagcacgcttcccctgcattagttttgttggatatcaaatattcatttccagctcaaatgcttttcattaggttgcactcctttgcattgggctgctatccgcgggaatttggagtcatgcactgtgctggttcaggctggtaaaaaggaggatcttatggtgcaagacaataccggcttaactccagcccaacttgctgctgataaaaatcatcggcaagttgcctttttccttgtgagtgctatgaatattcaccattttttgtttatcatacatgagaatccttctagcttcccaagagtatccttttagcttcccaagattccatcataccgtaaatgttgccatctgattgggaatttaatagttctgttaatatgctttttggctgcttttccatttgtgccacctatttttggcttgttcttcattgacaattattttttatacctaatacgtagtagtaagcattactctcatgatgaatggatgtgctccacggccctgctatttcccaatagactctgtatattgcctgccacagtgccacttaccgttaattcttttactatatgaattaaaatgttttcttaaaataatatgcattgttaataacatggaggtaacaaagtaaaagtttttggataatcactagcatttgtggattgtgaatgctcttgtacttgttctggatattcttttaactattccccagtatagattatcttgcttaaaggtataaaacatttatcgttagcctcagcatgtaatttattcctggcaaatgctaaggattgatttgatgatttgattgttctatgcaggggaatgct

SEQ ID NO: 43147 - DNA, 291 bp, Oryza sativa
aggatccgcgacatgggatccacgagttacgggttcacgtgtcagtcagttagggcatgttattataaccaaaataaactagagcaagttaacaatattgtcaaaattttagcaagatttcttatgtatttatcaaatttggcaacatttttttaacttttctaaaaaaaatagtatagttgaaaatagcatcaatttgaacaacctgaatagtaagttaaatgatctatttttaaatttcacgcatcatgaaacataatgttatttatctatacttcatcgtctcttagc

SEQ ID NO: 43148 - DNA, 1501 bp, Oryza sativa
tattgtcgcagtccttgtgttccttgcacttgttcacagagagaaaaggaagatgagagaattttttgaaaagaatggtggtcctatattagaaaaagtcaacaacataaagatattcaagaaagaagaactcaaaccaattctgaaagctagcaatattattggaaaaggtggattcggagaggtttacaaaggccgtcttgctgataacaaactggtggccgtaaagaagtccatcaaagtcaatgctgcacaaaaggatcaatttgcaaacgagatcatcatccaatcccgagtcatccataagaacattgtcaagctgataggttgttgcgtagaagttgatatcccaattttagtatatgaatttatcactaatggcagtctcgatgacattcttcacggtagtaacggagaacctctcagtttggatttacgtttggatattgctgccgaatcagccgaaggtctggcatatatgcattcgaaaaccaccaatacaatcctgcatggtaatgttaaaccagctaacatacttttggatgacaactttgttccaaagatatctgattttgggatttcgaggctaattgccgtagataaaaatcaacacacagataaagtcattggtgacatgagttatatggatccagtttacctacaaacaggactattaacgaagaaaagtgatgtctacagttatggggttgttctcttggagctcatcagcaggaagaaggccacatattctgacaacaatagcttagttcggaattttctagatgctcacaaagagaaaaggaaagcaactgagctgtttgataaggatatcacgctggcagaagacttggacgttcttgatggtctcgtgaggattgctgtggaatgtttaaaccttgacgtggatcaacgaccagaaatgacaaaagtaacagacgatcttttcatcttgatgaaatctcgagctaaagagaccaagcagtaaccagacaaaagttgcaagatgcataagatattctacatggttcagaggatttggggaggtaccatgatttctagcttatattttggtatccttgttatgcgttcttagtgttaagataccttgatgtatcataaagtgataaataagatgtcgtaccatcttaaaagtattgtaaaattactcttattgttgcattgaatctgtgtctgtaaaataagactgaggccaactatcagtgtggttgtggaaaaatggcactacgagacattgaatgcatcagtgtatataacttcagtggggttcacatcctatagcataatggcactaccattatagacattgacgtatggtgcaataggagggtgagaccccataccagtgattgtaatggtagtgacattatagtagaggatgtaaaatcaaagtgtgtttgattcttattatgtgatgaacaaaatgacatatcagattattggttttgatatttggagattattagtgaagtggttttggaga

SEQ ID NO: 43149 - DNA, 421 bp, Oryza sativa
cgctgcaaatccgacagtggccaaacaattatttttaccagctctactaaaaaaaccttgaaacagctcagcatcaaatcaaggactgcattttcgtatgccaaatataggagaaaatcatgtaaaacactgagatgtgatgctccaagcatgtacaacagcgatgaaacctagctgaattggtagataaaagggacaccccaaggtgaaaaacacaagacaaagatgataaaagagtggcatgagagatatggtgtgaacagaacaaaagagtggttcataacaaacagactgaaatgccacaactaatgaccaggaatccaggatcatatgcagcgccaaggatatcattagaatttcccaatagatcgacataggcgggactattctgtttgctttctgtttctttttcgttttcagg

SEQ ID NO: 43150 - DNA, 1501 bp, Oryza sativa
gatcaagggagcagcgggcacatctgatcagggccaggaacacacaacggctgcgaggaggggatctgcagagaacaaccaagttgatgcaacacagggtcctacggtgttcaccgaaggagatctggtggaggatgatgaggatgtggttgtggtgaatattgaggatgatgaactgcagactgctggcctgtggacgatcttggcgaggttctattctctgagaactccgaaccaagtggccctgtttgacgacatgcgcagagcttggagattgagagcagatataagctacaaatcactacgtgacaacatgttcatcataaccttctcggcagagggagactatgattttgtcattaaagggggtccttggattcatagaggagatgcgctcctggtagcgagttttgatggcattacgtgcccatcaaacgttcctttggatgttgttccgatctgggtgcgcatatatgacctccctctggtgttgatgacaaaggtaagaggtgagatgtttgggagcaaactcggcaaagttcgtgaggtagacgtgggggatgatggacgcaacaaacatgattttttccacattcgtgttgatctccctgtcaagcgtcctctgaaatcacagatagctataaggatgactgtccaaggcaaggaggtccttcgcaggttcgatttacattatgagcgggtaccgcacttttgctttatctgtggttttattggtcattccgacagagattgcaatagaagatctgctaatgaggagcaacctttccaattctcagctgagctacgatgctccccccttaaaccttttgagaagaagatcagtaaagtgaaagctgcccaaacatcaagtgttgcacgtaacttgttcttcagaggggcaggaagtgctagttcgttgtcctccagacacaaacaagatggtcagatgcaggaagcaataccgcccagagttgatgcccatgatgggtttgagtttaaggaaagggaaggggacactgcaatcgatgagatgttagctcaacaggctgggaagatggatgttacgggggacaaaactcagggaacatcgatggttgtccctgctgggaagctagcccagcaacaatcggagaaggaagcacccaagaagactgatggtgatgaaatttctgcttctgagatgataccagccatgaggaaccttcaacagcaagcctcgtttggggaagtgtcatccgaggagatcagcgatgccaataggaagaggatgccagaccagtcaggactccagataaaagggagggttcagcaagcattgttggaataccaacaatacacaggtggcagcaattccatgcatggggatatcggcaaggcagctagagcagtgaagagactcaagaaggctgtagagggtgaggacacagacgatatggaggcaaccagccatggggccgctggtaaactgacgggacctgtgattgggtcccgtcaggagcaa

SEQ ID NO: 43151 - DNA, 1501 bp, Oryza sativa
cggagcggtccattagcgtgtgattaattaagtatttgcttcttttaaaaaaggattaattttattttttaagaaactttcatttagaaactttttgcaaaaaacacactgtttagcagtttgaaaagcgtgcgcgcgaaaaatgagagagatgggttgagaaaaggggcattgcagccagttcccaaaaggaacggtacgcacggaaaacgaaacggtctattagcgcgtgattaattaagtattagctaatttgtttttcaaaaatagatcaatatgattttttaaacaactttcgtataaaaactttttataaaaaaagcacatcgtttagccgtttgaaaagcgtgcgcacgaaaaacgaaaggggagagttgggaaaacaggatgccgaacacaccctaagaccaagtttaatagtatagctaactagcagcttcaattcgtctatagtcaatctaatagctcattcatataatagttacctataaacatatactataccattaatatatggtcctacctctcatacatacaacgtattggagtccgtgctctctctctcttctcttctcttttccacatgtgcttacagctaacttgtagcatgctattgtacccactctaaaactttagagaactagttaactgcactccgaccaccactatcgggctaagagcaagtttaatagtatagccaactactagctccaattcatctatagccaatctaatagctcattcatacaatagttatatactacactattaatacctggtcccacctatcatacgcactgtgttttgtagtccgtgctacagctgtctacaaatttatagcccgctgcttttctctcttcttatttatcttcttaaaatatgtttgtagcccgctgttcttctctctccttatttatcttcttaaaatatgtttgcagctggtttatagcatgctattgtacctgctcttcaatgcatgccgtcctccatgttggttttccattcgtctcctatgaccacccaaagttgttatatcgtggaggctttttcatcaaacacccttttgtgtttcttccagacaaaccaagtcactgggatcaccccgacgtcgaatgtcttgtgatccattttggcgactgatcgactaccaggatcacggagaatgtgtttcgcctctttttaagctgtgtgggtgtggtgtgtctcttctatatgtaatttaaaaaaaacacaagaaaacataccggagtgcaaggaacacaaagacaaatcatacaatcttcaagatagcaaacggtgctttacaccgcgattatatttgtcctcactggaatcgacatcttatcctttcatccagataaacgtaaagtacgcccctttttgtaggatctctctccaattcagttagcctttttctgcctccaaacgaggaggcagttgtgctcaacaccaacaaacattttgcgtcccaaagcgaacacattctcaaccttttatatgg

SEQ ID NO: 43152 - DNA, 1501 bp, Oryza sativa
caatgcgccccaaaaggtgaagatttttgcctggcgagctattactaacagccttccaacattggaaaataagaagaagaggaagcttgaagtttcagacatctgaccatttgtggggtggagtcagaatatgttgctcacgctttgtatcgttgcccacatgcccggtaattctgggaagcgatgactgttgatatgaagcttaaccctctcagtaacattcgcaatggagatccgaaagtgatcctggacctgttggagcagtcgcagccggaggatcaggtcatgcttttaatggtactgtggcgaatctggcacacacggaatgaaatagtgcatggcaaaccagctccaggaatgctagtgtccaaacgtttcattgaaagctatgtgctctcccttgctgagatcaagcaacacccccaagcaagtcctgagaaggggaaacatgttgtggatgtggttcaaaagaagttgcacagcatcaaacggagtcgagaacctgttcctgacaaatggttgaagccgctcccaggaagcatgaaactgaatgttgatggctcattccaggagagtgacggcaagggtggtataggcgctgtgttgcgcaattgcacaggagaggttatttttgctgcttgtggacatgttgattgttgtagcagtgctttggaaacggaactccttgcctgcagggatggtcttgctctcgccctacaatggaccctgctgccaatagtgattgagacagactgcttggcgatgatccatcttttccgcgatgcaacaggtgctaaatcggagctggcgtttttaatcagggagatagattctctcttggtgggaaatagggatattagcttcagtaagtgtcttagaagtcaaaatcatattagccactatttagcaaataagggccgttgtgacaagatcacacagttttggccggacaataagtgtacttttatctcgcagtttatctgtgaggaggctaatgagtaattatccctttcccctgcaaaaaaaaaaagagtggaaccaacacactcaaagatacaccttcacattatatttgaatttgaactcacacaaaaagccctagatacactctcccacaaagcacaagggacacctcaaacctgcaaaaaagggcaccaaggggggcaggggtgagtttacctcttttccgtagtttctaaatcatcgataaatcgtctataaaaaatactctgttaacctggaggaaatcctattgaacattacggttaataattggaattatcagggagaattttttttgaaattctctatgcttaaaatcattaacaggactttaggggaatattcagagcagaggaagtaataatgttaatttaaaatgtcaggatttgaattaataattctttcctccccctcccgtggtcgtgaaccgttcttggttcactgtccccgtgcgcggttcgtcgtatccaccgacccctttgccgctttgctttcgttt

SEQ ID NO: 43153 - DNA, 1501 bp, Oryza sativa
cacgccccctcgccgcgtcgagcaaagaagcgaagaaggaagagagaaaaagggaacgagaggagaaaccgagaggaagaggagaagaaaagagaagcgcccccgtggcgaccgccgtgcgggtgtcgagccagcgcaggacaagacgtagctggtcgtccgggaggttgctgatgtggtcctcgccatcatctcctcattggtcacccgctccatcgccgggcggagcatgcgaaggccgccgcggcggacgcgcacaatggggagaggcggcgcgccggccggcagcaagcagcgttgccgccccttctctctgtctcctctctcaccgtgttctctgagtttataaggggcaattttatctcaccatctagtagaggagagaaaatctttttgaaaataaataaaatggcgaaaatggcaaagtggcagtagacatacgcttcatgttggcattttatcaatcacgttttgggatgacattctagcgaaactatgttttgaacatggcgaaatgttcattttcttaaattcatcaccaggtctcgttagattttgatcaatgattagtccaaattatacatacatctagtgtactaaaatttaatggcagattcatcacaaaatattggtatttacagctactagaacatatttttatagaattaaaatattggtatatattatacatatgtttaaatgtatagtaatattagggatgtgtcaaatctgatacttcatctgtcccaaaatgttgatatctaatataggatgtgacattatctagtactatgaatctggacagataatgtcacatcctatactatatagctatattttagaacggaggtagtactgtattttgacgtagtaaaacatatcatatggaattaagggtcaaagcataatttaatcccttttttttcaaaatgaaacagttctgtaaaagtagaggtattagcagatttttaatggaccattgtagtataagatacaactcatttcattactgaaaataaattagccatggcgctcggtgcatgcaactatgcaagctggaatggaattaaatttgcaagagtcaagaggaaggaaggaaggaagaagacctgttcgtgcccaaatttcgaagccaacaaacaaccaaccgaaaaatactcacaaattcattgccgatacttccgccatctcctccattgccgtcgtttgaaattcaggtagaacatgtagtagttgacgccgcccaatgccgttcgtgatcatggcgtctcgtgctcctcctcttctcctcctgctgatcgtgctctctctcgtcgtcttagcagcattgctcgccgccgccgccgccgatgcatccgcaggtaaagatttcgtgtgcattgtctgatttatcgcggcaagaagtgtgaaattttgatgtgattggtggcggcggcggcggcagtggccggaggcggcaggagctcgccgtcgacgacgacgttcgtgctcgccggggagc

SEQ ID NO: 43154 - DNA, 335 bp, Oryza sativa
tccccctcttttttcctcccctctctccctcgggcccgttttattctcccttcttccctctcggcccagccacccggcccaagccgtggcgccccctggccgagctgctcccctcccgtgccgcgcacgtgcgcgcactgacgacgcgcgccccacgtgggacccgcctgccaggcgcgtcttcctcctcccgctcggcctcttctccctcccgtgaaaaccctagttcgttcctccttcgaatccgcgcaatttaagcattggattccaaaattgattagggggaattaatcccctttccctcctctctctttcccccttaattcccccttgat

SEQ ID NO: 43155 - DNA, 178 bp, Oryza sativa
aaaatcagctacaaatttaaggttgaaaatttaaaatttggttgataaacataatgaagccggacgctttagtgtgcgcgctgagacagctagaggatagaaacaaccaagcagcaaagctaccttcctaccgcacactagctacctttgaggcataggtcgcctctcgcctttcaga

SEQ ID NO: 43156 - DNA, 1012 bp, Oryza sativa
aaagactatcgaaagaagagactatctagaacacaacacgagattaattaaaatccagaataaaaaataaaatcagtagtaatacaatttataaacaacaaaatatcaggacggaaaatatggaagtttgtttagaaatagtccatctagaacacaacgataacaaatggcgataaaaaggggagaaacaacaggcccgtaaaggagtagggtggtggctgtttatgggacatctaaaaactataaacaaaaccccaaatagaatcccaatgacgattaagaggagggacgacgggtaggccgttaagcagcatggccatgacggttagcgggacttctagaaagtaaaaaataaaccccaatgttaatcatgctcgttttttaaaatctcaatgataataaagaggggaggctgcaagcgggtcgtagagaagtataatggcggagccgctgacggtttggcgggacttctagaaagtaaaaaaaatgaaccccaacgacaattatgttttgttttttaaatcccaatgatgaagtgaggaggcagcgggcgggccgtagaggagtacaatagcggcgtttgacagggcttctaaaagttgtaaaatgaaagccaatgagacaatgaactctaaaactacaatgtccaatttttaaagattccaagaaggatgagtagaagtcatagtagatcaagcaaacaaataaatgggtgacaaaggagtaaggggtagcgattggcgtgacttaaaaactacaaaattagaaactcggagatgataaggcaatgagatagctatttaacaaaattttaagtaaaatcatatgtaaaaatagataattttgtatgagtgccattgagctagttgtgtttataatagaaaatgattgggcttctgtttgtcccattgagctatactgcaaatgtttttttctcagtccttgcaattatcattccctgcttatatttgggctctatttttaaattacattgtcaatcatttatttcttc

SEQ ID NO: 43157 - DNA, 662 bp, Oryza sativa
ttggccatttgaactcggaattggactgttcaagtctctaattttttcttaagaagtcaagaacccatttttgtgctttgttcatgcttgttatatggagtttattagagtaaaagcccttttcttttccgttggtcgtgtagatgctgcagcttcggaagatccgctcttcgtggaggttgaagccaacgtttgggaaagcgagcaaggcaagtcacatcattctttgaacatattggatcccactttgtgaaattactttgatttaaattattgcattatcgctttacttaaattcccgcgttatcactgttttatttagccatgcctatttacctttgttatgaccttattattgttgttattgttattattaccttgttcaccctagaaaaaacaaaaccccaactagtgggcactctattcatggttccactagtatgaagttaggtagatgcttcgctgattaattaggcaacattaggtggttttataactctagactttgggaatattcatatcacttgtaccttatggaatggttgatttattgtggaactggatgcacacctccccctctattcaaaactctcaaaatggttttaggctgggcttggggtgcatggttttgatagtagcacctcggccacataaggaccggt

SEQ ID NO: 43158 - DNA, 912 bp, Oryza sativa
tgatgttaaatacctcattgatatttttattcccactagagccataggttgatcgttcatgattagcttgctagatacgctgcttgtcaatacattgagcgttgtcaagttttgtgaccctagtgatatgcttttcatactttatggtcaagatcacatacactccacatacacccaccaatgcttgacttctacacaggaagttagcattcctcatttatcattcatttcatccacattccacaaaataaatactccatgaaatttatgcctcttcttccaaagttctttaaaaaaaaagagtgagagatgcatggcttagcaaaaagaaataaaaaaaaagtgctcatacaagtatggagcatgatgatgagaaaaaaaagaaaaaaagggaaaaaaagatagccatgtactcttcgaaatttcaaaaaaaataaataaatggagaggaggtatacaaaaggagttattcttatttttcttttacaaattcaccatacacatacacatgcacattcttaaccagaaagtatgtcttctatttccgcggatccattatttgactttgcaatatatgtggtgcaagtaatgctctactctttttcataccctgagctccacatatgccttattaggtggtaggaaaagaaaaggcacaatcatatgcctttgtgaggaatcatacactttgagtgattgagagaatcattggtggagtaaagcaaagttgtaattttgtgttactggaaaaaaccccacgttgttcttcatgaaaagttaggctgacttaagtcaagattgttcaatttctcaattgctcaggatcacatggtagacactacaaagaccacaggtgtcacgaccggaaataacccaacgggcgttccttacgtgcgtgtattattccttgtc

SEQ ID NO: 43159 - DNA, 1501 bp, Oryza sativa
ttagttacaggagttgggtctagagtagagttgtggagctacctaaatccagctccacctctctagtttattttgtgagagagctgaaactgtttggctagttatagctctaggagaagtagagctggagctggagctagagctgtgctaaacatgcttctaattttataaaaaaaatatgactattagggaaagacctaatatcaaataaatagagctaaccagaaaaccctataggcgtttctcctaattttacacacaccatcttcttattaattaggagatagtttatacgaaataaggaattttatggtccttcagaaatctcttttaaatatgtgattcgaattttgggcctacaatatattcggattagtttcctaatagaagttgactattaggattagtttcctagtatgactctaagtctttccccactaggactcctagatttctcctatatatagggcctgtttggttgggtatttcaacttaccacacctcaagttagcacatgccaaaagtgtggcgaacgaaatccttgccatagctttggctcaaaaatgtgtggcaaagcagctagaagctgcctaactttctttggcaggctaaactatggaagcaaaacaaacaagggctaagcggttgtggctgactaacatgaggtgcggcattctgtggcatggatccaaacagccccatactcttgtaagccgcacggggagggtgcgacagtccaatgtaccccatgcgtttgtatccaactcctctgtagtgatcattgccggtcggcgcccgtggttttttcctgcaaaggttttccacataaaattcgtgtctccgttgtgtatctattttattaacaacctcgaggtaactaaattttactctaaatttttttggtactttaaggtactcagtgcctagaggcaccaaatattacactagaaaatatggtacctctaggtacattattaaggatgataaaattacccatacaacatattgcctctaatgcacttgtcccaatatactactcataccttattttttttaattcaatccattgatttttttcccttatctatctaggagtttgtatagagactaccctttacataaggggtggcaactcctctctttctttctttttttctcttttctatctcattatgtaattttagagcctcatcggtatgcctaataagccaaagcaaaagggcaaaatatgaactttcaaacttgattttgaagcattttcaatgtaatttctttttagtattggtttttaagccgttacgaacaagtgtataaaaatttacctataaattaattttattccctaataagtctaaacgatttattaagtaatattggcaacccatgaggctcttacatggtactcccttcgtttcatattataaaactttctagcattgcccatatttatatatatgttgtctagattcatatatgtgattcattagtgtgtgtgtgtgta

SEQ ID NO: 43160 - DNA, 1501 bp, Oryza sativa
cctttaacctagaactagaaggcatggtgaaactctagctgcagaaaaaaaaacaaaacaaaatgtgtcctaccaacaccatcccttgagggcaatggtgcatacagtacattttaaacttattcacttaattgtaacttttaaccttattaaattttggctttataaaactctagtagggtaacaaaccaaacatatgttagaaatcttagtagtttttcacatcagctatgttaccaaactttgataattctagatatttgcacttttcaaagttcaaccaaattttagtaaggtagagttgagagtggctacaaattggacaagtcctttattctatgtcaatcctaggctttcaattttgttttttttttgtctacgacaagatttaataattaccaaaactttaacgaagttgtttggagtgttccttttttttgggcaagatcaactagccctagatttgtaatattgtaaagaaatgaatgtcaaataatttttcaataccatttaaaaaaacaaaaccaaatggatgatagattttttacagggataagtccattttacacccccaaactcttatgtttgcctaaaatataccccgaactacaaaatcaggtataatatacccctaactatcaataccaatcattttacgccctcgagcaattttaagactggttttgattcatttgaacgccacatcagcatagtcccaccagtcaaaccatctcaccggtcacgtgtggagaggggcaaggaagaggggctgtgatgaggaaaatgaggaatagaaggttggaggcagccaatgagctccctccctccactccccgctagcccatccatgacaaggcacatgcaacggaggggggaaaagctacgtcaagcggcagcgcggtatctgacaaggcatcatcgcctggtcaaggacaaggtccagctcaagctccgcatccgcttcttccttgtttagctcgaactcctcatctcaaagcctagtcgccttcgctgaactcggcatccccaagtagctcgagctcgtgtttgtgctccagctcaaggaagtgaggcaggatgttggatctttagcttgtgctcgccaacgctcggcccagaatggggcagtgacaagggggcggcgacgggggagggtgatctagagctcaccggctctcagaagggtagttgggagggagagatcaagctcaccagcgctcaggggtgcggcaacaaagggggagtagagagaaggggaaaaaagcgctcatcgtcagccgctcttgaagcctcactagccgcactgtgtggggtaagagagacggaggagagggagaaaggaggaagaagatgaagtgggtgagccctctattgtttagatgatgtggatttattgaacagttggcatcctatgagatatccacgtgtagcaaaactatagtaaaacaactcgagggggtaaaatattcagtattgatagttaggtgatgcattataccta

SEQ ID NO: 43161 - DNA, 1501 bp, Oryza sativa
tgctctaataggcatagcacattgtgagctttgtaataactgttaccacctaaacccttggcccacattattatctagtttagtaggatacattacggttgcttgagaggtactaccaagaagtattaatatctgtagtgcaaattttggtattttttaataccaaagataataagagatactaaattttacgctataaaatgtggtatcttttggtaccttctaaaaactgtaaaaatcattcattagtaatacgtttgtctataataatatttcgccaaatcagatctcagtgacttgcaccctagctgttggattgatatctaacggttagggactcatcttcaacctcccgcacaagacatggaaaagtggagctggtggatgagaatactcactatcaatggtgactccctcgaccgcgcgagctgttggagatgcgtgggtggtgaggtagcccaagacaacctgccaatactattagagggtgaaggtggcgccacggaataggaggaagaggaagtatatgaaagatagtagaatggggtggcgatgaagtcttgttggcaccgatacatgcttgcaaggcgaagtgagtcaacgtgaatgacgtgcacatctacgatgagtagcggtggggtctaggtcaggagcaacgggtggaggaaatggattgagatagggttacaaagtgagatagggatcttgatacaatttaaaccattcaacataaataatggaataagattaatcatgcaactcatgaattaagaaatccaaaaacaggtggcgttaaccatatgtacaaatactccatttagtcttaaataaatagatgatatagttgcctttttacacatatatttgatcatttgtcttattaaaaatattgcatatcattttttttacttgtttttcatcgaaggtaccttaagaatgatttatatttttcatatttacgtaacatttttaaatgaaaagaataatcaaataaaaatcaaccatatcatttattaaaacctaatgggagtataataaagcgatcaaaacatgacgacgccgtatgcatatccgatggatatgatctacttccagcctactttccatcccgtgtaacggccggtacgtgtaagtgcaccatggaggatgagtatatattatagatctgatcgatcagtaaacaagttaagatgcatgtgccacaaaactcaattaattaattaatcgaacgtcatatatatcgatgcatgggtagcaagatgcatgtgaccgcacaaacataataataatactatacagtaatagagtactactagtggagtactacaatgccaacgttagtttctgcagatattgcaggataacgaggtgataagcagatacgtgcgcgtataggtgagggtcggtcgcgagggttgtggacaggtggcgtcccggccggcacaaagacactagcccatgcggcgtgtatatcgtcgcgcgcgagaaatcgatcgacagc

SEQ ID NO: 43162 - DNA, 1164 bp, Oryza sativa
acaactccactccagactcaactcctggagttaaatttaggagctggagctgtaccaaacaggcccttagtgccatccttaaaattttggattcaaaactaccatcatcatatgtatcactgatatgtggtgccattgtgcagtactatgtgtcatggatatgaaagaaaagaagagcaaatgaaagacaacaaaggaggtccattattatttatttccacgcacatatatgggtaggttgacagaaattaataacaatgttattttcattcaatcgggttgatattttagggtgtgcatgcttgttcaatgcctaataaagcaatagaaaaaaagggtaatgccaaaatacccataggtttgttggaaaaaatggtcagtactaaaatggcaaagcaataaaaagctttgatttgaacaaacttagccaaagttttggcataaaaataaacaacctagtttataaattttttttggaattaccttctttcttggagtaacattgagaatgaccttaattctccagcacgtatggcatatattgataacaattaaaatatgtgtattttgcaaagcatcaacactacgatggttaagatgacatactgatgaaccgataaatcattggcctcagttcatttgagtttgtaataaaggatgcacacccgtggacgcgtgcgcgcatgggtcttccatttaataggaaaataatattttcttttatttccatttaacgtttccgtataaaagccaattattggagagtaaggctccattttcggtactttatttacgtcgtgaaacaaccttatttattatgggcacgttttctaaactgttcaatggtaaattgcacctcaaccaagcaaatcgaaagtagcctaagtaaatttctacaccattagtttacataataaacccctaatcaaggatgctaaaattagagaaagaatcagaagatgagagatggggggggggggggtaaatgaaaaggtaaaagaaaaatggagtagcagataaaattggaggagcaaacagtaatactaataagtaagggaagggaaatactactcctccaattgattgattccctttctcctccggagttgtcttctcctcagccgccgcctcgccctcctcttcctcttcctctcgactcgcagc

SEQ ID NO: 43163 - DNA, 1501 bp, Oryza sativa
gaaactaatgcaatttcgtcctcgaaacaagcacagataccaagctatcgagtaagctcccttcttttttgaatactacaatggtcatttgatgcattactgactccactgtaggctcgcatcttttctagttttctgtgtgcagtgtttgagaatttaatataagtctactaaactcttactccctccgtctcatttaagtgcaaccatgagtttctgtgtacaactttgatcatccgtcttattttaatagtatttttattgttatgagacgataaaacatgaataatactttatgtatgacttatgtttttaatttttttaaaaaaatttttaaataagacagacgatcaaagttaggtaaaaaaaaaatatggctgcacttaaaatgggacggatggagtacatcctcagtgttttgtttggtcagaataattaatatacctgtggcagaattaccgaccagatgtaactattatactcacgcacttgcacttcacaatctcggtgcattgcccatctctactgatttgtttgaccttgccaaaatagtcgcctccctcatctttatctgcctcgcttcagcatttgcattcgtcatcagataattgatcttcctattttgtcccaaactttcaggacaagtatcacaatgctggtgatcaacagatcatttgtcagatgtttcatttgagtcttcctcttcctgggtgcagttcctgcctgcctggtaattttgatcagctgctggggctggcgcgtcgcattgcagtggagattttcctttgctggtctgcagccagagattagttttctcacacctgatacatcccgggccatcaaatcttgcaagttacttacagtagtagtactacactagagaagttttccgaaccaaagaatactactatttagattgttacaaggcaagtatttttttgccaatttaacatgcagctgttcatgcgtttcttgcacattggaaatcaaaacgttgattcgtatttgtacttggatgggcaacacgacaaatgctaaactgcagaatgcaatgtctttcaataacgttgtaaaagtaaaatcaggaagtgaaacaaaatacagtgatccttcacaggaagagataattgcttccattagccttgggagactggggtggacgatgcaagcaaagtattcaggctcttcctaaccaccgccttttatttttcacgtgcatgtttttttaactattatatatttttttaaaaaaaataaaagaaaattgtttaaaagaatatattaattttttaagtttttttaaactaatgcttaattagtgtactagtccatcatttcgttgtgcgtgttgggagagagcgcttccaagttgttccaaccatcacaaagaacacgcccagcaggagcaggcgatgactgactgtttctcgtgttgcttgaccgtgcagcataggtcaaggggtttgtttctctataattaatttaagcggacagttatgta

SEQ ID NO: 43164 - DNA, 1501 bp, Oryza sativa
tagagtcgatgtgacgtttttcggaaaaaaaattaggaactacacaagaccttatgtaaatccagcagcccgtactattcggggatgacagaaggatgtcgatctacacggtttattaacaagctttggagttaaatttcaccatttagcattttaccttgagcattgggaaaagtaagaaaacccttcgtgcaatggagaaattcatgatcagatcgtttactaaagagagactgcatttggtctcgttttaacacataacatgcatggaggattggaggttttttggcccttcgattccgtgcatcatacttccattctaaatactgaacgtgacacgaacatgaaaatgaagcaaagagatagtgagatagcttaataaaatattgaaaaagaatagtgaaaaaaaaggtcccaccgggattcgaacccaggtcgccagattcaaagtctggagtgctaaccactacaccatggaaccgatcttgttcattgcctgtgaattctatataaggctttgagttcaaaacaaactgaaatttgacccgaaaatgtatgcgcggcgcaacagcggtacagtgtgatacgtgtatgtatacggtgctgtactaaaggatcgaccttggagaaaatttgatatgatcaatcttgacggatagctcgatcgcgtcgcttgtttacttaacatagaaaacaaaatggtatatgttttcttcaaaacaaaaaagaaaaaatatttatgttttgagagggagagatagagttgacggtaagaagaaaaattgcaaagtcgcgagcagttattacattattatgttccaaaatagaaggattttagtactaatttgttataggagtatacacggatacaggtagcgtgggcgacattctctggaggagtttgagcgatgagacaagtgcagggcgctgcttcgtgattgcttgtctcgtgtctgaatcactgaatgaacgatcttctggaggaaacttgtagaagcgaaaagagcgatgggtgtcagtttgcttccaatatttgtggacgaggagtagttactatgcacatgttggcaggcaggcatgttgctcgatcgatccttttgtttgtttgtttgtttgtttgttgtgacatggagtatgtatgtactaaagcatagggccaagtgtacgtacgtaatagtacaagagttggtaacaaaaatcaaatgaatggtgatcactgagatttagatgctggaggacagtggatggatggatggatcccaagtgggcgacgtggctgcttcctaacccttgttgctcgaggcctcatccttcctcaactattaaaaccccgggcgggcgtgggactcgaattcattccaagagagcaagccaagatcaagagatcgatcatatcgtattttgtagtaatttagcagctagctagtgcagctgcaagctattagcgactgcatgctttgatcgatccatctagctaattgttgaatccatctaagcttaa

SEQ ID NO: 43165 - DNA, 1501 bp, Oryza sativa
caggggaggatgtcgtcgagcgccgtgcgcgcctgcgggcgctgcacccactcgcccatggcggcgcaggtgtcacccaccacgctgaaacgtcaaggaattcttttgctcagtgtcgagacagcaggtacgtgaggtcgccatggcagcaagcaacggtgaaaatgtagaagaaagtttttaaacaaaacatataccccatcacaaaatatgacttgtatatcatttaaaatttgtctaggaatattttgtctaaaaaaatttacagaaaatctcgacgggatacccttctatgagacaatacctgatacctgatacttgtagtggtactagctgtatggtacccgatacctgtgatacttgttacccggtacctatgatacctagaacctaatacctgtgatactcgtgcaagagaatagttaatatgtctattccgttgcaacaggaccctgttttgtagcagccctcaaaaaatttatcccacaatataacaacttctacacctacatttcattcttaatcaatcataatcttccctcattcaaattgactacccactttctcttcttaaccaattattatttttctccaatttaatatcacttatttttttcttaatatccatgtccagtggtaactttctcttgttcaattctacctgcatccttatattttggaacatatgtatcattttttgagacgtgaagcaaataaaaaatagttttttctagacatggagcaaataatttgtggagtgactaaaaagatcgtagccttacttgtgtagcagaaggaaggtgccacagagcaaaagcgttgctgcaaccagaatccacccaagaaacaccaacctgcatccaaaacaaccgtgtggctcaacaccagtaacagatgaatatttgggaatcttatgccaactagggcaattctttttaattttttgtaatttcagcatgtcaaatgaattagtgaaatcataaaactctaaaggagtgttttcatgcttacacatagacgagtgactccattccgcatattgagaacgctgagaaaaaaagatgcagaaccaaataagtcgcacaaacagattaattacaaaatgtttttgcaatttcaattcttcaaagaggaaaggaacttgttttctcaccgagcccaagaacagctaggatcaacatcgtggcagcaacaacaatcaaaatcttccttctgcaaacagaacaaccgaaataaaagaatttctatgaacatcatcaaggaaaatacttgttatgaacactcataacagcagtatctatactttctatataattggtacccactaactcctaaaactcaacatacaagtgtgtggtatgccacatcatcatccactagcaattactattatttagagtattttagatctcatacaaatatgatatatcatttgtaatttagttgtatttttaaaacttaacacgcaagcaatgtcaaatcaccatcttcacattattta

SEQ ID NO: 43166 - DNA, 1501 bp, Oryza sativa
cagtacgtcaggtttttgaaaatcgctaattaatccctatgcctaattcccatttatgcacaatttagattctagaggtctttatgatcgatttagcccctcttctgatctcatcatggtttaggattattatatgggactattgtacgctaattaatcccccatgcctaattcccatttatgcacaatttagattctagaggtctttatgatcgattttagcccctcttctgatctcatcatggtttgggattattagatggctctaccgctaggactttggaaatctgtccgacagaaatgtatatgatcaagttggttactggctcactgctaaggctgcgttcgtaaaacggaacaactcattaacatgattaattaaatatgttagttaaaaagatttaaaaaatcaattaatatgatttttataattttctttaaaagaattagcaagcgtggttatataaaacaagtgagtagaagatgagaggaaggagtatcgagcacagaccgttcttccaattagagtttgggactatggggtttgggttttggtcaatttgacatgcttcggatgcattaatgctggaattatctttagttaataatattatgtgcaaccccccttcccctttttgtgtatttatttccctgtttaaatctctggagctgttctacaggtgatgccttacagcactggcatgaaaacaccattgtcgaactttgaggcaggacagcaccgccaggtcaattgttgttttctctcctctgcacgcccttgtttgacctgctctgttagttgacctgatgtttaattttgatgatgttgtagtttgttccggccgaaacagccatggtgtccttccctgttgttggtgatgtggacaatgcagctcttgttgcatggacaacaacaccctggacgctacctagcaacctagcactctgtcaatgcaaaatttgtttatgccaaggtttatagcgtatttaaatatttttattgctgtgtttgttaatagtacagtctgcatgtatggagtaatttgttggtgattttgggtacgtgaaaaatagtcctgaactacacctaaagcagacagaccatagaaaatggtggacatttgcaatttttttcctgtcatctggtgaacagctggggttatctggacttttaaactaattcacataactcaaaattaattcaagaccaaggctttactcttgccatgcattttgtaattgtttcatttgccacttctgggtacttttactaattgcctacctattctagagtcatgacagaaaacaattactagaattttcaaagatctgctgatctgcagctaatatgcctctgctttcactgcaacttcagattacccttatgtaaactcatactgcatttttttttatctcagatatatatagctgatacttcgattgctttgtaacttacacttgttttatttctgactgtgacttgctctgtttttttaattta

SEQ ID NO: 43167 - DNA, 406 bp, Oryza sativa
cctcacaaggtgaggttacctttgcctcctgtcgtattgttgttattgctcgctgtgataaaattctggttaggaatttatttgtggtatgtgagagcggtttgtttcagaacaattgtcgcttcaggtattgccgtcgaaactcacacttgcagtatttctgccatttgtttagtaattgtgaacaagtaatgttgttgttaactgatagtttcagtgaaatattagattcgtttgtaaagttcattatgaattgcatcacgtgtattattgattttgttgagattggcaggagttgatacatgaaaagctcatgcatgtttcttaatttaccggacactgattcaaagaaatttgtattttacttcaccattgctaatgcccacttatgtttttcttctctagt

SEQ ID NO: 43168 - DNA, 990 bp, Oryza sativa
ttcttctcctaaaaagaaaatcatttttgaaaaaaaaaagggaagagggaaaggcatggttatgaaaataataaagttatgctctctcaagtatgagcatgatatgggaaaaaaaagaaaaaaaagataataatgtagccatgccctctccttattaataaaaagaaggatttttgggagaagaaagtaagcacaaaggagaagcgttttctttatttttcttcacatttcatttccaccatatatcacacacacactttgcacgatcttgatcttaagtatgtttagtcatctattttagtctaagtttttgacttagtaataaacgtgaatgcaagtatgccatgtttgatccctactgagctccacatatcaaaccttagagtaggaatctaaaagggcaaaaaggtgaggaattcatattgatacacttggagagactgagtgaatcatttgaggaacttggatttcttttgtaaaatcatttgaaaacttctggaataaaagttgaataaaaattgggtgattagtgctctaattgttgttctatctttcaaccgctcaaggcaaggaaaggcagtgtcttgtgggaattaggggtaagggtaagccaccatgccaaatattatttaatttgagagagagtacatataccttgcacctgtacatttgagatatacagcatagtagcaattcctgatcaacaaccaagtctttgtttccgttcgtcctttacttgggacgagcaaaggttcaagcttggggggtttttgttgatggacgttagcgatcagtttcgaccgtcaatactaccaaattagaggagaaatagttatgcttgtaatgcatatttgtgttagaataataatattccactggtaataggtttactgaccttttgcagagaataaccacagagtggaggagaatcgacatcaaatcagacgatcaatcaatcggacaatgtcgaggatcagacttatgtatgaa

SEQ ID NO: 43169 - DNA, 1501 bp, Oryza sativa
actttcgattcgtgcataccgaagatgcacacagtctaagagagatatagggagatgaaattatagagacctttgatgctttgcggatggtgtaagggagaggtaggagacattaggcgtcgatggattccatgggaaccggctcctctgactaaatgctccaacgtcatagacgaacaataacctgagtcacgcactacagtgcaaaactgttcctccgacatagtattgtagcacttaatctcgtatacatagtatacatacattctagttatctgatacactagctaatatcctctatccgatgccctcctggtacttcgagaagccacccctgattgccgagttccttacgacagcccgtcatgacaatacaaccggggctaaatacggaggaataccctccccagaaaattaacttgggatcatatacaggcacggaggaatacccgtactgagctgtcaccatcagcggcccacctctcatccgcagcatataaccctaaataatgatatcccgtaatctagacaccacgtctaaactaccagatactactctaatatcatcgtcatgacatagagtaattgcataagcaaaaattatacccgcaccaaagcatctcccagataagttagccgtatatccagtataacatgaacataatgtaaagtaggcattcatatactcgaaaagtatttcaataccataaatgtctacagaagagtattctaaaaaaagtacaaagcttacaaaagaggaaaggaaagctactagagcgatacccgaactcttccgaaggcttccggactcctgatttctactctattcctattccaccagctagatactactaaactaaacttgagagaaatgagagagctcttgcttgatgtgtctgagtgaagtgagaagaggagctccttttatagctgagttatgacggttgtgacggttggaatggtcggtaataccctccaaccttcattggggcttcatctcaaccgtccagccaaaacatggatccaacgaaggcgagggaggttcggccgaaccatgggtcggcccaaccaacccagctttcagctggcggcctcctccattgctcctttatgtagacttgtgatttttggctcaaatcatcgtgtcaattctgagttcttggcccattcatacatatgtctaattctcgacattgtccgattgatttatcgtctgtgttgatgtcgattctcgtcgactttagtgttattctctgcaaaaggttaattagtatacctaacactagtggaatattattgttctaacatatttatgcattgcaagcatcactagttctccactattttggtcaaactagtatcaggatcatagcaactcttatttactatgtcatatatcgcaacaacctagacttagattggcaagtacagcccatttacctcaagttctcagataattgttggctacttatatttaacctttgagagagcacttaccatg

SEQ ID NO: 43170 - DNA, 411 bp, Oryza sativa
aacaccagcacctgcagtttcagactgtggacattccatcacttttggcattacaacttacaaccaaatgtgtcaacaccgtcatcgattacatataattcttgcacctgctaatactggctttggaagacctcatcctgagtagtagcatatatttgcaatacttctgttaatggtgttgcttttgcttcggtgaactccacagctaattatgctggcactggtgtttggcctccacattttttattttctttgctagaaattgattgtttaataaaaataaaaaaattacaattgatgccttttgtctttaccatgtatatctacttgttatgttcttttttgtatcgccttcaaataccagtttcaatatgtattcaaatgaaataaatttcctttttgtggggccca

SEQ ID NO: 43171 - DNA, 1501 bp, Oryza sativa
attcgtactaagtgctctagtaataggactctagataaagaaggaagttcttgtacaagtattagagtagtaattaataacttagacgtggtgtctaggttaaagattacatttgtttgttgtgtatcccacggatttgtcagagatggacggcaggtggtgaggggatcctctagagtcgcgtccaggtatcctccacgttcggatacatcatagagctatagccggaaccacgttggcagaccagcaggggtcgttgcccgaagcaatacataggaaattatctttacttagcgtagataattaaaacacatagaaagtcttctctagcctagcctacctatcatctgttgttgtccttggataatcttagccttaggtagattacacacgttccctgacttcgatatcctttaggagtcacccgaaggtgaagtgctacagcggtattccgtgcgcttgcggatttatctgtggtcataagaaataccaacacccttgacatgcagacgagggagatctagtacgacctcacagaatacatggctcaaatgcaagaatggcaacagactgctgatgctcaattcgccaacttcaacaacatgatgcagcaacagcacgatgaccttcaagcgtacttccgctttcaggggttcaattcttatcaaggaccctgagcgaatgccaagcttggggggagagatgtctctccccccactgagataacttgtatcacattggatatttccctttccaattgcatatttgctttcaaattgcatcttataaaacttgaaaacaatataaaaatttgcaaaatagaaaataccaaaaagataggataggtttgggtcatgctaggtaagacaagctagttctcttcgttgaaatgatgaatagttgctctgttttatatctcttatatatgggttcatggtaagtgctctctcaaaggttaaatataagtagccaacaattatctgagaacttgaggtaaatgggctgtacttgccaatctaagtctaggttgttgcgatatatgacatagtaaataagagttgctatgatcctgatactagtttgaccaaaatagtggagaactagtgatgcttgcaatgcataaatatgttagaacaataatattccactagtgttaggtatactaattaaccttttgcagagaataacactaaagtcgacgagaatcgacatcaacacagacgataaatcaatcggacaatgtcgagaattagacatatgtatgaatgggccaagaactcagaattgacacgatgatttgagccaaaaatcacaagtctacataaaggagcaatggaggaggccgccagctgaaagctgggttggttgggccgacccatggttcggccgaacctccctcgccttcgttggatccatgttttggctggacggttgagatgaagccccaatgaaggttggagggtattaccgaccattccaaccgtcacaaccgtcataactc

SEQ ID NO: 43172 - DNA, 1210 bp, Oryza sativa
aatagcctgatgtaaaaggggaaaaacggaagagtagtaatacaccaaggaaatggaagtcttaagaagaagaaatatcaatatgttcataatttgttggcatcattcactaaatcatagaaaaggcataaaatatttgtggggtggggtgcagtgaggggaataaaatccaggaaatttgagaaatttggatgcagaaaactgctgtgtttaaggttcaaatcttaggatgaagcatgaaactcaatgtttcaaaaataccacagtagtacctacaactattaatttaaaagagattatagttctaacaaggtgcggaatataagaacacctatttcactttttggtgaatcatcctagaaaatgatgtatcaagtgagaactagattctaaagcagcacagtttggacattcgatctcgtctgacttagtggaacttcggtactcagcattgagaagtctgagagagaatatgttgagtacagaagattcaaaaatgtaaggtgcaaagttgttcctttttttttagcagagaaatttctctattctacatatctaactgagatatctgacatctaataagatctcagattgtgagtccataagctcttattttagatgaattctgacgtgataaaccataaattgttcaatgcatagagatattcatattaacccacacattttcctttttaatgaaaacctcataagctgtaatttttggacattcaagtcttagagctagtttatggtctatgctcttcaatttcctctatatagttccagtaaaacagtgcattatcccttttccttacatccctgaaatgaaaaattaagtacccaaaatcaattaagaatttatgcaagcagaaaacagtagtattgtaatgtaactcctatcaagtccatgagcaacactccatcattgacagaagtgtctatgcatagagcatctgaacccaataagtactcagtgtgccctttctcagacagcacagatatatgggtgacacttcacaataggtgaagtcaaccacatgaactactgaaggacagccatgctaatcacctcaaacagtcaaccaaattaagaaatatcatcattttatgtttttggggatgctcggtcaatacagtacaaattaccaaatagtaaaggatgagttgaaacctgatttgtgaagatctccagatatgttgactgcagaca

SEQ ID NO: 43173 - DNA, 1501 bp, Oryza sativa
agggtattaccgaccattccaaccgtcacaaccgtcataactcagctataaaaggagctcctcttctcacttcactcagacacatcaagcaagagctctctcatttctctcaagtttagtttagtagtatctagctggtggaataggaatagagtagaaatcaggagtccggaagccttcggaagagttcgggtatcgctctagtagctttcctttcctcttttgtaagctttgtactttttttagaatactcttctgtagacatttatggtattgaaatacttttcgagtatatgaatgcctactttacattatgttcatgttatactggatatacggctaacttatctgggagatgctttggtgcgggtataatttttgcttatgcaattactctatgtcatgacgatgatattagagtagtatctggtagtttagacgtggtgtctagattacgggatatcattatttagggttatatgctgcggatgagaggtgggccgctgatggtgacagctcagtacgggtattcctccgtgcctgtatatgatcccaagttaattttctggggagggtattcctccgtatttagccccggttgtattgtcatgacgggctgtcgtaaggaactcggcaatcaggggtggcttctcgaagtaccaggagggcatcggatagaggatattagctagtgtatcagataactagaatgtatgtatactatgtatacgagattaagtgctacaatactatgtcggaggaacagttttgcactgtagtgcgtgactcaggttattgttcgtctatgacgttggagcatttagtcagaggagccggttcccatggaatccatcgacgcctaatgtctcctacctctcccttacaccatccgcaaagcatcaaaggtctctataatttcatctccctatatctctcttagactgtgtgcatcttcggtatgcacgaatcgaaagtgttctgaatataattgtatcatcttgatgtaatgtgaaagggcatatagccttctcttaaaaaaaaatcatctctcagtctttctagcctgtactggcgtgctgcacggtcgcctgctcagcacatgcccttatttcgcatccaaaatcaccaagaacgggttcaccaaacacatcccaaagcttcgattcagcggtggccggaactgaggtcttgggacttagtatttggtttccgctgtcctcgatggacctcttcagggcataattcattccatgtctctaatttattgaccgttaacgatattatgcactatatatgtcataactacttcgtgtactgttcacatttatggtgggctgacgaattttgactcttttttttttctaaatcatccttacaaatttagaaaatgtctattaggtactgaaaaaataaaccatccctacaaattttgtaatgcatatcgtaaaaaaattttatatctaatatatatgcacttttgcagccatggatcgaagttaga

SEQ ID NO: 43174 - DNA, 894 bp, Oryza sativa
atatatatatgatattaggagctttaagattcggattggatatgttctctgttttgatgcacgatgcagtgttgaggtgtaacatgttttggtaattcactgtgtataaaatatcggagtatatgtgcgtaagcttttctatactagcaaggcaagcatgcaggcactgtgccttcgatagtatgatgtttatctttatcccttttagcatttctaactttgagtctacatagttcatccgtaacaaatctattacgtgtaactcaagcttaagtccctggattatgataatattaaggggagagaaacttgtaattaagcagctgtatctggcacattctgctggcgatgcaaactggcttctggtgtggtgatggctacggctagacaggccagtgaagcagctgcagcctgcacattcctaatttcctactaattcctaagacaaacgagccttaattattcctagaattggtctaaatcgcaagtagccggcacgcaaagtccaagccatgtgtccatgtagccttgaaggcttgaaccaaacaccaagagcgaaatatttgtctttgcttgatatttttctacggctcgctgtcaacgtcaatgcagctaatcaaagcttgggttggcctaggatagcaggttcaataattaatcgccaaacgacgccaaattacctaggacaatttagttgtgcgtccagctgtaatcgttgcagaaatatcaagaacttgagaatcatttatcgtacgttcatctccaagaatttcgatgttgatcaatcgtagtcatcactggtaacgcatgaatgtgatgaatgaaaacgttcgatgcctacaagaatagaaaaaattttgcgttgtaattcgaactcgcgaaacctccaaaagt

SEQ ID NO: 43175 - DNA, 360 bp, Oryza sativa
attttagaatgaatatagtagtttcgcttgtggttgcactgatccgctgtaaattttcttgtggttgcatgatccgcagctcgattgtaatcccagggatgatcgatcattgccaaactttaagttttggaactttttaattgatttaaggtggctttcttttgtagtagagaggttttatttataaagcatttcttttttatttttaaagttttgtacggtttatcgttaggcatatgtagctccgatcataaagccatacgtacgcacgtacatttctcaaccgtcgatagatgcaagtgttactagcttactagcactggtggagaaaccctttgtagtcccggttcgtaacccccc

SEQ ID NO: 43176 - DNA, 214 bp, Oryza sativa
agggtggtggagaggtcgaggcggcgtcgaggagggcggtggaaaggtcgaggcggcggcaaggagggtggatgatctggatcgagagagagagaggcgaggcggcggtcgagagagtgagtgagtgagagtgggtgccggatctggatcgatctagaagatgtccaaccctaggtcaaccctagtcaaactcacctgtgacgggcgccaacta

SEQ ID NO: 43177 - DNA, 1501 bp, Oryza sativa
tgattaatctgcaagatgagttatgctaaactagaatagcagacactagactaacacggaaaaatagcatgaagatacctgtctcagcttctcagggaccacaatgctttgaatggaaaagtatttactcatcaactatttgctgcactttgaatactgaactcagaactacgaattactaacctggaacatgcatgaagtcaatggttcaatcagccttttaaccaaagtccgcacatgccaaatgagacacaaatttcaacctagagggctaggcccaatgggacagcccataattgcatatagatgatccatagtgtgatggtacgcggcagacacgaacacatgatatttgattaaagccctaccagctgagagtgagatagctttcctgtaaagttacacaacaaaaatgtgaatactcaaacattaattaaatcatattcaagctaaatccgcacctaagataagaaaaataaaatccacgcggaagatgaaaataggacatttgcagtgtgaattcgcctaagccaaagtaactcagtactaagttggtacgttccccaaactgtaagccatcaccccaaaatactacaaagatttcatatatcggtacaatgcatcaaaatttcagcactgaagttgcacctcgcgggaacacaccgccgtagcaaaccccgcatccggcacccgcgagaacgacgatctgtacagtttgcactgcatcccggcgcgacattacgtcgaacacccggcgggcgagcaaccaattctcgaacgctctcaccactggcctctcccctatctccccaccgcgatctcctcgcatcaacctcagagaaagagctgcgccgaaccgtcacgaggcggcggctggggttgccggcggcgggcgccaccggaggagccactacgccgccggtgatcgatcgctcgctcgcttcctcttccgttgcgagttgcgatcgaccatccacggctcggctctgtcactgacaggtgggtcccacaccgtcagcagtaggacataaaagtgaaattttcagaaatcccatgaaacctcaagtatataactggtggcataaatgtatcacaaaaccttatctccatttcggcaaacattactaagatttttaaaatatagattgtatttgaaacttttagttgttgacatcttacttaaggttgttggatcaactcttcccttcttcaacaagcattgtttcagatatgccaaaattaatttaaatttgaaaagggtgaagttttgtactccaaaacatttaaatcataaaacacgtgattatacgccaaaatcatactgacgtgggttttatgtatttgaccataaaacgagatttgatgaaatttactcgacacaaaacaactctagactcttctcgaggaagcaacgcctcccttgggaaaggaagagagagattttctcttcctctcgccgccgccgccgccgccgccgcggcgccggccatggcgacctccg

SEQ ID NO: 43178 - DNA, 525 bp, Oryza sativa
ttgaattcgaccaagattatcaataaatatcaaaggaggcatgataagcagcaggagaggtactacgagcaagaaggtgatggtttcgatcctcattggggttgtgagtttttcaggttttactggaatgaggggatgagactgccatcgatcgaagattgccctggatgtagtaatgacacaggaagttcaagccggtcatacaacagaggtaatcggctgagtcggaagagggttcccgttcatcaaaggttgggcccggtcaatcgagaatactatcaaagtgaggatgaagatagagcaacacaatggtgcccttctggtatttttatgaagaatcagaaaaggagggttcaacgaatggggaacagggagcgtttcaggaagtggagcaagaaatcaaccatcggctgaagaaagcgaagcctaagcaagaatggcgcgttaagagcaaggttgcaatggccgatgaagttgaagccgacaaagcaaaaaggttggccaaaggacaaagtgttgtaactg

SEQ ID NO: 43179 - DNA, 171 bp, Oryza sativa
ccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcac

SEQ ID NO: 43180 - DNA, 1335 bp, Oryza sativa
ggtgctgctgtatagatgaattaaatgtgatttgttgtctgtggatgttttggatgaatgtaggggctagattttatatacttgattttggtgcagtgaatcttgaatgtggatttaagtgcaactgttgctgtctatgtttgcccttgctgtctatgtttgcccatgctgctgcctatggttgcaactgttagttaagtgcaacttgaatgtggatttaagtgtcatttggacatataaccattcatggagtgtgtactgctatatatgttgctagacctattgaattttgtggatcatgtttacatttagctgaaaaaggataggtcagtgtagtccatggacggaaccgacctagacaccaaagttctccatgcattttgttttctgtcattctttgatgatttatatacccttgctgctgctgcccaatgtgttccttattaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattgagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattgagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtacgaaatttataatctttttcgcgaaagttaaacca

SEQ ID NO: 43181 - DNA, 212 bp, Oryza sativa
cgaacaagccctggatgaagaggaaattggagaagatgttgatcaagctgcagccgagctaagtgacctaggagaaaaaacaccatcggctccacctaaaaagacgcctccaactcctgcagctccaactcactttacaagggtaacttatcctgacaagctcttaaaaaatttccatatagccgatcattcattgaacttgtatttgtaga

SEQ ID NO: 43182 - DNA, 1501 bp, Oryza sativa
gaagattttggtgtctagctcgtgcctgccgtcaagcgcctgtggtcgtcgccctagtcttccgctgtttctcgtttgtctttgtgtgtgctgggccttcgctgcccatgtaataaattaactttttacgcttccgcttgttgaactctgaactgtattaacttttggtgtaccttgcctcctgggacaaggaataatgcacgcacgtaaggaacgcccgttgggttatttccggtcgtgacaagttggtatcagagccaggttgaccctaggacgagccttagatcccaagccttagcaatattttcaaaactaaaaatcctgtcttaattgtgaaaaccctctagtctctctctgtcctgctgcttcatttatcgccaaaatctgacttttaaatgttgcttttctttttgtttttgtttgtagatggccggcagcatcagccgtcgtggtctggacctgattggtttcgtcttggagctgcggggcatgtgcgttgtcctggggtatccgcatggagtggactaccagggcaggccgctcccggagcaggagggtgacgatgcagagccccacgctgcttgggaggttactgcagtgatcctcactggctcacccgagaggacttcattggcagtcaccgcgggtggagattctttctccgccgcttgccagaatgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcaagaacaacatgaagatcctggagctgcgtcaggagaatctgcagctgaagaaggacctagacgcagtggaggcgcagctgcatcagctcaagatcgcctagggagaggtctgtcgccccaagcgtcgccgcgtctgccgcagccagaagatcaccgcccgcaagagcacctccaggcccaagcttgttcgtcagtccctggcgtggacttgcttcgttgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaacttgaactttaatgaaccaatttaatagcagtaataaattcaagaattatggtagtcgtgggtggttagctttaattgtcagctctctctgtttgctggttctgtgtggggttttcagatggtgacgaccagga

SEQ ID NO: 43183 - DNA, 1501 bp, Oryza sativa
ttgtactattacgtacgtacacttggccctatgctttagtacatacatactccatgtcacaacaaacaaacaaacaaacaaacaaaaggatcgatcgagcaacatgcctgcctgccaacatgtgcatagtaactactcctcgtccacaaatattggaagcaaactgacacccatcgctcttttcgcttctacaagtttcctccagaagatcgttcattcagtgattcagacacgagacaagcaatcacgaagcagcgccctgcacttgtctcatcgctcaaactcctccagagaatgtcgcccacgctacctgtatccgtgtatactcctataacaaattagtactaaaatccttctattttggaacataataatgtaataactgctcgcgactttgcaatttttcttcttaccgtcaactctatctctccctctcaaaacataaatattttttcttttttgttttgaagaaaacatataccattttgttttctatgttaagtaaacaagcgacgcgatcgagctatccgtcaagattgatcatatcaaattttctccaaggtcgatcctttagtacagcaccgtatacatacacgtatcacactgtaccgctgttgcgccgcgcatacattttcgggtcaaatttcagtttgttttgaactcaaagccttatatagaattcacaggcaatgaacaagatcggttccatggtgtagtggttagcactccagactttgaatctggcgacctgggttcgaatcccggtgggaccttttttttcactattctttttcaatattttattaagctatctcactatctctttgcttcattttcatgttcgtgtcacgttcagtatttagaatggaagtatgatgcacggaatcgaagggccaaaaaacctccaatcctccatgcatgttatgtgttaaaacgagaccaaatgcagtctctctttagtaaacgatctgatcatgaatttctccattgcacgaagggttttcttacttttcccaatgctcaaggtaaaatgctaaatggtgaaatttaactccaaagcttgttaataaaccgtgtagatcgacatccttctgtcatccccgaatagtacgggctgctggatttacataaggtcttgtgtagttcctaattttttttccgaaaaacgtcacatcgactctatgaatatatgtttgaagcattaaataatgataaaataaaaaactaattgcacagttcgtatggaaatcgcgagacgaatcttttgagcctaattagtccatgattagccataagtgctatagtaacctacatgtgctaatgacatattaattaggcttaataaattcgtctcgcggtttccagggttacaaaattagttttttcattcgtgtccgaaaaccccttccgacatccagtcaaacgtccgatataatgtgacacccaaattttctttttttgaactaaacaaggcctaaatattcgcacagtaaacacagtg

SEQ ID NO: 43184 - DNA, 963 bp, Oryza sativa
cctagttattttcttcaactcgaaacttcaacttcttatttttcattagcatgtttttcaaattattaaatgttatagcatagaagcttataatagttaaattttaattattcatatactaataagccttctcatcctgcatgcgttaaaatctccatacgaacctatggaaagaatgcggccttaattaaggtgctctctctaactgagatgaatattgcactgatctaatgggttcaaacaaatttacaaattgtacgcccaataattaagttggtagtggttagtaagaaaataataaaactgtatattgattctccctactgagagagagagcttcgtataagttggtcaagaatagtcccataaaaaagataaatcggtatagtggtattaatatacgtatcttaattttgttttttctcaaaaacatagtataaacgtaaacattcacaacgtgtgactccgataaacgcccacacacacattatactctaatattagtatattaaagatgagcacgcacataattggtgttgcctgtgtatatccagctcgatggagatgattggagtactgggtagtagctggctggccagggaggccgaccggaccaactgcatatgcagcatgcttttcattcttgatgatatgacaggctcagcatgtatagcattataattagaggaaagcgaaaagggaaatggccgaatttcgcagcatgattgggtccaagcatacgtccaccacccatctattctcatactcctgctgccgcgctgtgttgttggacaatgctgttggttttatatattccgctgtgtgtgtgtgggtgggttcatgtatgtacacgctgcaattctgcaagagcaacgcaacaaaaagaaactcggagcaaaagcagcctctcttttggcaaaaggctttcttgctttgctttgctttgctcgtaatactgacaga

SEQ ID NO: 43185 - DNA, 1501 bp, Oryza sativa
gcaatccatcccatctcccccctatatggtcacgtacgtcgtcttttaattaagtgccatccatgcataagtccatatctgactttggcaaatgcaagtgcagatgcaatcatggctaagctctccatctttgtatttagtagtagtagttgttacctttgagttcattgtcatatatctttggaaaatatgtcttctttgcatacatatgtgtgtacaaaagtcaactagtgggctttttctctctcttttttcggagctagactttaaaaataggatttggtgcgatataccactcccaacttcttgttcctgaaatacaattgtttttttatttaaaagtacaactaggtttgatatacaactcttaggaatccttcggaacacatgattttcaaaacacaggaatacgaataatataatatcggaatgtcatgccttgtaaatcctacaagaaatagaaatacaacatttttcaaaaacaaccgtttggatgtcgcatagaaaaaaaacataggaattgaagacaccagaagagggaaaaaaacacattccataagattttcaaaggaattttgaaggttctatccttaggattcaaattttctaaaaatcctccacttttcctgtgttccaaatgagtccttaacttctatccatagatacaaatgcattttgtattcaactaaattgattaatgcacatcaactcactacgattttgcagtgtaaatattatttgttttcttcaatcaatatggaaatttgtaggctcggaggaaatattgtaaattccttttgaccttagtatttaatgtccttcttagctcaacattttcttaaaggtattttgaaatttcgattttttataattaattgtaggtgtttttttaacttgtcttcttagaaaatgaaacacctaaaactataaaagtaataatcaaactagataattaaaaatcagctacaactctcccaaggatatatggggcttaatttagagagagatggaataagtccactttgaatcacttaactagtggtctaatcactacattctagatatctccaacgaagaatatactacgatgaaggatgtgaagcagattcggcaactaggttagtgagtcaaagtggacttattccgagagagaaacaaggttagggagtcacagtggacttattccgagagagaaacagaggtagcgtatgggccggtgacatatggtccgaaagcggtgggtagtaggtgggcctggcctggaagggttacgcgtccagtccagacgtaaggaacccttgctgatcgatcgtctccaacccaacaacaacaagaaacaggaatttcgatttctttttcttcccttctggaggcgtcctgccctgcgttcaccccccgaaatccctctcgattcgccgccgccaccgcctcctccgctccgccgccgctagggtgttctccggcaaccctaaccctaaccctaacctatcttcgccgccgc

SEQ ID NO: 43186 - DNA, 1501 bp, Oryza sativa
atgtcatctgtgtatgagttggttctaagttcgttcgcttttagaaatatacaatatacgtatttgagtcggtttttaagtttgttttagaaatgcatatccgtataagaaatctttttacaaaaactcgcatgctaacttgagatgaacaaactcctaactacagctcatgattttctaaaagtatatatatccaagtgaattctcacagtaaatttcaccttaactaaatcatataacaacagccttcactcgttgcaacgcacgatcattttttctagcaagctaatagtaatcggttgggggccatcacatcctaaaacacgtcagggagaacaaggattcctaacacccccggttgtgtctgttccccgcaatgtaccgatgtatggatgtagtttctctgaatgactcgtatacttcagacttcagagacgcaaccagtcacttggtcacacattgctgtgacctggtatgatgttttttttttctaaatatttcaatcctgcagaaagagacaataagaaaccttgtgaagttttggtatattgcagcaagcaatgcccttgctcatttcagtggctaattgtgaatgatttctctcagaatttttcactcttcttttgttgccagtattttcagtcccttgcaacaaagactgaccgccacagaaaaagttcagaacataaacttcacttgtttttatcagagggaacaacaacattctcaagagaacactaccaaaaaaaaatgaattcagaaaattcagacattctcttctcagcagaaggcacgatgtacaattacaaaaaggatagtggagcagcgtagagaactaattatccaagtcgccgatccttgaaggtgattgcgcagcggagagcgatcgaggagaacctagggccttgggggttcggagttttcttctccgacccctcccacaaacaaaaacaaactgttgaatcaaaacatatgtccaagatccaacatttctcgatccttctttattgccggcactcgaccgacctcaccgccgttgtcctctacgacgtacggcgacatggccatgatcagctgctgaaattctaaagtactccctccgtacttaaaaatcgaatctaagactggatgtgatatattctagtacaacgactctggacaaatatatgttgagaggaaggaatcttttacaacctgcatttaaatcccttgcactaagggcctgtttagatctcattctaaaattttacaccatgtcacatcgaacgtttgaacacatgtataaagtattaaatacatgctaaaaaaataactagtttcacatattgcgactacttcgcgagatgaatcttttaagtctaattgctccatgatttaacaatgtggtgctacaataaatatgtgttaatgacagactaattagacaataaattcgtctcacggtttactgacggatattgtaattagtttttttgttagtgcccgaacaccccatacgaca

SEQ ID NO: 43187 - DNA, 211 bp, Oryza sativa
ctcaaatgttttttgttgttatataacttttggagctatgtttcacacatttttatttgtctccaaattttgttgtaagttatgagagagaaaatttgtgtggggaagaagaatatatagaaattttattctcatagtttaaaatatgatgaaaattaatcttaaaaaatagaaaccaacctaaatttaaaattaagagaagtacaacata

SEQ ID NO: 43188 - DNA, 760 bp, Oryza sativa
gtctggatgtttagcatgcaactgtctaaattcaacagacgtaccttcagccgataacttaagagcggctggcaggacgctattggaatcacctaccgcagccgattccaggcacagctcgttcaaactctttatagcagaatctatatcatctccagatgcctcaagagctctttcaagtaactgtaatcatgcggaaactcatcatcaaacagctaaaaatataaacaccacatagctgtgatggaaacaccctttagttgcaaaaaatgtacatgacgaatgcgatccaatccagtttcttacagtatatgcatgctcaattgaagatagcaaaaggtgctgacaaaaaaaaacacatttgccgtatttgttgattacacattcacacttacattcctgaatactgtaaaattagtgaaaacatggccagccatcagatcatcggagatcggacggacatgatatattagtagcacttcgattcctaaaggttggttgcaaaaatggataggccattgctatctaactattgttcaacatttctgcagcatcatagttggtagtagctattagctattgcatccttagctccaggcaccagagaatttaacccaacaagccacataatttactggacggagattcacctcttcgcatccaattgcaaactcccacaaaaaaaaatcgaaataatagcgatataagtagagctcggaggcgaacctggggatccatgtgggggaagagggagaggaga

SEQ ID NO: 43189 - DNA, 392 bp, Oryza sativa
gaattcgagctcggtacccacatgctctagcgcatgtgctgtacatgcaccccgagacgagccttggccttcgtgaataggaagcaatgaacctaaccagaatccaccaaggattgtggtgtggcaatcgaatctcgagcagcatgcttttcccattcgaagatagaccaaaatggggggagggggggggggagggtcaccacttgcttatttactctgctttggactgagtttaggcttatgtaggtgcctgggatttgaaggacgagagtgtacatatggtgaaaatagacgaactatagctaaaaatacggatttagttcggagggaggtgggaggggggttcacgacagtggtcgctgccaccgtgctgctgattccccggtcacagc

SEQ ID NO: 43190 - DNA, 462 bp, Oryza sativa
acaatattgatcctatggagagtatgccagtacattgaaatcaagtctatcggccttgagaatataactatagaagcacgctactcttctattggtaaaccaaatcaatttacctaataagcaatgatggattagcatacactgattttagcatccgctgagcaaaccagcaaatatacgagttaagtttgggtcctatgcaatctctggcagttcagtactatttcagcgtgatcatgcggggtagagtaatgcaacccacaccgatcgagagcacccagatcggccgagctaagcgctgccgtcgttgcggatgagcaaaagcaaaacagtcactaaatggattggatcaacctccatcccccaaccccaaaccccgagtggagtagagaacaacagattcgtcgccccggaaccggataacggcgtacctggagcagcgggagacgacggagttggcga

SEQ ID NO: 43191 - DNA, 781 bp, Oryza sativa
accaaaatatatgtacttaagtgctaagtatcaaagtgtgtgtggttttatgcaacttggactacaaaacgtgtagttttgtgaaatttactctttatttctggacacttggccattgtgagcatgtgatccctatatatatatagggcctgtttggttggtgacctgagtattgtgcctgagaaaattgcatgcctgagtttcacatgagttttgatgattatgcctgacagaaacttatttgattgctgacccgtgcctaagagatctagaaactatgattatctacattatttattcttaaacactaaattaaccatggattatttattcttcaactttgaatcaaccatagattatttactattaaactctgaattaatcttgttcagccaacactctacttatctaaagcaaacaggtctgaaggaggtcaacagaacacaaacaaataaaggcaacaacctgtagcgttgcaggatggttaattaatgcaataatcactgatcaagcactcatgctaacttgttaaggggagtactgagaatcatatgctagccacaattggatcaacttccatagcttactattgtctattgtagttatctttaatttttaaatacactgacatgatcatgtttctgctttgtttgaccactcttatatgatttaagttgtaatttcttgttatgcctgacaaacttctaacaagtttcttctcaaattaacattttcagggttcttgctcttgcaaccgaaaccttgcagcaaaactttgaag

SEQ ID NO: 43192 - DNA, 1501 bp, Oryza sativa
cggatcgattgagctcgttttggttgaggagggtgtcgagaagggtgatcgcggcaaccgcattctgttgaggggtgcggaaaaccggtgtcccttcgacatcttgctgaccgatgagatcacgcgctcggcgccctgcttccaaagctcgctgacgtcgatcctcagcctccttcgcagtccgctcacggtcctgctgctcgcgccgtagccgttcttgttcttgtgcttgatgctcctcctccagtcagcgacgttcttcggtctcccgggcttggcgttgcacctccgtctcattattggccatgaaaacgccaaagtagagaggggtgtagttgtcatctaggcttccgtcgaagtcgtcgaagtcgttgtagcgagaactaaattcgtcgtactccacgatgtcagtaggacgtgagtcgacggtgggagagctgttgtagtcatccagctgatctgtcgaaaccgtgccgagtggttggaggatgacgccgacttccctgaagctaggcgaaatcggtgttgaagccgacttccgcctaggcctacaggatgaagacgctgtcgtggtgaagacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatctggttctctcccgactggtctgattccgagtcgaggagagaaatcttgccgaagttgttggtgatgaagtcgaggctgccgaaccgaaacgtctgcccgggtgggaagacgaggtcgtcgatgccggagatggaacccattgcactgatcggcgaaaagcttgacgctacccctacctggcgcgccaactgtcgaaactagatttcggcaataataaaagggggtggctatcaagctaggaaagtgtatgggtttgaagacaaagggtttatacaggttcaggccttcttataaaagaagtaataccctactcctgtccggggatgaatccgccgagtgtgttattgattgtatgatttagagaaaatcaacatccgcccctagaggcgcccggaccccccttatatatgggaaggagtccgtgttacaaaagataatctatatccctaacggaatatgcaaatacagatgaaatatagtcgtaaccgactaagtctcagggtgtttccttgatacacaagttaagaaacaaacccgagatacagataagatattctatctacattaggtatcctgtacccagtccaaataccgtcgccgtgtagatatgggatatccataatctccacacttcctttctcaatcttcgattctaccttcttcgcagcatcttgcccatcaaattgctgtcccaagcattgccgataatcttcagcttttccttggtccaatcggtaacttagacccca

SEQ ID NO: 43193 - DNA, 379 bp, Oryza sativa
tggtggtgattggtgaagagtgatgactcaaagctttaaagtaaatgaggatggcagcattcacagtgaatggaagtagttggaggcggaagtggcgatggtgatttgggagtagaggaggacaacgacggtccagacgtgtgagggtagatgagtatgcagggttatggttaggctatgatagtttaaaagaaaatttcttaccatataaaacaggaaccatgagatgctgagcagcggtacaagatttggagcacagcaaactggtttgacaaacttgggacaacatatttgaagtagtcaatcctagcaacttgatcgtatcctcctcgcatgaatgttttctcctcgcactcactcgctaatcaatgccacaaca

SEQ ID NO: 43194 - DNA, 815 bp, Oryza sativa
ttgagaaaataagtaataattgcgcaataattcgtgaataattctagaaattcatataaatggctcaaaacttctaaaattcatatctaattcattcgaactccgaattgagccattcaacttgcaaaattcatttaaaattgagctctacatgtttgtttagtttttatgtactgtttccttggtttttattagagttttcctcgttttgcgcgccagcgtgtagaatccgttgtttcggaagttcgcgttcgcaaggataagagttcagaagatccaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatttgttctttgtcaaccttgggtaatgaatcgactagctcatgttacttatgtgaactagctagaactatatgcttagccatgcttaattaccactagctcagttgatgggataattacagtattagaccttttagtatcggaatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 43195 - DNA, 1501 bp, Oryza sativa
actcctttctctctgttattggattggttcttcttcctgtcgaaactagatttcggcaataataaaagggggtggctatcaagctaggaaagtgtatgggtttgaagacaaagggtttatacaggttcaggccttcttataaaagaagtaataccctactcctgtccggggatgaatccgccgagtgtgttattgattgtatgatttagagaaaatcaacatccgcccctagaggcgcccggaccccccttatatatgggaaggagtccgtgttacaaaagataatctatatccctaacggaatatgcaaatacagatgaaatatagtcgtaaccgactaagtctcagggtgtttccttgatacacaagttaagaaacaaacccgagatacagataagatattctatctacattaggtatcctgtacccagtccaaataccgtcgccgtgtagatatgggatatccataatctccacagtagcccccgagacctttgcagtcaaccatcagagccttctcaaagataataatccgagtgcttcaaaacttatcatgccaaggcctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgccagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttctgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaataaatcccgagatccaagcgacgcttcgtcttccccgccggaactctcgccattttccccactccttgctacagtgcagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcga

SEQ ID NO: 43196 - DNA, 766 bp, Oryza sativa
accctagtccacatcattttgtcatgatttccccctttgtagtattgtggcggtacttcagggcatggtttcatgtgcggaatcgtgtcttgtgggtaaagttgtagacctctgatcagagtaaaactattcaaattgccgtgcccgtggttattgtgcggtcaaccagctcacaatagatagcgatgattcgggttgtcgaatatctgggcgcgacaagttgatatcagagctgatcttgaccgtaggacaaaccaaacggaaaacacatagagccctctgaaattctcttcttcccctggaaatctcttattcccacattttgaagtggtccagtgagtctaaatatatgagtctgttttcttttgagtttctgagtttcgtcaaaaaatatatattttttctttgtgcctttttgattttcaaagaaaatgtgttttcggctattttttaaaaaaaacatttcggcaaaaaaaatgtttcggttaaaaaaagggggatttttcagcggaaaaaaaagagaggttttggtatttttttaaaaaaagagttttggtatttaaaaaaatttggctgaaaatagtattttaaaaaatatatttatatattgctttagtcttttgatttcagtttagtgctttttcttcctttttgcttctagttttaatgccagcatctcatttctgattggagtcagctttgttccttctatcttctctttagatggctgatttcccccctattcaccgtgctgagctcgcaaata

SEQ ID NO: 43197 - DNA, 1069 bp, Oryza sativa
atgcagacaactgaaatggtcgcagtggcatttcttgctgcatctgcatttcttatctttgtaccttggagacatctgctcctgattgcagtcctggaggtgtacacaagagagatgccgctaaggaaacagaacactgaaaagttccgccggcggattagagagtggtgggcccgcattccagccgctcctgtgcagatgatcaaacccaacgaaagcaagaaaaagagatgacaatgtgctccgtgctgttgcaaagagctcacaattttccctgtttcccattcctatttttcacctgaccagctaacctgtacatatctcaaaccctcttgcctcattgttacagagatattcttactgatcaaagctagccaaactagtaatcaattcaatgcatagtgccattgctatgagtgtacactgtacaaatatatgatcgaaaacaaattaatgctgtattttctttcgttgattgtgtaactttttgctgtgcatgcaagttcctgagttctgtgaacaaatctgggtgataaacatggacataatcagtttaaaaaggaaaaaaaatgaagttaatcttattgtattgatcatgaattaatgatgcgtccttcagtattgatattacaatccaatcttaagtgataaaaaagtggtgctgctttggttcatctggataggggaacactctggatgctaaattgctggtttccaagtgatctccaggtgctctggagaagccattgcacaatgatgttacagaggctgttttgagtcttcacaatgctggcgggtagcaactgtggtaggtagtgggagttcctacctacccctccctgtcttcctactaatttggtggtgcgcatcatgggttcaaggagcaatccggcggtttgacttctccgtccgcacctactctagcctttgttcagtggtacgaggcgccgcgcgagcctgccggaatggccgcggcgtcgtctccggcggcggccatcacctgccgaggtacgtacgagccccccctcggccgagttactccctgctccgttgcgtggttttgtggtgg

SEQ ID NO: 43198 - DNA, 1501 bp, Oryza sativa
cgtcatagaagtgattgaaccactctccaaagggttcagtcgatagcttggatacagtactgaccgatgctgcttctccaaacgatctgcattggcgtgtattgattacttctccatcatcactggtgatcggctcaaatcttgggaagcttacatcggctaaaggtggtcaattggcaaccagtctagtatgcaagtttagccaagtctgaagtaaccaccatggacctcctgtaccgatcgtttttccagaggctatcttgtcagttgcagtattgagggtttgatatagatagccaagtagatacttggcaagaggaaagtgtttcttttctaccaggttttcagctatcctttgccagtttgcagttggaccacaacttgggccaccgaataagaatttttctaaccacatcatgataaaagctgtgtgttctctttgggttactggcccagttcccatatacttagccatgtagcaactccagcctccaatgcttctggttttgaactcatgggtgagttggttgttgaggctggacaggttagctgatgaggtgatatctaggccagtaatcatggtaacatctagcagagttgcggtcatcagtccttgtgagaataagaaggcattcatagcagtggaccagaagtaggtggatgctgccatcatgggttcatcccttgccatattagctgcagttaatgccaaagcttgggatatgccgatttcgtcccagtgagtggatttgctggccgacatcctcttgtaccaagcaggccaggtggtttcggcatatggccaagatttgaaggtacctttccactggctgagatctgggttagcaaatctgaaggggatccgattagtttcgccgtttataaactcaatggggtctaagttaccgattggaccaaggaaaagctgaagattatcggcaatgcttgggacagcaatttgatgggcaagatgctgcgaagaaggtagaatcgaagattgagaaaggaagtgtggagattatggatatcccatatctacacggcgacggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactccttcccatatataaggggggtccgggcgcctctaggggcggatgttgattttctctaaatcatacaatcaataacacactcggcggattcatccccggacaggagtagggtattacttcttttataagaaggcctgaacctgtataaaccctttgtcttcaaacccatacactttcctagcttgatagccacccccttttattattgccgaaatctagtttcgacagttggcgcgccaggtaggggtagcgtcaagcttttcgccgatcagtgcaa

SEQ ID NO: 43199 - DNA, 1501 bp, Oryza sativa
tgaaactatgaaaaaacagatctgctttgtgattgtgtccagtggctatctgcccatgctgatcctgaacctgagaaatggagttcgatctatatctttccgtagcaatggcttggaagaatttagtattttcctcacccaataatatccatctattcgtgctcctttttttttccaataaagccttttaaactcaagaagcataaggatctgtattttgataatttctctgaagttccattcaaggatggacaagggccgatgctcttctattaggtctaggaaattgattacagcattacaattaaccaaaagggcagttaacttagacaagtttttactccaatgtagcaaacttttcctcaaacactttagcttgaagctaatgcattttgccggatcttcataaccagggtctattgcccatattctgctaacaagctcaaagaatccttccatttcaacccaataattctcaaatttgaaaattggagactttggaatcttggtatcaatttgatctacacagggcacatgatctgatatattcctggtcaatgggtggacagtagtgtttgggaaaaccaaagtccaagctggacttgtaaagatgtcacgcctagaaatttaacctaaatttccagactattttgcgtagtaaatccctgtccaggaccagccagggtacgcaaaacgacaagtaatatacagttccaaacgtaaataaagcgtaaaatacttacggaagagacacttagtcctcacaccgaaacagaacgacagcagcggaaaaaggcgatcctagcggggcttcagctccactccacaggcaaaactcaactggggtctgagccttggtcctctaacttcgtcttcagctcagaagaactacacttctgaaaaggggaaataatagcaaggctgagtacaaccaccgtactcagcaagccacaccaacgatgcagatgtgcaaggggatacaaggatggtttgtggctatttgcataaaggcagttgtaaaacattttattgagcaaaacagtaaaacggttgagtaattaaagtaatattgaatctccactgatcaacgctacaccacgttgaacaggcccaaccaacccacctggactacagtgcattgagtcgatttattaaggtgggactaatcacggtgaatctggtcgaccgcccataaccgcgggcacggctattcgaatagttttactctgatcagaggtgtacaactgtacccacaagacagccccacgacacgtttccgtgcaccgacatgccaccacgacatatcggaaagaggccgtgacaggacccttcgtataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctaga

SEQ ID NO: 43200 - DNA, 1501 bp, Oryza sativa
catgaggaggtccagctgttaacagtgaaatttggtaaagcccgaagttatcatcggcttagagtcaatatcggctttagagtactggaatcagccgattggaggaaacaaccgatgggagtcgtcaaatcgccagcaaccgtgttttcgatggagtcggatcaactaaagggaatttatccagaagagtccgagttcaaggaggatgcggcgtggcaagttatctattaattaggaatagtttgttagttccttttatctttaggaaagtgtgtttagtgtctgataaggactttatgttttccttttatctttaggaaagtttctttcttgtccgacaaggacttgtatcaacccatgggtacaaatatgtacacccggggtctatgtaatctatcaatctcgatcaatacaattcggcgcatcaccaccttttaccttttcaactttattttatcgtccggcgggacttggcacccgacgtggggctgcatcggtgttcaatctccggcgaaggggtaagtccaatgtaccatcggcccaggcaaatgtatcgtttacgtcggcgtcgttcaaggctgcatcattacattcgacctcttggattgctctggtttggatgatatatttgcctacctatttatcatatgtctctgttaatctagtcttagcatatcaatttagctctattggctgcttctcgttttagggtttatgctggtatcggctaaatcgtgttgctagatttgattagcttagacatcttcccccctgaaaactcagtcaacgacttgattgtctagatattatgtttcttttcatacttagtgttgcatcagttaaatttcatctactaagtcatgtttagaaccataatccttagcctgcttttgactgtcaataagggtttcatcggggtttcagctgatcaggtatctatatgttgcatcggcttacaaggattgcatatacatataagttggatttagccgatgacaacaaaggtttcattatttaatcttgtggattttatgacatcggaccttcagccgatgtatgctttaaccttcagatcaatgcttattctatcatatcattattagccgactggtttctactggattatattgtttaattatattgattatcatcagccgattgcctttatatcattatctactttggacatatagctgattgcttaaaccctatcgctatcggctggtatcggcatcggctggaactactccatcagcttgtcagccgatcggctgtttgatctattatttgcatatcttgtcagttgcaggatcaaactgactggcacactcgcatctcactatcctttggacctgcactatagctaagcagatctcccaggccactgtgtgttttttgcatcaacacgagcttggcagtaagcagttccgtctccttgacggtatgcatgcctcactgacgggtctgaagtcgttcctcgctccaatacatattggaaacc

SEQ ID NO: 43201 - DNA, 957 bp, Oryza sativa
tacggccatccgttccgggctccggccgtagcccgcagcccgcacggcaacgcgcgctcgcgtcgatttgacctttaccggtgcctgtctgtccttgcctagccttgatgtgttccacaggggacccggccttctgcattcttgcatgtgccgccgctcttgcagatctgctcaacttcttggaattcttctcctcaatcaagtgccacttgatctcttgatctcgaacggagatgagtttttgttccttgagtgaaaagatgtttggtttgctcctaaagtttaccaaagattaccacatcttaggttagtcaagtttgaccaagttagcctattatttggtttatagccacacttgtggcaagattacttctcatctatttgggtcccacatgtcatcaactcatcaaagtgtggtacaatttaattttactagctaagttgtggctcgcaagcgtggcataaaaagtacggtgaattgtgacaaacttagtatagcatccacttgtgcatgtaatttcaaaatcaattattttttttaaaaaataatacaataatcatattatatgattgttactacctccatccagaatataacaattcaaatattttctatatatagtatttctatacatctaaagtttatacacctaaaattacccgattcaaatttgaatttgaattcaaatttgaatttgaattcaaatttgaatttgaattcaaattttttatacataaatttttctaactttttattcttttaaaaaaaatttggtgtactgtaataggaagagaagaaggggaggaggaagaggagaagggagcgggggcagggggggtggaccgatcgctgggcgatcgccctggcgatcgatcgtccattaggcccccttggcatgctagtcatcaaattccatctctcttcttccttctctaccctactctctctctccccca

SEQ ID NO: 43202 - DNA, 443 bp, Oryza sativa
gagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctataaaaggtgggcaggaggccctctagggggca

SEQ ID NO: 43203 - DNA, 1501 bp, Oryza sativa
gctccgttccctccaatttgcggtggttgtctgtccctggtaggctcaggttccaaatgccaagagggaaagcttcttttatagggttggtgcccatcttttcacccagaaagatccaaggcgtctcggtggctatctctaattccgcactttggaatttggaatggatggaacagccctcatcttctcatcatgatagagtgctttgcgttaaaaaaaagctctggtggctacctaattttcgcgagggcgtgggtccctcgcatagcttttcgtgtgtcatgcttttttgtatttgtgtgtggagccttttgtgaaagtcgctgtatttatcgagcttgtttagcgcaagtgcatatttattttgtgctctgcatgcagagacggattaggttttcggtgtccggcgaaattcgatcatgagatggtaccataacagaacggcttgaccgcatgagcaggaagaaaatgtgcaagggctggtacagctctgctttgttgcctgcaagccatttggaacgtggaagccgaattgttggtcgaaggtactttatggctaaggcctaagaccaaaatgctagtagtatagttagatcaaaattcaggccacttttataaccaaaaaatctccatggacttctatactctttcccttagtcctgaaatattagatatacaattttattacacggccttcgacattgtcctatacctatcttttggtctctttagaaattacagtgagacggtggtcggatgattgggagtcaaacaccttaggcactgtacggatctaggaattaatcctggtagggtttgatgaaggttcggtgttgttatctctttttatttgttgtctctattaagctccctctgaaagtagtactacctccgttccaaaataagtgcagttttacactattcacgttcaacgtttgaccgtccgtcttatttgaaaattttgtgaaaaaattaaaaacatttagtcacatataaagtactattcatgttttatcatctaatagcaataaaaatactaatcataaaaaattttcaaataagacggacggtcaaacgttaaacatgaatagtgtaaaactacaattattttgggacggagggagtatatttataccttatgtctcgttgtattcgagtactcatagagacattattggtagtctccagtttagtaggagtaatagtctagatgttccgtagcagcgtaggtttttcaaattaggtatagatcttcttatcggatcgaaatatgattcctaacttggaataatcttccaatggacgttaaaggctgtgttctttttgaaaaaaaaattctatacgaaaattgttttaaaaaatcatattaatccattttcttaaaaaaatgttaatacttaattaatcatgcaataatacgtgctttattttacgtgccgggatcctctagaacgcagcctaagtgttttatacgatcgtttaacattttccaatatcgaag

SEQ ID NO: 43204 - DNA, 1501 bp, Oryza sativa
tcccaacatgtgtagtagcttacttagggactgctaaacgctactctgtaattgggtagttataaaagtagttttcgggtatgctatgaaacatgtagtgggatatgaataatcaagatgagatttgcccctactatggagagatatctctgggcccctcgatgatgtagattatggaagtgcatggccatgccaaaggtgattgaggagtcaatcacaagttatataatctatcaacaggttcgagtgaatgattgagctattagaagatggcacatatctagccttgagcttaatcgatatcgtgaggcaaaggggttcatacaagtatacactagaggttcagccgatatgatctttatgtatgcccggtgggtcaatacgttctgataggggccgctgttgacgcgtggaccgaaaaggagttttcgggtcacagccgagtatacatgaacctacagtgtcgcacgcttaatgggccggaataagaggattggatggagatctaatatgagcttaattcggatagggatccgaatagtagtcctacgggccttggaggcccgagtgatggatcctatatattcgtgaggggtatgaccggcggaggtattgcatcacgtgaaaaaccctagccgtcacttccctccccgagcaaaaccctagccgcgcagatgtgctagtgctagcacatctgcgcgtggcgtttcgtccctgtacgtgtggataccggtagaggtgccactgatttgcggtgctgatcggcatgggagtacggcgaagagaacacacgaggtggagaaggtcgagccagtgcgatcgactacttcctctatatcgacgcgcgctaattcgcgagaattccttcgacttcttagcgcctttttccgctgcacagcgcgtcgagtggtaacgatctatgatctaatacttgaatggttcctggtttacgcgatagaaaattttgatttatgctatcgtagcctatgcgtatcccaacaataatcagaatgtattcttcagcatacataaataaaattctctgctttgtcgtgcagtgagtttttgatgctaagtaagatgttcatatgtgcatatatatatatatatatgtgtgtgtgatgttgcagtgacaagcctgggaaccatgacttcaatctactgattgtcgaaacatgaattcggcaataataaaacgggatagcacacgagacctaaaagtggatggatgcggagacaaagggtttagacaggttcaggccctctcgatgagaggtaataccctactcctgtttggggatttgaatccgccgggtgtagtattgatctgacgatcaggttgtgtcatgccccctagagggcctcctgcccaccttttatagggtggggggcaggattacaagatagaaaccttaaccaatacggtatcggtttcctaaatctactttacaatattatcaaaccaggactttaggctgttccgtaatatataaggaaacgt

SEQ ID NO: 43205 - DNA, 1100 bp, Oryza sativa
aggtgcccggttaagggggggagggggaggggaaaaggaaacaaggggagactaggactttcctgaaaaggaaattcaatgcggtgccattttaggaaaagaacagaaacggtcccacgaactaaaacggatacggttcgtcatgcaaaacgaaaccgcggactgataggggagtgaattgagcacaattcacgaccaaaggcaagggaagacattattagcttgacacttttacttagcaacactgcctccgttgttccgatatttactctttaagtcctgttagaaaagctactaagattcctacctattagaaaagctactaagattcctaataagagcatctccaagagtcctataaacatgttcctaaagttaaatttcgtaaaaccccatctattatatatggtccaagttacacaaaaccataagaatcttaatacatgacatataacttcaaaaattatagttctaaaattttagaaaaccgcaccgttaaccatttttatatactcctatattcatatttaaaaaagctttacatacatgcatataaaatttataatggataaaacactcataaagttaattaagatgtgattgtagaactcaaaagtgtggttgatcaaagtcaaaatgatcaataccatggttttctgaaactttatggccagagtatctaaagttacgtgttacatgacaaaaatcgtgtgattttgtacaacttagatcataataatattcatggttaagtgagatttactctataacataagtcaaagacaaagctctctaacaagtaccaaaaccctctcccaatttttaggcacgaccaacagcgctccaataatcatattcagatgagaaatctcttgggcatattggtgcgaactggagctcagtggtgatgacacaggtatagcagttggcctggttagtaatttgaagaaatagcagggcaaaatcagaatttgtctctgataaaaaaaattgcaggtgcacttccacctagttctaatttcttgttgggttggaagaagaaaatagtgcagaaatacaacatttaattaataatatgaagaaaaaccggaagttctgaa

SEQ ID NO: 43206 - DNA, 1501 bp, Oryza sativa
agattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcatcaacgtttctcccaaatcgtagttatcacaactcaccgaaagatcgggccaacaacagccttgagtgtcgagaggaactcagggttcatcactaggtgaaaccccgcgcattgttgtgggaatttagtatgataataataaaaaaataatgtgtaaaatagctagataacatcagattaagtaaattaatgtggtttataataatttaaatttaaatagtatgtagaatggtgattcaaacgtaaaaagtaaggtggtatgacttcatggaagaagaaatgaagggagatagtttggaccttagattaatcatctaaaggataaaaacaattgatgtgatatgacttaattagaggaaacaatgagaaagataatttggaccataaattaatcatttaagcactaactaagtgaggatgaactatataagtataaatgatatcataaaacataataaagatatacattaaaacattatgtgaattatgttgaatgataatttaacatgttcatatttgaaaaagctcttaagttttaaaaactataaagatatggcatgtttgcatgatgtttaaatgtgatggttgttagtagatgatgatgtggcatcttgttaattagtggatgatgatgtgacatcttgttagtggatgatgatatagcatctttgcatgttaagcttaagaatttagtggagaataactttatattaagatatgatacttgtcctcgacttataaaccccccattgctttagcttcaccaactacagccgcaaagcatgcatactgggaatatatttcatgcatgttccacatagagagaattttgtcaagtatttaatgttgtgttataccagcactaaaatcatttaaatagaaccaacaaacttatccatgacttcatcactaacatgatcattatcaagtgctaagtttggcttctaatcatggagaagcaacggcaacagcaacagcaagcaagctaatctactccaggttgtaaagacaagaagtgcttcgatggcacaagcccacacacacctttccttctcttctcttgtacctgggccggttttttttccattaatgacagcaccgcgctctcaataaaaccggccagtcccacgctcccctcctctccgcatccatcagagaagagagaggtagagaagagagagcagagctaagctagctcagagtgagtagcgtgttgagcttgctgaagggagcggcaa

SEQ ID NO: 43207 - DNA, 1501 bp, Oryza sativa
cggtagatttgctcaggatacacaaagaaaatctcacctagtcacatgccaactatcgtaaattaacctcaattcacattgtttacatttcattgaagagcagaactataatattcgtagcaaacatagcagatgatctactcaccaaatcaacaccgtgaaaaaaaaggcatagctaaatatacctgaaacagctatttccataggaaaactaccattgaaacaatactaaatacaaaaggcaaaaaaatctagttgaagttcaatcacggaaagcttttacctatcatacttccacagctccactatacagttttgaatggtgttactgcccaatttccttcctgttccttctacctgacattcagttggataaaaaaactggcagctaacagcagtacaaagggaccaccgagtacctgctctgcttgatacatcagccaaactaccaaaaacatattattttcagacacacaaacatgaaaataaactgggaagttagtacagacaaaatgctgaggggacttagtttcagagatgggtatacctatgttgattcttagtagcatttagcaattttacagcctactcagctgatgctctgcacagacatgtaattcatagccagtttaatactttaattatgacaattgccaataactgaactacattcagattcaatcggagtatggatgatcaatcaaacaaatatatgacagcaaagtatgtttttgcacgttgagcaaaaacacaataaaaattacatgtataagagctaaaatatcgaatttagaatcactaaagcaaagctctcctctagacctttcttttaccttgattgcacagcacacatatagcacaaccgatcaggatagggagccaagaacacaatttttgaagcaaaataatccaaagttagcatccaaatctcccatgcccaactaatgcatatcaataggccatgcatgcgtagttgaaaaattttaagatagtttcagactctgtgctaataggaaaaatagcaaaacaccttaaaggcaaggcaaccaactcacaagcatattctccgtgctcatccaaaggtggccttcgtaaaataatagtagaaatcatatgtttactacttctatgcatactgtctgcaatatacccccaaagcgctgaagcaccttctaatatgtttgagctgaaaacagtcttcaccgttaatccacccatttgatctccaagaagtaagaactactaaatgttctgtgcagagataaatcaatagattattacttgtttggtgaattaatgttgcaacacacagcatggcagtggaagaaaacgcccatgcgagtatgcgacaatgttgtttcccggccaagggccaaccgtgcggttcccaccgatgaattaggcctccatgatttccagtatgtgacccaaatcggttaaattaaaacctgccctgaattggttggtgagttgagagctattcgggggtggcgtgttcgca

SEQ ID NO: 43208 - DNA, 1501 bp, Oryza sativa
gtcttagattcgatttttaagtacggagggagtactttagaatttcagcagctgatcatggccatgtcgccgtacgtcgtagaggacaacggcggtgaggtcggtcgagtgccggcaataaagaaggatcgagaaatgttggatcttggacatatgttttgattcaacagtttgtttttgtttgtgggaggggtcggagaagaaaactccgaacccccaaggccctaggttctcctcgatcgctctccgctgcgcaatcaccttcaaggatcggcgacttggataattagttctctacgctgctccactatcctttttgtaattgtacatcgtgccttctgctgagaagagaatgtctgaattttctgaattcatttttttttggtagtgttctcttgagaatgttgttgttccctctgataaaaacaagtgaagtttatgttctgaactttttctgtggcggtcagtctttgttgcaagggactgaaaatactggcaacaaaagaagagtgaaaaattctgagagaaatcattcacaattagccactgaaatgagcaagggcattgcttgctgcaatataccaaaacttcacaaggtttcttattgtctctttctgcaggattgaaatatttagaaaaaaaaaacatcataccaggtcacagcaatgtgtgaccaagtgactggttgcgtctctgaagtctgaagtatacgagtcattcagagaaactacatccatacatcggtacattgcggggaacagacacaaccgggggtgttaggaatccttgttctccctgacgtgttttaggatgtgatggcccccaaccgattactattagcttgctagaaaaaatgatcgtgcgttgcaacgagtgaaggctgttgttatatgatttagttaaggtgaaatttactgtgagaattcacttggatatatatacttttagaaaatcatgagctgtagttaggagtttgttcatctcaagttagcatgcgagtttttgtaaaaagatttcttatacggatatgcatttctaaaacaaacttaaaaaccgactcaaatacgtatattgtatatttctaaaagcgaacgaacttagaaccaactcatacacagatgacatatcaaaataccggcaaaaacatcttcaatttgttaacagtagagagtagagaagagatagagatactcgtggatgaaaatttagatacttgtggcacgtttttcaaactgctaaacggtgtgtttcgtgcgaaaactttctatatgaaaattgttgtaaaatatcagattaatctattttttaagtttgtaatcattaaaactcaattagttacacgttattattacctcacttggcgtgaaacatttaatttttatcttcatatataggagattcaaacaccaccgtgagggggggggggagtactggtacagcagtaacaggctgggatatgttgggcttttgggccgaagcccaactcgctctccgggtagag

SEQ ID NO: 43209 - DNA, 440 bp, Oryza sativa
actgtagccaaacatgtaggtgaggtccctagctttgctgctattgattcctccatggctcacactctcacactgctgctatatactccgtatactgctacctggctgcagcaaaggtattccacttttagcactatacaacagttgacgtggcctagtggtggtggtggtggagcatagcgccacgtctaccgacgagctagccaccccggccatggacgagcttgtactctccccttcctccttctccgccacggcctgcttcccgacgcttgacttcgagttctgcgaggtccccgaccaatggctgctgggactcggacacgacgagctcgacaaggatgccgccgcctccgccttggcggcggcagcggcctcgcaatcggcgagcaacgacgacgtgcccaggaacccgcccgccacgacgacgacgacgaagc

SEQ ID NO: 43210 - DNA, 1501 bp, Oryza sativa
ccaggcggcagaacgcctcgttggcggtgatggggcaagtcgacggcggaggcggcgatggggcgcgccggccgtcgctggcgcagagggagatgcagatgcagatgctggcgggcggctgtgtgggtggagagcaggagagagactggagagcacctagagctagggttacatggttgatagttgggctgaatggcttaggcctgaatgcctgattgggtttcccagaggaaaaagtacaccgaaggtccctcaacttgtcatccaaaccagaaaaccagatatccacaactaatcaaaaccggtgacaatatgtcctttggtggttttgacaccggttttatcctatgttgcggctgagtcagcgtgggacccacatgttaggctgtgtcatctctctcccccactcttctctttctcggttcctcgtatctctctctctctgcccgtaggatggtcggcgggagaggaggagggcggcgccggcagcagcccgacggagctccacgtcgtaggcggcgggaaggcgcgggacgccacaccatctaagtaagtaactatcacatacgccacaccatcaattcatccattagaatcaaatttacactgagatctctgcaagactgcaacctacgctattttcttatcaagctatgtaactcagggccatagctccaaaaaagcaatgaaaaacataagaacatatcccgagttacatagctggtaagatagtaaaaaaatgtcatgatttcgatgaattgaattatatgcaatggacttggatgaactcgatagatttgcaaagaaagagactgaataacctatacatacatacatacatacatacatacatacatacatacatacatacatacatacatacatacatacatacatacatacatacatacatacatacatacatacatacatacatacatacatacatacatacatacatatacacatacatacatatatatatatatatatgtatgtatgtatatatatatttacatatacatatacatatatgtatatatatacatacatatacatatacatatatatatatacatatacatatatatatatatatatatatacatatatatatatatatatatatacatatatatatatatacatatatatatacatatatatatatatatacatatatatatatatacatgaatatagacatctattaatgaatatgaacttagtgagaatatagacatctattatatatcaaattccaatatagagtgcataggattacaagcatttgcaccaaattggtatagggatattaagtctaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaaga

SEQ ID NO: 43211 - DNA, 308 bp, Oryza sativa
  unsure (1)..(308): unsure at all n locations
ttgtgcacgggtcccccaaaccaattggtgttgncggattggcccgccgttgggtgaacaancggtgcggccggccggagctcnccggaaaccgccggtgcgtgggaccggcgtggggaggggaaagagagcncggctggctcgggtaaggaggggaaaagagagaggatgctccggggttcgttttgatagggtcggagcggcggaaacggggccgagaggggcggcaaccggcgcggaagtggggcgccgacggggggtggtggtggctcggccggcgccggtttttgtgggacgagcggggaaaa

SEQ ID NO: 43212 - DNA, 1501 bp, Oryza sativa
ttgatttaacgagtaaagaaacaattcatcgaccttcctcaggccacactcatgtctcagctaaaattcgactcgggacatctgtgcctgatacgctaatatggtatacaaatcagtgcaactcaaaagtttcgttcatgagataatatgcatttatactctaaccgttccttttatgtgaaacaataaggacaaatgagctttgtgtgaaaacataaggacatatgagccattttacgtactccaatattacacgacatgctcgtggtttgtcggcagtggttctcttatgccctaatgttccttttccaaacattttgccctcatgacatggcacagatacaccgataagttacaaatccacgtaatctataattcaacccttgactttactgtctccaggcctcgatctattccggacatatttctttacgatgcccagaaacgtcttaaaaacacacatgctatgcagatgcattggacctagcatcttaacttgttccacaagatgagcaacaagattcacaatgatattgaaaaatgagagagagaacaacatctcgagctggcaaagagttcgaatctcgtcctcctgaagcttgtccaacgaagctgaatcgataaccttgtgattcatcactttgaagaactaacacaacttgctgattggatctcaggccttatctggaagaatacctttgattgtgagtggtagcagctaaccggatgtgactttgacaccctacagacattctgacgtactcattttttctgcagcactaagagtatagcatgctggagggaggtagtagcggtcatttcctttgtcctgaggatgcagctctttcctgatattcatgtcttcaaggtctcttcgtgcttgcaaactgtccttcgtcttgaccgatgtgttcaacaatactcagagcatgtttttgcacacaatctttccacgtgcatcacatcaactgcgtgacgggagtctttccagtacgatagatagacttctttttccaaagagggctctcaccgcttgatgtggatgcaggtgtgcttccactccctttaccacataaaacttcgagatcattcacctcatcccatatatcactaccgattatgaactttggacgtgctccctcttccaccatcccgtcgaaatcacttgtattttggcggtacggatgattcagcctaaggaacctcggatggtgcatgtacacggtcttccgccagtgattcagccacatgcctcctatttgaatcaggcacctcacacatgctttcatgcccttcactgtttggcccgatgtgttaccaagtgttgtgtagtcctatattgtgttgacggttcttaaatatcatttttgaccgctaactagcacaatgaataaaggaaaaattagcatttcttacatgcgtaccaataataaataatagttgcattaggattggagaattaacttggatgcaggaattatacatcaaagtgaaggagaaa

SEQ ID NO: 43213 - DNA, 1501 bp, Oryza sativa
aactaaacgtagatatttttttaacaactttaaaaaaatgatgcggtaaaaaatgacatcaatataaacatccccttaatcttgctaaaaccaaatttggtacgattcgggcgatctcaaccagtggctgtggagagaacagagaattcaagcagcagtagtacttactgtgagcgggcgaccgtgatctgcgcctcgagcgtcatcaacttcccaatctgctctgctaatcaatacggagtactacactacaccgtcacacaaaagtgcacatgcaaatgcaattcgatttcactgccgcccccggttcttcaatcgtaagctgtccccggctctgccagtcctaggcaattaaggggaagaactgtggcagtactcctccactgggacactactagagctagtgtggcctactcaacctaactagaaaggttatatttttaggttattttttttacggagtgagtgtctttatttaggccatgtttaaatctcatcctaaaatttttcacctcgtcacattgaacatttgaacatatgtatgaagtattaaagataagcttaaaaattaattaattacacatattgcgactagtttgcgagacgaatttgtttttttagataatggaataaatattccggcctttactcattagagctacagccagttattacaaggaatcatacaaacaacgaatgaagttcaaataaaattaaacacacccaacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagatatggtaatagggaggtttaaaccaaaagaaaactgtactattctccaaacaaattttgcataatgacagtcaagaaaaagatgttgaatggtctcattttttatacagaaacaacatcttaaactgccattccagttccgtcttgccaaattgtccttagttagcaccacccctttaagtaagtaccacataaagatcttaatcttaagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaa

SEQ ID NO: 43214 - DNA, 1501 bp, Oryza sativa
aacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagatatggtaatagggaggtttaaaccaaaagaaaactgtactattctccaaacaaattttgcataatgacagtcaagaaaaagatgttgaatggtctcattttttatacagaaacaacatcttaaactgccattccagttccgtcttgccaaattgtccttagttagcaccacccctttaagtaagtaccacataaagatcttaatcttaagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaatgcaggatgccactattgctgaggacgacgtaaaaatagcccaggaatccaagccgcagctctctctcggctcggagcccaagaaattctcgccaatccacacccgccactacaccgtcgcagcgcacccacgtgacacgcagccacagtccatcccccgttgtcccgaatccaacgcccggtcccgctgcatgttcctgcgctcagtccagctacaaccgcagctgaagcagcctacactcgccaacaaaagtactaccacctcacgagatcgatgtttgttctcggactctagtagtcgtaggcgtactccactgacgtgaggagtagtacacggagtgctcattctgtcttaaaataaaatcaatttttaaagtttgatttttgtcttaatttgtatcggaattttgactctgaacgatcacaccctagtttagtttgttcagtgtactgtattatcccaggggagtaggagtagattttagaacattcctgtttcttttagtcgcacagtgcaacgccagctcgcactagggcagcgaagttcagcgcttagtacgactgtactactacgagactactactacgacgacgagtacaccatttcctgtcccacggcattaaccgagcgagacacaggcgttgaaaaagcgttgaaaaaaggtaaaggaggcatcgtttttttatatacgctttcccaagctccgcccggccaccatatcctc

SEQ ID NO: 43215 - DNA, 1268 bp, Oryza sativa
aattaaaatttaaatgaagaaattcgcaaatattcatttaaagagcatataaacttcaaatggccataacttggccatttgaactcggaattggaccgttcaagtctctaatttttccttaagaagtcaaaaacccatttttgtgctttgtttcagcttgttatatggagtttattagagtaaaagccttttcttttctattggtcgtatagacgctgcagcttcggaagatccgctcttcgtggaggttgaagccgacgtttgggaaagcgagcaaggcaagtcacatcatctttgaacatattgaatcccagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatggttttaggctgggctcggggtgtatggttttcatagtagcacctcggccatataaggaccggtcttcgggcctctgttgcaaagcactaccgtacttccacatgtctagtgggtaaggcttagtttgtggctcagtctggttataaacaaaagtacatggatggagatggaagaagtcgggggtcgatggacatctctaggacaaatgaaggctacacgagctgcagcccggtagtcgagatgtcatggcacagggccggtgtcctgctgctaggggctcagtcctgcctacctatcccgggggtccggccgtaggtgggattgggtcggtactcttgtctatggctaggatgggttggaaactatgtcacgtcttccgtctgtttaccgtggtggtatgtggcacgtggttacacgtgaggaagatgtgtcttgtgggtaaagatgtacacctctgatcagagtataacctattcgaatagccgcgccctcggttatgggcaagccgagcaatgtacccaggtaagtgttttaaattcttaaaacctgcttaacaactaaaatggggaatggttggcctgggttggcttgggacgagctggga

SEQ ID NO: 43216 - DNA, 1501 bp, Oryza sativa
attgatttgatcctgcaatcaagaagaaataaagacaaggaaaccgtggttaaatccataaacgatagccgatcggctaatagccgatgacatatcatttatctttgagccgatgtcatatatgcatcgatcggaaatcatgaataaataataaagaactaaatctactcgatcagctatagatattaacagtatacaatcttggtgtcggtatatatttaaatcaagtgattgggatagatcggacgccaagccgagacagtataaatctcttagatcgaaatatatattaacaagaagattatagacatctatagcatagccgatcaggtaaatctagcatgtattggctaatactccgataccactctatattaagatattaaagcaagcaaaatatatcaaacaagaagcttaatatacctaaaagcagtaagatctcaacataaagggcagatctatcatatcaattaagcacataaaatataaggctaaatctggtaagatcggctgaaactccgatgaaaccctaatcggcaaccaaaaacaggctagagattgaagttctaatcacgacttataagatcagacaactgatgcagccaaaagtatgaaaagaaatacaatatctagataatcaagccattgattgtttcataggatggtagataccctatataatctaagccaacattgatatttaacttaatcggctatcttctaacgatagatattagccggttgaaggttaaataataatattgtcaaagattatataaaatatatgataactcgacaacttacataaacaagattagagtatcataatgatggaagcactaatatcgagaacacaagctgccataataacttttacctctagttgaagatcgaaaccgatgcaactcaatctgaaggcaagaactcgtcgaaaccaaatgaaagttaaagggtggcgattcgccgagattgcattgattgtgtgttcgtttattacatggggctcggggtctatttatacccgagattacaaaatatgtccatgtcggacacgactcttatctctaacaaactataatataccataagtctttgcggtagacttttgcccaaacttatctctaaggaaattacatgaaatatcctaactaatagatacaattgcctttccaggactcaatccgtgtgtggcaatccatatgaagcacattaacttaatccgacaacgtgtatcgaatcatattgtcagaatcggcttgatcggctaacctagtccgactcgaactctgtcgattaaggtcgcagccgattcttgctctgtttccagaacgatatttgtcttggattccgcttcgatctaatcttcatatccgatactcagattagcaaatttggttgttaacacatgccccccaagtccggaatatttggtaatgtttcggatttgccatatattgtctccaagagaatatcgcacttgtcgtttttttaccgttactcc

SEQ ID NO: 43217 - DNA, 1306 bp, Oryza sativa
ccgcccgccgctctcggtcccatcccaccgtcgccatcacctgcctccggtggatccgcccgggctggatccgcgacctccggccgtcgagccctctcatggctgctcccgcccacgacatacctcttctgagcccactaccgccgctctcgaccgctctcgcccaccgagggcccaggccacccaccactcgcctctcacctctcactgtcgaccagtgagagagaggagaggagttgagaaaggcagagaggatgatgaatgagagagaggatgtgggtggataagaatgagaaggtgagagatagagatagagggggataaggatgaaaattttcaaagtgttgagacagaaaagatctagagaggagggagcttatttttgcatgcggtcctcctaaacgggcgcatgcgactccttaggaggaccgcatgtgaaaatatgctatatttgcatgtggctagttaagagatccgtttgtgaaaatagtttttttacgtgggtctcttaaaaaactgtatgtgaaaatacgggtctcattcaaataattttgcctacctgttaagttacccttgctcaacaaataaggttatcacctatggaatgcgcttcgttcatgctaggcgtgcgcgcataatggtccaacggcacacatggagatggagtattgggatttgttggttcagatttcagagtaggctattattgggttaacatcagttgctttgtttattatactgtacttatatactctctgttctaaattataacatctatattttttacacaacttataatgatattgtttgaccactaatttatttcatattataccatcaataactacaatattagtgtcacctgaaagtattttaaaatataaatctaattatagaatatatatgatacttggtatatactgtatattgttagtccgaatttgaatttttaaaaaataagtgtttataatttagagccgagggagtacatttaagagtataggaaattttttcagagctcaaattgaacgagctttttgttttaaaaaaatgtagtactccgctactctctttaaaaaaaactcaacttttagagtttaaattttgtcccacgaaaaatcaatgagaagctttatccctttaataccttgatctatttatcactttcactattttttaagtgattaagggtattttagttattctcactgtccactatttttaccttacgatgttagcaatagattttttttttgacgagtgagcagatatatctgcttcattgtttttgcggagactctggaca

SEQ ID NO: 43218 - DNA, 1501 bp, Oryza sativa
gagcattggcatcctcattaggcttgccacagaacgggctagcctacgccatcgtgatgaggctggaattcaagtcgaaattcatgtctcccatgttgatctacggcccaatggccacattgtcagcagagggagcagtgaactcgccgagagtcttgctaatgatagtcttgaagattggtggtgctgatacggctggtttctctgtcggtagagttttctgtggagcaacgactcgcggtctgatgctccggaggaaagcttctggattttctttgaagttcttcggcaatttgaaaccagtcatgcactaccctgttttcacaacaaaagtgaaaacaaccaaggttagcctgcaaaggaaaatgattatacagaggcaaatataaagtattagttcaagtaatctctattatgaatcttccccggcaacggtgccagaaatgcttgttggtatttcttaacgatattactagaaatataattcccaacaatggcgcagaaatacttatggtatattatggttacagagttcatccgcaagcgtacggatataccattgtagcatttcacctgagagtattccaagggtatcgtatttattttatccagtgggaagataatgtagagaagacttgactaataatttatatattgcttgtgataatcatattctaagcaggggttcagataatccaaggatagagtgacacacaagctttaactactcattctcataatatattatctatgctaggtggaaagaaaagagaaagataatctattcctatacttctaatatacatagtatacatacatcctagttagctgatatactagctaataccctctttccgatgccctcctggtacttcgagaagccacccctgactgccgagttccttaagacagcccgttataaccatacatcaggggctaaatacggaggagtacccaccccaggaaattaacttaggattatatataggcgtggaggaatacccgtactgatctgtcaccataagcggcccacctctcatccgcaatatataacccctaataatgatatcccgtaatctagacaccacatctaaactaccagatactactctaatatcatcatcatgacatagagtaattgcataagcaaacattatacctgcaccaaagcatctcccagataagctagccgtatattcagtataacaacagcataatgtaaagtaggtactcatatactcggaaagtatttcaataccataaatgtatttagaagagtattctaataaaagtactaggcttacaaaagagaaaaggaaagctgctagagccatacccgaactcttccgaagacttccggactcctgatttctactctattcctattccaacagctagatattactaaactaagcttgagaggaatgagagagctattgcttgaggtgtgtgtgaagtgaagagagtgagctccttatatagaggtagttatgacggttgt

SEQ ID NO: 43219 - DNA, 1501 bp, Oryza sativa
ttttcaattctttttcaatttttcacacacctctttataaatgtagaattgaaagttttaaattttgacgtgaaagatttcaaatcttgacttgaaagttttcaaattttgtgttgaaaatttttaaatctgggttgaatgttttcaaatctgggctgaaagttttcaaatttaggttaaattttttcaaatcagggttgaaagtttttcaaatttaggttaaaagttttcaattcagggttgagagtttttaaatctaggttgaaaattttcaaatttaggttaaatgttttcaaatctgggttgattgttttcaaatccggattgaaagttttaaatttgagttgaaattttttcaaatttgagatgaaaagtttaatgttttcaaaatttgacttcaaaaaattcaaattttgagttgaaagttttcaaattttgatttcacgtatagatttcttttcaatttgctacttaaaaaaatcttaaaaaaaagacaaatctacaaatcttaccttaattatggttattatcgaaaactaattggattaggtacgcatcaccgaaaaaaatccaaaaagaaaaaagaaacagcaccaaaaaaatcccaaaaaaattaatccctccgtgtgcgcgccgcctacgcgcgcgcgagttagctttctcgtgaataaagagcaacaccggcttcagccaacaggagtagagctattacctgtttgataagggatccaaacctgtataaaaatacttgtctccatctctttttctttaatctcgcatataccctggtaccgacgatcttcatatcatgcaaataccgtagttgaaacctcaaacgtcgacaacttcgatattggaaaatgttaaacgatcgtataaaacacttaggctgcgttctagaggatcccggcacgtaaaataaagcacgtattattgcatgattaattaagtattaacatttttttaagaaaatggattaatatgattttttaaaacaattttcgtatagaatttttttttcaaaaagaacacagcctttaacgtccattggaagattattccaagttaggaatcatatttcgatccgataagaagatctatacctaatttgaaaaacctacgctgctacggaacatctagactattactcctactaaactggagactaccaataatgtctctatgagtactcgaatacaacgagacataaggtataaatatactccctccgtcccaaaataattgtagttttacactattcatgtttaacgtttgaccgtccgtcttatttgaaaattttttatgattagtatttttattgctattagatgataaaacatgaatagtactttatatgtgactaaatgtttttaattttttcacaaaattttcaaataagacggacggtcaaacgttgaacgtgaatagtgtaaaactgcacttattttggaacggaggtagtactactttcagagggagcttaatagagacaacaaataaa

SEQ ID NO: 43220 - DNA, 821 bp, Oryza sativa
ccagacgctcgatggttaggtatgagagggttccatatttctgtttcatatgtgggttcataggccactctgacagagactgtgttaagaaggtagctaataatgatgcgcccttccaatattctgctgagctacgctgctcgcctttgaagccatttgagaagaaggtgagcactgttaaggggacagaggcttcgactgcttctcacaggttgtcgttccgcaaggctggtagtgcaagctcatcttcttcacggagatatcagggggaacaatgggatgaagcagtccctccaagggtggacacacattacggctttgatgctcaagagaaagtgggagatgaaacacttgatgaacagttagctagtcagacagacaagttacatgtttcagatgaaaagggatagctacaggacatgatggctacaggatcgacaaaactgaagatgggatccatgtccgggttgtcgtcggcgaagcagcagatggttgacatgatcccggctattgcgaatttacatcaggcagcttcttttggggatgtttcttcagaagacactctcagtgtccataagagacgatccacagaacaactcgggaacaagaagtcagggaaagtccaacaagccttgctgcagcatgtgttggaagcagaggaagacatgaagaagaaggaaggtgcagggctgcaaggaagagaactgaagcgtttcaagaagacagctgcggacggtatgaatgtgggagaattggaagtgaccagcgccggggctgctggtacactggcaggtcctatgttgggatcccgccaggaacaa

SEQ ID NO: 43221 - DNA, 1501 bp, Oryza sativa
tctcgcgttcaaacgggcggatttgcccccgcaaatctcgccggcgccattgatggcggccggacctcccgcgccggtttcctcccttccccggccaccctctctcgacccggctctatttaaaccctccccgctcctcctccttcagtttccgcctctcgccgcccttcctcctcgccggaatcaaggtcgcgccgtcgctctctccctccgccgtcgccatcgagctccggtccgccgccgtcgtcgtcccggatcacctcccacctcggcgccgcctccttcggctttgccgcatcctcgccgacctcgtccacccctccgtttcggtcgccgaccgccggaacgccgtcgaccccgtcgactcgagccgcgccgccgccttcctccgctccggccgcctttttcgtcgtcgccgtcgacctagggtgagccgtggaccgccgcttcttttcccccttcccttcccctctctcggccgccgctccgccgtgcctatggccgccgccggcgaccataggggcgcgggcgccgcctcccgccggccgcaccggcttggccgccctcgggcgcaccgagtggctgccgcgtggggcccggccgtcagccgcccgcgcccttaggtgcggctgacgcgtgggacccacggtgccggccggtgtgagcccgggtgcacccggtccaccgtggaccgtgaggctgccgcgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaggttgaagccgacgttttggaaagcgagcaaggcaagtcacatcatccttgaacatattgaatcccagtttagaaaattattttgatttaaattattgcattattgctttatttaaattcccgcgttatcactgttttatctagccatgcctatttacctttgttatgaccttattattgttattgttattatttccttgttcaccctagaataaacaaaaccccaactagtggacactctactcatggtactactagtatgattttaggtagatgcttcgctggttaattaggcaacattaggtggttttacaactctagactttgggatattcgtatcacctggacaatatggaatggtttgattattgtggaattggattcacacctccccctctattcaaaaccctcaaaatggttttaggctgggctcggggtgcatggttttgatagtagcacctcggccatataaggaccggt

SEQ ID NO: 43222 - DNA, 1501 bp, Oryza sativa
cagcacggttggcatagaaccactgcttagctctcccgaggagggagaacagaaacagtcgcagcctgacggcgtcgggactgacgcccttgatggtgtacgtgctacatatctctaggaattgttgcagatgagcattggcatcctcattaggcttgccacagaacgggctagcctacgccatcgtgatgaggctggaattcaagtcgaaattcatgtctcccatgttgatctacggcccaatggccacattgtcagcagagggagcagtgaactcgccgagagtcttgctaatgatagtcttgaagattggtggtgctgatacggctggtttctctgtcggtagagttttctgtggagcaacgactcgcggtctgatgctccggaggaaagcttctggattttctttgaagttcttcggcaatttgaaaccagtcatgcactaccctgttttcacaacaaaagtgaaaacaaccaaggttagcctgcaaaggaaaatgattatacagaggcaaatataaagtattagttcaagtaatctctattatgaatcttccccggcaacggtgccagaaatgcttgttggtatttcttaacgatattactagaaatataattcccaacaatggcgcagaaatacttatggtatattatggttacagagttcatccgcaagcgtacggatataccattgtagcatttcacctgagagtattccaagggtatcgtatttattttatccagtgggaagataatgtagagaagacttgactaataatttatatattgcttgtgataatcatattctaagcaggggttcagataatccaaggatagagtgacacacaagctttaactactcattctcataatatattatctatgctaggtggaaagaaaagagaaagataatctattcctatacttctaatatacatagtatacatacatcctagttagctgatatactagctaataccctctttccgatgccctcctggtacttcgagaagccacccctgactgccgagttccttaagacagcccgttataaccatacatcaggggctaaatacggaggagtacccaccccaggaaattaacttaggattatatataggcgtggaggaatacccgtactgatctgtcaccataagcggcccacctctcatccgcaatatataacccctaataatgatatcccgtaatctagacaccacatctaaactaccagatactactctaatatcatcatcatgacatagagtaattgcataagcaaacattatacctgcaccaaagcatctcccagataagctagccgtatattcagtataacaacagcataatgtaaagtaggtactcatatactcggaaagtatttcaataccataaatgtatttagaagagtattctaataaaagtactaggcttacaaaagagaaaaggaaagctgctagagccatacccgaactcttccgaagacttccggactcctgat

SEQ ID NO: 43223 - DNA, 1501 bp, Oryza sativa
atgcatcgcttgcgatgcaccccaactggtgtatgatgctggaggcgaggagctaagtagcgaacacaaatactacatcttcctggtaaataataggtctggtgggggtgccctctccatcatctatgctggcaatacacattgtgagcattttgtgttccataggaccgatgaggctctctagggcgcaaaagtgagattcacatcattgcacaattcaacagtcagtgatgcagtccgcttgtcgaccgatgtccagattgactttgtggacatcatctggttgtgcaaccgcccctcgacatggtacatctctaatttccaactgaaattgttaccaatgccaccatcatcgtcaacatctaagttgcaatatgtcgtggccaacacaaatatagagcctaactacccatcatcggctaaagtgttccgcattgagaggtacagtgatgatgacaatatgacgtacaagctattgacgtgcattacccatgggaagccttgcaaatatctagggtttcaggtcttcggggataataaattcctagtggcaacggacgagccattagcagttcaaatcgtcaaggaatacacatgatttatgcaagtgcttatgcttatgttatattctagcatgtacttgtagtttatataatgtgcgccatataatctatttgtgatggatcaatcttaagctgttatttcttttgatgtgcgaaatgttgaaactttgtgactcttaagctgttattctatcaatgaataagggagaatagctactttagtccctaaagtttctctataggatcagtttagtccctaaccttttaaatggtccaaaaaaatccttaacctttgtcataaggcctagaatagtccttgggtccaccaaaatcatcatatggatatgccatgtcatcattcatgcaaaatctatgatgaattgtccaatttacccttacgtatatcatagaaaaataaatataagggtgaattagacataaccataggaaaaaaatacttctttttttcacccttttgaggtatatttttgctcttacaaataccatatattttttaaactttttccttttgttttttatttttctgtgcgtaagggtaaattggacaaatcatatagattttgcataggaaggtgacatggcatgtccatgtggcattttggtgggaccaaggactatattagcccacatgacaaatttaaaggacttgtttggacaatataaaagattactgactagaatgacccatgagcgaaactttagggaccatattagctattctcccaatgaataatatctttagaagttctaatttcaattactaatcatgaaaaatatatacaagtatgtcaatgcttttggctgtgaaaaaaatatattaatatattttaaattttggcaagcaaattcatcttttcaaatccaacaacaaacatttgaaagcaatcaaaaggagttaaaggcagcagcggccaagt

SEQ ID NO: 43224 - DNA, 1501 bp, Oryza sativa
gtgacaactcataaaaggagttcctggaagatgaaggctttggtgtctagctcgtgcctgccgttaagcacctgtggtcgtcgccctagtcttccgctgtttcccgtttgtctttgtgtgtgctgggccttcgccgcccatgtaataaattagctatttacgcttccgcttgttaaactctgaactgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagcaatatttttaaaataaaaatcctttcttatttgtgaaaatcctttagtctctctctgtcctgctgcttcatttatcgtcaaaatctgatctttaaaatgttgcttgtctcttttgtttgtagatggccggcagcatcaatcgtcgtggtctggacctgactggcttcgttttggagctgcggggcatgtgcgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattccttctccgccgcttgccagaacgccgcactcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggcccgtatggacttccatcagatggtgcgccgcgggttggtcgagaacaacatgaagatcctggagctgcgtcaggagaatctgcagctgaagaaggacctagacgtagtggaggcgcagctgtgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccgcgcccgtggttcctcaggaggatggagtctccggcgttggcagcacggaggatgcgctgctgctcaccttccgccctggcccgttgcagaagtagacgagcagttagtaggcttgcgcgtgtgttcttctcgtttgtttttctgctagagtcgtttggggcatggttatgccggtgtgtggtatgactgtgtcggagcctgtctttattttatttgcttaagcaacttgaaccttaataaaccaatttaatagcaataataaattcaagaattttggtagtcgtgggtggttagttttaatagtctgttctctctcttggctggttctgtatg

SEQ ID NO: 43225 - DNA, 427 bp, Oryza sativa
tagagtgtactctagaactagaagtgagtcaactcgattgatgccatgcgaccacagacagacttcttgtgtctttctttgtttaactatgcatgttggaaattctacagtttatatgatccagttgtttgattctttgcacagccaagagcatcccctcgggaatttgtgatattagttggaaggaaggatatttggctgtggtaaaactggtattgataaatagagcacagatgcggctaactgttggccaagtgcatcgacatgtacttgcattggcatcttctcggtcatgcttcgtccttggtgatcaccttccattcagaatgctttcacttccacgagtggtaagatttcaccaaaccgcttggcatgatattcaaactgtggaagataagagtggtccgctaactctagctagtcttga

SEQ ID NO: 43226 - DNA, 312 bp, Oryza sativa
tattgctattgttattattaccttgttcaccctaggataaacaaaaccccaactagggggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcgggggggtttgggtgcatgccagttgtgggaagtagcaccccggccactataaggattaa

SEQ ID NO: 43227 - DNA, 1501 bp, Oryza sativa
ctcggattcgtttggaactttccccctaaccttgccggcgccattaatgacggccgggactcccgcgcccgtttccccctcctccggccaccccttccctctcttaaccctatataaaccctccccgtgcctccctccaccgtttccgccgctcgccaatctctctccccgccggaatcgagctcgcgccgtcgctctctctccgccgtcgccgccgagctccggtccgccgccgttgtcgccccggaccacctcccacctcggcgccgcctcctttggcttcgccgcatcctcgccgacctcgtccacctctccgtttcggtcgccgaccaccggagccccgtcgaccccgtccacccgagccgcgccgccgccttcctccgctccggtcgccgttcccgtcgtcgccgtcgacccggggtgagccgtggaccgccgattcgtttcctccttccctcccctctctcggccgccgctccgccgtacctatggccgccgtcggcgaccataggggcgcgggcgcgccgcctcccgtcggctgtgccggcgtggccgccttcgggcgtgccccgcggctgccgtgtggggcccggctgtcagccgcccgcgcccttaggtgcggctgacgcgtgggacccatggcgccggccggtgtgagccctggtgcgcccggtccaccttggaccgtgaggctgccgcgtgggccccactcccgtggacccagtccgcgcgcccctcccctcggctgacgcaataaatccttttttttttctttaattaaaatttaaatgaagaaattcgcaaatattcatttaaagagcatataaacttcaaatggccataacttggccatttgaactcggaattggaccgttcaagtctctaaattttccttaagaagtcaagaacccatttttgtgctttgtttcagcttgttatatggagtttattagagtaaaagccttttctttttcattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcactggttaattaggcaacattaggtggttttacaactctagactttgggatattcgtatcacctggacactatggaatggtttgattattgtggaattggattcccacctccccctctattcaaaaccctcaaaatggttttaggctgggctcggggtgcatggttttgatagtagcacctcggccatataaggaccggt

SEQ ID NO: 43228 - DNA, 433 bp, Oryza sativa
actgcgcccctttgaaaatcgagttgcagctcggtaccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgatggtcaggccttaagtgcctttgtaataatgtaaatattatcgatataataaagatgtgccttttgtatcatgtttgttcggtgtaccccggctttttcctgggatggggattaatacactagcattcgggaaaaggtaattttctcggtcgcgacatagtactgatgcagctcttgactatcagtacccattctagg

SEQ ID NO: 43229 - DNA, 187 bp, Oryza sativa
tgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatccct

SEQ ID NO: 43230 - DNA, 590 bp, Oryza sativa
gcggccttaattttcctttttttagatggttgattttttgttcaccattttttacttctatataatacatggacaaaaaatcgtatctaatctaatattctgatctgacaaaaaaaaacaaaaaaaaaaggggaagaactcaagtcggtttctccaattaggccgacaccaagctgtcggttcggcccaaaacctcgcagccacaggagagagaagaatcgcgaaggaagaaggccggagaagcggaagcgagagcgcacggcggaggcgaggagggtttcatggagcccgagaaatccaaagaggcggcgagccagccgatggaagcggacgccggcggccccgtcgatccccgagaactaggtagctctcccaatcccccccttgctttagatggctaaaatctttcatgcgaaccccttttgcttcctcctccaagaaccggaagtatatataaatcgtgcaggaaatgggagatgcctgacgtgtcctgactgatgcacctgatttcccctcttttggttttgtgttacctctgaatttgttagtgtccagcgacgatgagatagattactccgtggagcccgagt

SEQ ID NO: 43231 - DNA, 184 bp, Oryza sativa
tgttccctttcatccttcactcgggacgagcaagggttcaagcctggggggttttgttgacggtcgttatcgatcagtttcgaccgtcaatattaccaaaacctttcctcttcattctttccactaagaaagctctcctctccatctcaactcaattccttggtccccctactcaaaccaccca

SEQ ID NO: 43232 - DNA, 1501 bp, Oryza sativa
agcccgccacctcccgcctcgtcaccactcaccagcctccccgaggccagtcgccgcctcatcaccttgtcgccagccgcacgccgcctcccgcccctcccgggagagtagaagaggagaggagagaagagaaagagatagagaggagaggagagaaagtgagagatgagtggaaataaaatggaggggaggtgaaaaatttaaagtgagtgagagggagaagagggaggagtatttttgcgtgtggacctcttagagcaagtataatagtaggctataggctggctaaatgctaaggtggaggagagaagagaggccagagaggagaagcgggctatagacttacagccggcttgaacacaagaaccaagaaactccgtgagagagacaggtatgccatatattaattgtaaagatctaactattatatgggtaggctgagaaagactataaagaaccttatagccaacatgtcggctgtattattagccttgctcttaaccacctgcgaaaataggcccacggtccatttaagaggctcgcatgtgaaaattgatttttccgtatggtccttttgaggagccgcacatgaaaataggggacttttcggttttatcggtaaatgctttataattgtttaggatagaaacctaaattcaggattgttcagaataaaaactaccacttcaattctactcatacctccttttttttaataaatgacaccgttaacttttaaaaacacatgtttgatcattcgtcttattcaaaagttttatgcaaatgtataagatataaatcatgcttaaaatactttaagtcataaactaactcacaacaaaataaattataattacgtaaatttttttaataaagataaatggttaaatgtcccataaaaaaatcaacatcgtaatttattaaaaaaggaaggtagtatttgtttggtcggtgtgtaattgtgttcagcctattcggtgttgcattcggccaaattaaggcccacgccggttgccacccaccttgtacttgtcacgaactcacgatttggcgcgtcgccgtgcacggagtccatgaagactggaaagcagaggcacaccgcacacgtacgcgcggtctcgcggaccggggcctgcgctgcggccggtggcctattgctagctaagctctaccttggctcgctcggccgcctgaacccgaaagccaaaaaccccttgcggccttgaccaaaccctagcgttgatctttgctccctcctccttgagtcccctttccctgcctgccgcctcgcgcacccgcacgcacgcacgcacgcacgggcggcttctcctctttccccttcccgcacgcgcctcccccaagtctccgcgacgcccacacaagcggggggaaggagaggactccggactccactccccccgccgccaccgccgcgaggagccctagccccccgcccccgtccgcgcgccgccgccgccggtaccccaagccggcccggaga

SEQ ID NO: 43233 - DNA, 1501 bp, Oryza sativa
gtgaagctatgttttggtttaaggtttaaaagggttgaagtcgaagatgaccagaatgaattgttgtgaatttaattccgcaccaattgcttttcgcagcgcctgtattgggccatgttttggcaagttgtactgaaactagttcccgatcagaaaatactgaggaagttttgcaaccattgtaacttgtctatgcctgcgtgccgtggcgtggggcacccgaatgatagcatctgtgcccttccatggtgttacgccacattttaaactgttgaattttagccagcatctatacagtaccagcgttttttagtaacaattgtcttacatggggtgtacagcgttttatagtaacaattgtcttacatgggttgcatcggaggaaaaatcagtcagggtctccctctgtcttattttaagcgtagctataagttttcgtgtcaaactttaattatgtttcatttaaaattgtctcatttaactgcttctcctagtggtgcgcggggtctgatgcattctgaattctgatgcattcgtctcaacaggatcattcatattcgaagcccgaaggcattgccgactaccgtgccagtttgtttcagcaaaagtgtgtttttgctgataagaataagacggcgagggccgaggagctttcaacgaaactgcaaccaaactggtggattccacgacacgaatgcactaggcaaaagatagtcgagctttcagttttacatcgcaaaagttatagtcaagttgtcatattatactcatacggaccaaacatgtccgcttgaattacgcaccagaggcccagagcgcttcatgctttgcctttcatcttcattaattccaccgtgctttgcagctgagaacgcctcatgctgtgactgtaatgctgtgcaacgcaacatggcggaatcgctacttctcccggtggtgcgtggggtggccggcaaggcggccgacgcgctcgtccagagcgtcactcgcatgtgcggcatcgacggcgaccgccgcaagctggagcgccagcttctggccgtccagtgcaagctggccgatgccgaggcgaagagcgagaccaaccccgccgtcaagcgctggatgaaggacctcaaggccgtcgcctacgaggccgacgacgtcctcgacgacttcgagtacgaggcgctgcgccgcgaggtcaagatcggcgactccaccacccgcaaggtactcggcttcttcacgccgcatagcccactcctgttccgtgttaccatgagtaggaagctgggtgatgtcctcaagaagatcaacgagctggtcgaagagatgaacaagtttggcctgatggaacacgtagaggtgccacagcttccttatcggctaacacactcggggctggacgagtcagcagacatatttgggcgagagcatgacaaagaggtgttggtgaaactgacgctggatcagcatgatcagcagaatttgcaggttctccccatcgtggggatgggag

SEQ ID NO: 43234 - DNA, 1501 bp, Oryza sativa
tggcgtatgtgatagttacttacttagatggtgtggcgtcccgcgccttcccgccgcctacgacgtggagctccgtcgggctgctgccggcgccgccctcctcctctcccgccgaccatcctacgggcagagagagagagatacgaggaaccgagaaagagaagagtgggggagagagatgacacagcctaacatgtgggtcccacgctgactcagccgcaacataggataaaaccggtgtcaaaaccaccaaaggacatattgtcaccggttttgattagttgtggatatctggttttctggtttggatgacaagttgagggaccttcggtgtactttttcctctgggaaacccaatcaggcattcaggcctaagccattcagcccaactatcaaccatgtaaccctagctctaggtgctctccagtctctctcctgctctccacccacacagccgcccgccagcatctgcatctgcatctccctctgcgccagcgacggccggcgcgccccatcgccgcctccgccgtcgacttgccccatcaccgccaacgaggcgttctgccgcctggcgccgctcgtcacgtacgaggacatcctccgcatcgccaacggcgacacctcaccatcctatccggcaagcctgtcagcgagttcctcaccaggtaagtgctcgatctactccctgcatgcgtacatggtcgaccacttcgggagggaagaggaatataactatgtactgtgactctgcgagtccatggttgtgtttagttcacgctaaaattaaaagtttggttgaaattgaaacgatgtgacagaaaagttataagtttatgtgtgtagaaaagtttttatgtgatggaaaagttaaaagtttgaagaaaaagttgggaactaaacaagggtatgactgctatgtgctaatgagtaatgacctgatgtgtgtgactatgtcagtgtgtgatactgtgatgtgtgtgagtcagtgagtgactatgttagtgtgtgcaagtttgtgctaatgacctaatgttaatctgtgtgactatgtcagccgtcagcgtgtgcaagtttgtggatgtttgtcgatatggtattattaatcgctaaaacttgaaaatgttgacattttctattagaaaaaataatgaagttatatttcttcgttgatttgtgatgcttagtttgaggggtttttatgttccgattaatatttgtcaccgcattcgtttcgtttcgtattcgctccgtatctgtattcgataatattcaatcctgttttcatatccggttctgattccaattttgaaaaaataatatgaaaacaaatatgatagagctagtttctgaccgtattcgatccgctttcatccctaatcccagcagtttagtatgcattgcagccaatattttctcatggacaaggcgctgaagtgagagacgacagacgaagaggtgaaaaaaatggagtcatgttttgtaacgccccacgaggacacgc

SEQ ID NO: 43235 - DNA, 1501 bp, Oryza sativa
cagcccacttgttttcctcgtcgttccatacatcgtcaagaacaagtagaaaccttcttcggccaaaggcttcctcaagttgccgtcgcaacagctcgatggtgttgattagttggcatcttctatttgtagccaattcaacgatggatttcagaagggaaccaacttcaaagttctctgagacacagtgccacatcttcagttggaaatgttcctggacactggggtcattgtatatcagcttggcaagcgtcgtcttgcccaaacctcccatccccacgatggggagaacctgcaaattctgctgatcatgctgatccagcgtcagtttcaccaacacctctttgtcatgctctcgcccaaatatgtctgctgactcgtccagccccgagtgtgttagccgataaggaagctgtggcacctctacgtgttccatcaggccaaacttgttcatctcttcgaccagctcgttgatcttcttgaggacatcacccagcttcctactcatggtaacacggaacaggagtgggctatgcggcgtgaagaagccgagtaccttgcgggtggtggagtcgccgatcttgacctcgcggcgcagcgcctcgtactcgaagtcgtcgaggacgtcgtcggcctcgtaggcgacggccttgaggtccttcatccagcgcttgacggcggggttggtctcgctcttcgcctcggcatcggccagcttgcactggacggccagaagctggcgctccagcttgcggcggtcgccgtcgatgccgcacatgcgagtgacgctctggacgagcgcgtcggccgccttgccggccaccccacgcaccaccgggagaagtagcgattccgccatgttgcgttgcacagcattacagtcacagcatgaggcgttctcagctgcaaagcacggtggaattaatgaagatgaaaggcaaagcatgaagcgctctgggcctctggtgcgtaattcaagcggacatgtttggtccgtatgagtataatatgacaacttgactataacttttgcgatgtaaaactgaaagctcgactatcttttgcctagtgcattcgtgtcgtggaatccaccagtttggttgcagtttcgttgaaagctcctcggccctcgccgtcttattcttatcagcaaaaacacacttttgctgaaacaaactggcacggtagtcggcaatgccttcgggcttcgaatatgaatgatcctgttgagacgaatgcatcagaattcagaatgcatcagaccccgcgcaccactaggagaagcagttaaatgagacaattttaaatgaaacataattaaagtttgacacgaaaacttatagctacgcttaaaataagacagagggagaccctgactgatttttcctccgatgcaacccatgtaagacaattgttactataaaacgctgtacaccccatgtaagacaattgttactaaaaaacgctggtactgtatagatgctggctaaaattcaacagt

SEQ ID NO: 43236 - DNA, 1501 bp, Oryza sativa; identical to SEQ ID NO: 13270

SEQ ID NO: 43237 - DNA, 240 bp, Oryza sativa
tttttccctctctctctcgcgtttaaacgggcggatttgcccccgcaaatctcgccggcgccactgatggcagccggacctcccgcgccggtttccccccttccccggccaccctctctcgacccggctctatttaaaccctccccgcacctcctccatctgtttccgcctctcgccgcccttcctcctcgccggaatcgagctcgcgccgtcgctctctctctgccgtcgccgtcgagc

SEQ ID NO: 43238 - DNA, 1501 bp, Oryza sativa
aaacatctcgctgtcaacggatgtcatataccactaagaataattaatcgtaaatacgagcatctgcggtaagtctagaaacttgaattccgatgagctaatcccaccacaataagagtaaatcattttattcatgtttttattttttttctttagaggatttgccacttcccaataatttgggttgtgtgtttgcataccaccacttgcacgcacaaacatttgtaagtcctgtacacatgttttaagttaatgttggaggcatcaaacacccaccccctgtagcgaggacaccacgtattaacctagcatacatgcataagcactcctaaaaacattggacagctaaactaaatctaaaacttgaactctgatgaactaggtacacaccagcaccacttagccatccgtgatttttaatactatagttagcccgtacaaccaagtagcaatcgcaatacgcacatgaagatgccaaaaactgcgttgattagttgactttgcgggaggttgtgagagcgtttttttcaacaaaagatgactggagaaagacgtcgagagagggaggagagggcagagaagcgagggggggtacaggggcgatgaagcgatgatgatgacctgtgttgaaagggaaggcgaatggaccggctaccagccttcctagttttggatatgcatatggcgttggtcgcctactcgctttcagcgtataattggagccccacccggcaaaggcttcatggcttcgttggctcaaaaagagcatgtcggcgacctctcccgccacctgattttaacgcaatcttttctctctctctattctcaccgcggaagtgaaacactgtgcactgttcgtatctttacactgaagctacaacctcttctgctcctctcagttttgatgttcttgcacaggatatgagctgtgaatttcacgagaaacaattcgattctacccccagcaaaatttcctgtgttctggtccaaacaggactgtagctattcacaacccattgtcgttctggtccactaccatactaggacatctctgcttaacgaatgaatggataaatgggcacactttcccgaattcctaaatgctatgatttcttataatactgtcttaaatccatttttatctttataataattcattcgttcatttgtaccctcgaataattctcacgaatcattaatttattcagcaattctgcacagcacaaaaaaacacacattgaagtaattaatgttgcaattccaatattccaggaacttgccaacattcttggtgaaattcatcaggccccataccagaatacagctataaattataattttagactgaagaactcctagcaacagaaatgaaaaaaaaaagtatggcaaatgcacctgactgaattgaatgtagattgatttaacagtagaacgccaaagcaagtacagatctcatcagtggctacggatcaacaaactacacattcagaagaacaagttt

SEQ ID NO: 43239 - DNA, 1501 bp, Oryza sativa
gattgcgattaatttgcgagacaaaccttttaagcctaattgttccatgatttgataatgtgttgctacagtaaacatttactagtgacggattaattaggcttagtaaattcgtcacgtggtttactgatggattctgtaattacattttttattagtgtccaaacaccccatgacggattacattttttattagtgtccaaacacccaaatttggcacctatggacgaaatagggggaaaattgccaaagtttggaaagtgcccggtttccttcatggggccggccagactgcaggcatgtgggcggtctgaccggctagtagggccggtctcaccgcaggtatgtgggcggtcagaccgtcagggttcgagtccgagtctgttttcgtcgggtctcgggtttccttgctcgggaagccatgtttcgtgtttccattagtttctatcctgagttggacgtggaggagggtctgtaaagggcaagaccaacccttatttaagagacaaggccggttcattgtaaaaccccccaatacaatctacttgaatcgttcttttactatgttttctattttaccctagttttagtccatctttgtcagtttgtgccgtaaaccgtccgccgccgctgcgagagtgttaacagtgaaatttggtaagcccggagtagtcatcggcttagagtcagcatcggcttcaaagtcgtgagattagccgatgagagttgtcaagtcgtcagttgtcggattcttgctatattcggttaaggaaattgatctactaaaggaagcttatccagaagagaccgagttcaaagagaatgtggcatggcaagttatctattaattaggaatagtttgttagtttccttttatctttaggaaagtgtgtttagtgtcctataaggactttatcttttccttttatctttaggaaagtttctttcttgtccgataaggacttgaatcaacccatgggtataaatatgtacacccggggtctatgtaatctatcttcacgatcaatataattcggcgcatcgccaccttttaccttttctactttattttatcgtccggcaggacttggcatctgacgcagggctgcatcggtgttcgatctccggtgaaggggtaagtccaatgtttcgccgacccaggcaattgtatcgtttacgtcggtgtcgttcaaggctacatcagtacatttgacctcttagattgcttcggtttggattatatatttgtctacctatttattatatgtctctgttaatctagtcttagcatatcaatttagctctatcggctgcttctcgttttagggtttctgccggtatcggctaaatcgcgttgctagatttgattagcttagacatctaccaccctgataattcaatcaacggcttgattgtctagattttatgtttcttttcatacttagtgttgcatcagttaagtttgatctactaagtcgtgtttagaaccataatctctagc

SEQ ID NO: 43240 - DNA, 328 bp, Oryza sativa
tttggtttgaaactaaaataaaacctgcttggaacttgtgttggtaaccatatattgtgcttgatcattttcctctccagaatatgcaattatatcacttgattgtactgagcatgtccaattttttaatacaaaattgagaaatctagatttgtgggaaaaaaaatctggaggcaagtttatgtgacctatttgcaattctttcagtaatcattttatatcgtgaaacattatgctgttgttttcatttgcacaatgttcagaaactcctgaagttcttactttgaatgcttcaaatcttcagacaattattaactgtagtggcttt

SEQ ID NO: 43241 - DNA, 1501 bp, Oryza sativa
gaaacgaaaatcaggatgtgatatagatctacagggagaaggcgcccttgtggtgaagacagcagccaaatcatcggggagcttcatcaggattggcggataggccccatcgtcttgatcgggctgtgttggagtagattggatctcgtccaagtggtttgaagccgactcggtggagatgatcttggggtagatctcggccgagttcgggataccgaacggggcgaagatctggcctcttcccgactggttcgaatccgagtcgatgagagaaatcttgccgaggtcgttggtgatgaagtcgaggctgccgaaccggaacgcctgcccgggagggaagacgaagttgtcgatgcccgaaacaaaacccattgcactagtcggcgaagaacttgatgctacccctacctggcacgccaactgtcgaaacaagatttcggcaagactaaaaggggtggctatcaagctggaaaagtggatgggtttagagacaaggaattttatacaggttcaggcctttttaatcaagaagtaataccctactcctgtccggggatagatccgccgagtgtattattgatcatatgatctgggtgaaaaacgtgccccaagaggcacccggaccgctccttatataggggaaggggtccgtattacaaaatacagtccatatccctaacggaataggtagttatagataaaatacaatcgttaccgattaggatcgcgggtatttccttgacattcaagtttagaatttaacccgagtccttttaaagatattctacctatacatggcaccccatacccagtcggatatacatatcatgtaggtatggggtatccataatctccacagtccctgccaaaccccacatccaacgatggagaaatgggttcggccgaacctgggctggcccaaccagcccacaatttggctggtggcctactagacttctcttctccgcagacttatgaattttggcccagtttatcgtgtcaattctgagttcttggcccattcatgcataagtctgattctcgacatcgtccaattgatttatcattggtgctgatgtcgattctcctctactttgtgatcattctctgcaaaaggttagtaaacctaatactagtagaatattattattctaacatatttatgcattgcaagcatcactagttctctcctgttagtgatattgacggtcgaaactgatcgataacgaccgtcaacagtaggcatagtatttgggttgattaaatgccgttggatgtgatgggggggttaggtcccgatcttccgataggtattgataaacaacgatttcgatggagtcgtgacacaactcgatccggcttccgaacgaacacgctactgagcccggcaatcgcagcaccacgtctcctctggttatcaaccgtgccaaaacccggttgacctcgccgagaaggctaatccctggatgcgaatcgaagaacacaagcaagaacaggatag

SEQ ID NO: 43242 - DNA, 1501 bp, Oryza sativa
tacttccactcccccctgtagttggcgtatctttcttcggcttccaagtggtgcccgactgcttggacgcggtaatgacatcttctgcttgaccgtcctgggaggcttgcgcccgaacttgccgactaggtcatcatggcaaatgcccttggtgaaggcggcgatgatgacgtcgtcggtgatgtcggagatcttgttgcgttgctcggaaaaacgtcggatgtaatctcgaagggattctccagacttctaaacaacgttatagagatcaaactgtgtaccagggcattcaaaggtaccctggaagttggcgatgaagtggtcgcgaagttctgcccaagatccgattgtgccacggggtaagccgtgaagccaggaccgggcagagtccgctagggccacaggcaaatagtttgccatgactttgctatctcgtcctgctgcgcgaatagcgagaccgtagatggtgagccaagactccgggttagtggtgccgtcatacttctcgattccagtcggcttgaagccggctggccaatccactcgacgcaatttgcttgtgaaggcagcaactccatccacgtcgttgtcgtagcgatctagtgaatggtgggaagcgtattctcttgccgcgcagcgctggttgatagtatcgcgaagatcgacggggcgcctgcgatatgaggagcgaggtcgttcaactcgatgctccctgtgtcattcaggaggcgagtggacagatcgctcgtcgtgacccttactcctgcgactggatcccgcaccgacgacgctgaggcttggttggtgatagtcttgagatcgaagagggggaactcggctaccagtcagcgtgcggacgcttgcagagttaaccgggaccaaggcagagatcatgatcttggtctggttcaagatgttgacgacgtgattggcttgattgagtacgtcttccttgaggagggtgtcgaggagggtgatcgctgcaaccgcgttctgttgaggggtgcgaaaaacagccgttccctcaacgtcttgctgcccgataagttctcgtgctcgtcgcccgacatccaaggcgtgctgtcgccggtcctcagcctcttttgcagcccgttcgcactcctgttgctcacgctgcagccgttctcgctcttgtgcttggcgctcctcttccagtcagggtcgttcggcttcctgttgcacgcgttgttcttctgcttctcgggctttacgctgttcttccgtctcgttttcagccatgaagatgccgaagtagagaggcgtgtagttatcttcaaagtcttagtcgaagtcgtcgaggttgcggtctacggtagccgaagtcgtcgtactcaatgatctccgttggccgtgagtcgacgccgggggagctgaggtagccatccagttgttccgtcgaaaccgtgccgagaggctagagtatgacgccgacttccctggagctaggctggatcgaggtagaggccggatcccgcctaga

SEQ ID NO: 43243 - DNA, 330 bp, Oryza sativa
aaaggctacatatatccgatacgatgtggccgagttaaaaaaatatcattctctaaaataaaaggctataacttaatttgtgagtaattatagcataatcttgtgaatcataatatatactaaaatgttaatcatgagactgatcacaggctcacgaatcacactacatgtaatgagtttaacgagctaactcggacattttaacgggtcaagttaagtttcaattcgttcccaacttattgtgttaatgagtcgagccgaacaaactcgttaacttaacaagtttttacgaattacttcctccgtttcaagttataaagctttcacatt

SEQ ID NO: 43244 - DNA, 1501 bp, Oryza sativa
tttcatgtttttcttaaaaactatttttacatagtgtatgaaagagtattcacgtacaggtagccgtatcaggaaaaaaattgtatagcatgtgaatcatgatgtaaataaaagaacttaaacacaagactattttattagcataaaaaacataaattatatttttataaatttaatagatgtaaaatgaaattcttgaaatatacatacacctatatattatttacataaggaggttatgtaaaaattttcatattttttcggaaaatctagtaggtcaatcaattgtaacctcttgtaagtcctgaagggcattttgggatttttttaaaaaaagtatccaccctaatggcacactgtagaaaacaattaacatggtagataaagtcgatgctaaatcattgaactatagtaaactcagtggcatagagtggattctctcttaaacttttaagccaaagacatggtaagagtgttacgtcattgtgttgaaactgacggctctaagaggaagtgttttgaagcactttcatgtatctcatgcttccaaaaattttaaaattccaaaaggttaaatttacaacatttcataagagcctatttggtgaaaactcaaaaatccaaagtccaaaggttagcaaaatactttaaagtgtaaaagagctcttgtagtaaaaaagtatttaattaaaaatgaaaatgcatatttctaagatgttgccttcaccatgtttggcccaaagttgcatatgatgggtttagctaaatgagctgaacttcattatgaatattggcttaaattggtatttaactcatgtaagctctagatcaagtttagttttctatgtgatttgagtctctgagtgaaacttcttgtcttaaaaagcatgtaaaccacatttcttgctttcagtttgatagaaaaaattttttttttccaaataatattttgtgaaatgttcctcacaactcacaaatccaaaatcttggaattttgaaaggaaattttattgagaaaatcatggaattttgaaaggaaattttattgtttctcaatgctcttttggaagctcattttgtgtttccaaaatctgaaagctaggaatgctcgattgactacaactttgtgattttttgtgtatcatatttggttgagatatatgaggaattctccctaatgaaatttgtgcatctatttatgatcaatctccaagatttaccacaaagttttaaatcctatggactggacagtccagaatgaagctggattgttgtcataggctctccggacctcccattatatttgagagatgaagtgaataattcaagtcatcaaagaaacataatgaaacattcgacgcctcgagagaagaatattggagacattgctgggcttttagcctgccagtcaacttcagcctgagatgtgcccgtcaaaccactcgaaggcggcgaccagatgtgttacacattcaggagacttgacaaaaatggctaaaga

SEQ ID NO: 43245 - DNA, 1501 bp, Oryza sativa
tgatctagaaggaatttcgaggcccatgagtacttgttggaaagattatggagtctactttcaaatggttttggtcccatgtcaaaattcctaccgagctgccgggaatctgcaaaacaagccacgtatctcatccagtccgaatctgattttgagttttgagccttgtaattgtgtcatgggcttagctcaagggggtgtgcgccctagggcaaccctatgacgtccctaagcacatttattcagtagccgtcatcgtttagagtcgggttttgcttagattattctgtcaagaacagtttcgccgctagatcggtttgtagaaccccaaattcgagtgcttaatcattcatatgcaatttggttgcaatctatcctgttcttgcttgtgttcttcgattcgcatccagggattagccttctcggcgaggtcaaccgggttttggcacggttgataaccagaggagacgtggtgctgcgattgccgggctcagtagcgtgttcgttcggaagccggatcgagttgtgtcacgactccatcgaaatcgttgtttatcaatacctatcggaagatcgggacctaacccccccatcacatccaacggcatttaatcaacccaaatactatgcctactgttgacggtcgttatcgatcagtttcgaccgtcaatatcactaacaggagagaactagtgatgcttgcaatgcataaatatgttagaataataatattctactagtattaggtttactaaccttttgcagagaatgatcacaaagtagaggagaatcgacatcagcaccaatgataaatcaattggacgatgtcgagaatcagacttatgcatgaatgggccaagaactcagaattgacacgataaactgggccaaaattcataagtctgcggagaagagaagtctagtaggccaccagccaaattgtgggctggttgggccagcccaggttcggccgaacccatttctccatcgttggatgtggggtttggcagggactgtggagattatggataccccatacctacatgatatgtatatccgactgggtatggggtgccatgtataggtagaatatctttaaaaggactcgggttaaattctaaacttgaatgtcaaggaaatacccgcgatcctaatcggtaacgattgtattttatctataactacctattccgttagggatatggactgtattttgtaatacggaccccttcccctatataaggagcggtccgggtgcctcttggggcacgtttttcacccagatcatatgatcaataatacactcggcggatctatccccggacaggagtagggtattacttcttgattaaaaaggcctgaacctgtataaaattccttgtctctaaacccatccacttttccagcttgatagccaccccttttagtcttgccgaaatcttgtttcgacagttggcgtgccaggtaggggtagcatcaagttcttcgccgactagtgcaa

SEQ ID NO: 43246 - DNA, 1501 bp, Oryza sativa
gaagtagtatcagtgacggccgcggtggcgccgtgtggccgtggacgcagcggcggcggatcggagggatcgccgccgccgccgccacacagcgcgagcaggcagccggcgaaggcacggatgagaatgctctgcggctgccgcgacggtgcagccgccgccgccatctccgtctccgccgtgacgacatgtccgccatcgacctgctcttcgccgtgcaggccgccgctagcgctgctcttcttcacaaccttctcgtcgtcttcctcctccatatctctctttgataatgagagggaggtgagctctctgctgctctactgctttagtccaggacaatttgaaggtggatttgccaataatgcccctgccttgcacgttgattcttttttatcttctaagattacacggcacacgtactcgcgcaaacaccactgcacacccgttacggatctagaaattttctgatgcctggataagattaatgttattgcagataaattagattttaaggctagtattatattgagcataggtgctaggtgctagtaagttatattgttttgaacctatttggcctttgatgttttttatggctacagcttgatggtttggcccttgctttctcgttttctgatttatcatctaattaatctccattaattagaacctatgaggcaagtatgcaaggtacataacgctgcatataccttgggagtagtgtgttgtggcatgcatggagcgcgggcacccgttcgtggtgatagggcactgtctccgtcactactatacacgtaacaccatatccatgttgttacaaatgcgtctattcacatatattgtaagagacaaacaatctagccactactaaaattacgttgaaagcacgtattgattctgctaattgccctcatcaacttgatactcacatgcacaaactgttactgtcatattgaagatcccattaacgattggtcaaactgagcaattacatgatcaacgcgaaaaagttcttgataataagtgttgctggcatgcaattaattaatcaaccttagtgtccaagggcgcatacaaacgtacgcaaactgccgtcatttgagccatatatgcattgccgatcttttcagcttattcgttggattattagaaatggatcatttacatcacgttttgaaaaccatgttttcttgtaaagaaaagcttttagacgacttgttttaaattgttctgttaagtctatttttaaaattcggtaaaagaaatgaattttcgaaaaaaaacatctaaatttatttcatataataatcaaatagacaattaacgataataattggctaaaaaaatcaaaatcaaacagtcgtccgaggtctctgctgcctatctcgtcttgaaaactctccacctgctctccaaactcaagaaattaaatgaatcgaaatggagctgagctgagcatgcatgcagatgaaagccaaaacgatgcagacaaacactagca

SEQ ID NO: 43247 - DNA, 1501 bp, Oryza sativa
tgttgtatcctctttttccaggttttaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgacgttgatgtgcttttcacttttgataaggtcctcatcaagaatgatgtcagattctccacacacagacacacaggtttgctcttaaatagattaggttgtcttccgtctcaaagttcattttattttctgatcatgtatactctagatatgttttttaagtatcttttgtcactcttgaattagcttggtgatataaatatttttggagttttctgaaagctaaaatcactccaaagagttaatcaaggatgagtacttaattatatatacgaggtaataatccttttcccaacttcccatatcttactcaagcatgaaaattttctaccattattatataatagtttgacaccttagttatgatttccttgctatcagtgataattggactatatttgtagatgtttaaaaatataaaatattgatgtttcagttatggttattatcagttttgtaattgtaaagtagtcatcactcatcacctaggtttgctacatgacttgactacattcctgatcagctatgcaactacaaatgcgctcctaatgttcatcgcatatttatacgataagatatgcataataattgctacttccagttaaataaacatttcttaccacaattatatatgatattctagcaccttatccatgaatcaattggcattcatttgcaagattaactacagaatttccaaaactgagatcaatgggtcaacgagggaagcggtactaggaaaaatgtcatgctgaataaaggctatcaagttaacgaggacagcagtatgacaccttacttacttttctactgttatttttcatacatgctatgttcataaacacatagtacataattttgggtaattttattgatggtgtatatttttcattttccagtaatgtttagtggccttcaattttgtttattaatacttgctctatccggtcaaaagccatatatttgagttgtaattctgttagttgcattggccaaccactgctacctggggagatactccatcatgtaatatttagttataattaccactgtatatactccatcaattatatggtaataagtagtttttttcttttttcttctcaaatgttatgcacatattgcatgtttaaaagttatttattatgtccgcagcaacgcgcggggtattatctagttaatcatcaacttgaccgatcgaccgagacagcagcaacatat

SEQ ID NO: 43248 - DNA, 263 bp, Oryza sativa
ctatgacgtggacagtcaagaataagttggattgtgtcataggctctcgggacctcccattatatttgagagatgaagtgaataattcaagtcatcaaagaaacataatgaaacattcgacgcctcgagagaagaatattgaagacattgctgggcttttagcctgccagtcaacttcagcctgagatgtgcccgtcaaaccactcgaaggcggcgaccagatgtgttacacattcaggagacttgacaaaaatggctaaaga

SEQ ID NO: 43249 - DNA, 1501 bp, Oryza sativa
tctaaaattcggaattaaaaataattaatatatgaagaagagtccttatagaactgaataagagaataattgaaatttagaataaaaataaaataaatttcgaaaatagaaaaataattataagagttcaagtagaaatacactttataaataaaaaaatatcagaataaaaaaatatggaatttttttttaaaaaaattaatcaatctagaactcaacgacaacaaataacagtaaaagaggacaagtaataggcatgtaaatcagtaaggtggtgaagggttgatgggacatctaaaaattataaacaaaaccagaaatagaaccccaaggatgattaagaggtggaatgacagacaggacattaagcagcatagtcatgacagttggcgggacttctataaagtaaaaaaataaatcgaaataacaatcatgttttatttttaaaatctcaatgataataaataggggagacaacgggcagaccatacaggagtatagtggtgtgaagccgctcttctagaaattaaaaaaatgaatccttaaaattcgaaataaagaataaaataaattttgaagatagaaaaataattctaagattttaagtaggaatacactttatagataagaaaatatcggaatgaaaaatatggaattttcaaaaaaaaaaattaaagtccatgtagacctcaacgatgacagataataataaagaggggagaaacattaggcccgtaaaggagtaagttggtggccgttgatgtgacatctaaaaactataaatgaaaccacaaatataatcccaatgatgattttcttttactgaaataatcccaatgatgattaagaggaggaacgatagacaagccgttaagcagcacggtcacaatggttggcgggacttctagaaagtaaaaagtaaatcgcaatgacaatcatgttcgatttttcaaatctcaatgataataaaaatacatgagtatagtatggcgaagccgacggcggttgggcagatttctacaaagtaaaaagatgaaccctaacgataattatgttcaatttttaaaatcctatcaacaattaatatgggagacaataagcggatcatagagaaatacaatattgacgtttgacaacactcctaaaaattataataacagaacgtgacgagacaatggactctaaaaagtagaaggtgtattttttaaggtttaatggaagataaataaaagccgtgatatagatcgggtaaacaaataaaggggtgataaaagagcaagagttaacgactggtgtgacttttaaataaaaactataaaaatttaaggatgataaggttcggtcttttaaggttataagacaacataatggctatttaataaattttaagtaatttcaaatatagaaaaatagataattttacatgtgtgctagcttttgcgcggatcacccagctagtttagaaatatttgaatgatatacaaacaccaagagacatctc

SEQ ID NO: 43250 - DNA, 1501 bp, Oryza sativa
gcaaaataatgggtgccgaatccctggaaacaatcttgacgacagggacgtacccggaataaaagagaaaaatatgagcaaaaaggctcaagaaaaagaaaagttataaaaagttctcttggttattttgtgctaaaggttatttgagaaagagtgataaatgcaataggtatatgtctttagtgtttattattcaacctatgtgcttgttaagatgttgcattacaaatcgtatgaaatcatgaattttgattgttgattcaagcttaattgtaaaatctttggttcatggttatactttaatgcatgcttgttctgttatagatgggtttatcttctttttattgcaacacatgacttgatatgctatatgtatgctaagctcttgaacattaatgaacataattcctatgcttgatgaaatcattgtcaaaagggggagaagtaatgtgaaatttatttttggaattttggagaagcaaggtgtattttcggagttgttgagaagagcatgtttttggttcatgagggaatttctttcttttaataagggggataagttttctttttgatttttgagcacgatgtgtacatttgtacgaagtgtgctttttaccacttttgtttttatttttccaaacaccaaaacatttttgatgagtttgccaatgtgttcatcaagggggagattgtaaaatcaaaggtgtttttgattattattctgtgatgaacaattggacattggagattattggttttgttatttggaatttattcacgaagtggttttggagatgattggattcacaggtgatcgcaggattctatcattttatgtgaccggtcagaccggcggtatgcgcgtggtcagaccggccagcccgcggtctgaccggccgacgctgtgtcggtttcgggttgtttgtttggatatccgtgattatttcatgattatgacttctagatggatactatacgtatataatactgttgtttgctactaatgagtcaagttggagatagcttggtctcggaatatggtttatttgtttatttcatatgtaggtgactcgatgcctcgggagagtatttgcggtgatggaccgggagtcggcttggggataagacaacgtccgtggtggtcagagatcatgcgggatatttaggctagagttgatgcacgtggttgatggagatttcatatggcatacgatgaaggtattgtgtgcgtatgggatgcagagtcgaatttggaaggagtccaaatttggtatgattggttatgtaaagtttgtttcttgtactagatggtttcctaaggtgtttaggactcttagtatgagtttggttcgtggctttaggctgcctacctcatgtataaatagagggggagcatgaggcttcccggtatcgcttttgagagcaattgagttgagttttgagttagggtttcgagtttagtcgaaatttttgtaaggagtgctgttggtgcactttgtaa

SEQ ID NO: 43251 - DNA, 1501 bp, Oryza sativa
ttgttcgccggcccatcgtttagtttcctccaaaaaaagatgccatctttttctcctcctcctcatcgaatctatgcgtactactgcatgcagcttcgccaaaaggacaacttctgaatattgtaaagatcgagtagcagtagccggatgatgcatggtagtattaaaaaagacatgtgtgtgcaacttacttctaaaattttgttaatgagctacacatgcggccatcttagcagaaagtcgaaagggaggaaaagccaagagacaaataaactttagttgtttgaggagagaaagatgtcaatgccatctcattgcgaggctagtttatttagcgagagagagaaaagggagatcctagataggatcaaggcaagggccgggggcacttgtgggagaaaaatgatcgcctgcatgtgtgaagaatcttctcccccatcaccacccccattgctgatcactaacagttggggcgttttttcagcaaagcaatcacttcggtgacaaggatgagctgttcgtctgcatagtttatcattggcaaaaacactagctttaatttcatctccggtcagctatctaccacggcatcaacaactatatatatatatatatatatatatatatatatatatatatatatatatatatatttgcattcgtatatacgtggcgttttggagtagattttttttagtgtgtatatatatgtatttctagataaataaagaagaatgcgtgaactgaatttccatctagctgccaaactcctgtcaggacaacagaaaagaaggcaaagaggggggtcgagaggaaattaaaacgtacgcagagactaatcaaagagggtcatcagcttgctaatcaagttatgatgaaggtaatggacagtgctccattaattgcgttggcgagatcgatttggcagagactagccccctcatgatcccatcttaataaacccccaaaacaaacaaacaaagccttgataaaagctgcccatccaatgagtatatgagacacattcccccttcaaaaaaagggggccaacacccacacaccgatgcaggcacaaaagcaaagagatattgacaaagccctttttttcatctcaccttgcacacacacacacacacacacacacacaacccctctctctccctggcttaagctatatatgatcccctcatgccccagccctttctacaacacaaacacatacacacacaatgcaccttcacctttccaccccataaagcctcccttggcacccctatcccactaaggagcaaaaagagaaccaaaccaaggcagctgctgcagaggcagtagtagtagtagtagaagtagctgctgtgatctagcctcttgtggtggtagctctagctctagaagtggtattgtggtgataagcttaagcttaagcttattagtgatcctctcccttaaaaagaagaaaagctccttgcagttatggcactggtcaagagccaccaccaaa

SEQ ID NO: 43252 - DNA, 1501 bp, Oryza sativa
acctcatataggagaaacagattggtttcagaggtatcattttccccaatgccatactgatctctgacacccagttgattattttctggatcgcgttgaagtttgaaatgcttattgtgtttctatgtcagttgttgaaggctagagttattttactttcagccccttgcttgtgtaaaagctacagttgcggttgtggttttagctgcttgcttggctttatcgtcagtatgttggggcctcactcttactggacctgctttcttaaccccctgttatttcaatcttaagattactagaatgaacatactggcagaaatcttagtcctcattaaacatttgattcttccatgaccgcagttttttttttatcgtgcaaagttgcaatacctcactcttttttgtgttacatctttcaggttgccaaagagaacttcaataccatcctaatacatccagataaattccgggagatacttctagacaaggtatgttctaatgtcagccacgaattctatgttcagttcttggccccagcaacagaatttttgcctcaccatgcattgttccttgcagatcggattcaggtcggtagaggtggttacggacaaactggagggcgctgttactggttttgaccgcccaatcgaagtttaccacaaagtgatgggaactggatcaagttcttgacatttcctgccaaaggcatatgtggtgcttcagatgtgcagcttgttttagtgggattcattgagctccatgacgctttcttccattcgacaaacttcaacgatggcgccctcacataccgctggatttgcatttgcagaagactatttgaacgcccaaggaatgagatgggtagattggaactgttggtacgtcctctttggaagttttgacattttgtaggacgatcgatcggtttccaaaaaaaaaaaaaacattttgtaggtcgaggcagttttgcctgtgtaaatgaatggtggatacgtacgtatgaaaaatattgttcctcgaggaaaatcacatctcgtttgctagtaatatgaatattgtcactgcaagcacaatttcgatccaaaaactggagcgggcggcctgaaaggattggtgtatatcggaatcggacggagtcgttgagtcagcctcgagtcatcagattagcaagtcagttattacaaacttgtgatcgcgagaaaaatcttcagaatccaatccaataatctaaggcgaaagagagagggatcaatcttgagatggagcggacgttcgtgccgctgatggggcagcgcgagtatctacggtggatctgggtgccgccgccgccgatagacgagtgggcgacgagggaaactttgacggagcggatggagtaccaccggaacgtgttcgcgcggcgggaggcggaggagaaggagcgcaggctatccaaggtggtgagggagagcacggacgccgaggaggtggcgcgcgccagggccgacctctacgagcgcgt

SEQ ID NO: 43253 - DNA, 1501 bp, Oryza sativa
atccttgggtaggttcacatgaatgtaactaattatgccataatttaaatgccatttgagaattttagaagcctgagattttataattctaataaaggacatgaactttgtttgtgcccacctttctcttggtaatgatttagtattaatccatcatgtaaagtagtcaaacagtcaaagaggtggacatttcagctatgctctttacttgttgaccctagacttgcttctttgattttggtagttgttgtcgcaaatgtttttacttgctagcattttacaaggtcttgagatgctgtctatgctcatggatagcagcttccttgcctattctttattgtcatatgagctttgtttacgatatgttgactttgcttcgtctccactgcagtgtgactcggaattattttgagaaccttgttcaagcactggaggctggcttggaggatgtacactctactgcccagggtaccacatcaagcaatgccaccaacatcccctccaagaaagcagtcactaaaggcaaaacaaagaagcagcttcctagaacatcttcggacaactcagatgaaggctggccttgtgagcgctgcacgtttattaacccttcatcggtggatgcatgcagcgtctgcgataagcatagatactagatgaaaaactggctgaaagccagtgccccccataaatctcgaagctgttgagaaggtgggtgcttactcaaagctcatgagaagattgttgattgtagttctgttcctaaattatgtggcgttgaagaagagcttccaatggcagcaatggcgtacatgtgtgagtgaaggtccctggttgtatctagattgcagcaacaatgcaggaccgactatggagcgaaggtggatggggtacaaacatgtggtagtcttttttttttttactttctagcctatattatgtacatattagttatggtctgtagttgtgttaatgtggtgggcaatgttctgtttttgtttaaatgacatgagatgatgtggtgggtaaagttccaccccctgtactgaccaacctgtgaagctggagaatggtagatgtagctcttatctattgagcggtcatgtaaattaccaaagctcgtcataatctatggttgataaatcatgtgggaaactggtgtttactcagcagtacctgatttcttatagattcgtcgttcgagctgcatattttgatggatggaatttttgatgttgtgtgcatattatagcaaacaaaaatacccatttaccgaaagagtagcaaaaccggtacgatccccatttcagttccatttctcatttcacaatccaagcgcagcatcgcatcgtgttgccactccaatacatttctctaagttggtcttgtatctctctctagttatccctgtctggtgaaggtgaaagatgtgcagtttataagccttgatgaaacaaagttgatgagattgttgggcatcatcgatcatcagggagtaagagta

SEQ ID NO: 43254 - DNA, 211 bp, Oryza sativa
gttcccctctagctgacgtatccagccaagggtgggcgtgacggagtttggatgggccctgtgacggcctatgcggcttccggattcacctaggcacgagagggggctgccctctgcatgttgaggagtgggggcgaaacctgaggtgtggtgcacttggttagaggtggttatgcgaagggtcctgtcacaatctctttccagggtacca

SEQ ID NO: 43255 - DNA, 1501 bp, Oryza sativa
catgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattca

SEQ ID NO: 43256 - DNA, 1501 bp, Oryza sativa
ctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtactagggggtatcgccccgggtggaccactcggtcgggatgatccgagcggtcgaacttaattgctatctctgaccaccgaagatattggggcatgttaggctgaaccgcatttatctcccgttctgtcagcttttgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctctgcgaactgtttgtagacgaagcaatctttggccacgtggttggagttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgtttttttttta

SEQ ID NO: 43257 - DNA, 1501 bp, Oryza sativa
cgatagcctgctaatgctagttggtaatactccagataatgaattctcactgagatcaagaacttctagacttgccatgtgctcgcaccaaccagatagctgtccagttaatttgttatcagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatgccatgagtgtagccgcccatcaggatccttgatactggtgttgaaggcaaccaaagcatccctctctgtggagatgcacgcagctatctccctgaaattgatggttaagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcc

SEQ ID NO: 43258 - DNA, 1501 bp, Oryza sativa
tattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattg

SEQ ID NO: 43259 - DNA, 1501 bp, Oryza sativa
ctagattattgggtttgcaggtctaaagagggagtggagtggcatggtgggtaattttttacgcaataatctagaaaaagctcacctaaatgagcttattagattatataagctgggctctagattataataaactattttaataagttgtctgtttctttcagtttactcccaataatctagattataataatcccaagctgaaagaaacacggccttatgcaagtggagtacttattagaaaaagtatgcaagtatttttttattatattttagacacattgaaatttatatatgttttcatttcaatgtatccgatgcaaaatttgtgaccagatgggattaataatcaattatttttccagtcaccagatcagcacactgacccagcctagatacatataagcacagtacaatatttttcgtttcgatggatgatgatagtactagatacgaaatgggatgccggccggccaatctcaacgctggcatgcaccgcgcgcggcgaggcattgtcgaagatgaggctgatgggcgcgctggcggcgtacgtgaacaccaccggcgaccccttcacgatatgcaggccgtcgttgacgaggcagagcccgtcgttgccggcggcgtggatcttgctccggtcgacgccagccggcacgctgcacttgtgctctctccgtattttaatatatgacgccgttgactttttgacaaacatttgatctttcgtcttattcaaaaaattatgtaattataatttattttattgtgacttgatttatcatcaaatattctttaagcatgatataagtatttttatatttgcataaaaattttgaataagacgagtggtcaaacgttgattaaaaagtcaacggcgttatacattaaaatatggagggagtagtttattagtgccacttctgactactgatcaagcggaccatgttatctgtacccgataaaattaactaaatagtatgcatgcataatttagattttgcctaagcacttaccatgatcaaagttagcttcttccatttactgtaggaattctataacgatattgtactgtgattgagggagtactaacattgactccggtactcatgtaccacaaaacttcaagtgtaaaattaactcacacatcgtgaagtaaatatcatcaaattcagcatataatactatcgacacataaatttgtcttttttttctcaatgtacacagtttctaaaacacgatttccggtagaatgatgatataacataccagccacttgcactgtacttttagaaagaaaacaaatgtgtagaatttaaagacagtggatagaaatccagtctctcaaaatggatatacacagccacgtagaacaatatatcttcactcatcaggggattgaattaaatccatcgccgtaatcacgaagatacaatcaaatcgctaattttgggataatctgatatatattgcccagatatacatatatgctcctccaaaa

SEQ ID NO: 43260 - DNA, 1501 bp, Oryza sativa
tactactcatcaagccaaactatgatatactcatgatataagagattttaagttttttttatattgtttgaccactcgtctttttcaaaaaagcttaaagtactttggataataaaataagtcaaaaaaataaataataattctaaatttttttttgaataaaacgagtggtcaaacagtgtatgaaaaaactcaaattcgcttatattatgagacggagggagtatattcgtgtaaataatctggcaatgcaatgctaactacgagttggtggcaatcgaaatcgagttggtagcttaggtttcaatgcaggagagagcagtagtaaatcgaggtaggtgagagtgatcggcaacaggagcaggttttagtaattaaattcgtccaagctctttataggctgctagtgtttgtctgcatcgttttggctttcatctgcatgcatgctcagctcagctccatttcgattcatttaatttcttgagtttggagagcaggtggagagttttcaagacgagataggcagcagagacctcggacgactgtttgattttgatttttttagccaattattatcgttaattgtctatttgattattatatgaaataaatttagatgttttttttcgaaaattcatttcttttaccgaattttaaaaatagacttaacagaacaatttaaaacaagtcgtctaaaagcttttctttacaagaaaacatggttttcaaaacgtgatgtaaatgatccatttctaataatccaacgaataagctgaaaagatcggcaatgcatatatggctcaaatgacggcagtttgcgtacgtttgtatgcgcccttggacactaaggttgattaattaattgcatgccagcaacacttattatcaagaactttttcgcgttgatcatgtaattgctcagtttgaccaatcgttaatgggatcttcaatatgacagtaacagtttgtgcatgtgagtatcaagttgatgagggcaattagcagaatcaatacgtgctttcaacgtaattttagtagtggctagattgtttgtctcttacaatatatgtgaatagacgcatttgtaacaacatggatatggtgttacgtgtatagtagtgacggagacagtgccctatcaccacgaacgggtgcccgcgctccatgcatgccacaacacactactcccaaggtatatgcagcgttatgtaccttgcatacttgcctcataggttctaattaatggagattaattagatgataaatcagaaaacgagaaagcaagggccaaaccatcaagctgtagccataaaaaacatcaaaggccaaataggttcaaaacaatataacttactagcacctagcacctatgctcaatataatactagccttaaaatctaatttatctgcaataacattaatcttatccaggcatcagaaaatttctagatccgtaacgggtgtgcagtggtgtttgcgcgagtacgtgtgccgtgtaatc

SEQ ID NO: 43261 - DNA, 1501 bp, Oryza sativa
tgtctttttcttgacataaaagaaaatgttctaacatgaagtaaataattatataattttttttgaatgtgacgaatataaaactaacgccgactttaccttctaaaaagaagaacagttttgtttttcttgtcattgtgggtgcaaaatatgttggtcgattggtattgtctaataacagatacaaatatgtgaaggggataatccaccattttctctcggggtgacacgcgaggcgacttaggtcctgtttggttccatgggctaaacattagcccctaccttttagctctgaattagccctcgaggatccaaacaggtgggctaatttttggctcaagtgaattagcccctccaagggatgctaatggggctaattttgtgtggggaccataaaaaagcagctctctctctccttctctctcctcactttctactctctctccaccttttagccttgaattagcctatggatccaaacataccaccttaggctaatgtttagcctaccaattcatgactaaatattagttctcaaaattagtcctgggctaatcttccaaacagggccatagtgtggagcgtaggttcgccggcaactgcggcgcctccttctctcatcctttatccttcctccttctctctcatccccttcccttcctcgtgttctactgcttctcctcgcttcccaaatagacccaaggttacgttcctcaagagggtggatacaacatagtaccagaaaaaccattttcctaaacgaggtactaccgtatttctaggtgaactaaaaatgtgccccatcgatccgtctgtaagataggaaggaggggctagatggcagaccaccttagaagatccatcttcccaggtggagcacttaagtggcccgcacggaaagaaggtcctatatatattgtgcttcctccccccgagtttcccaacagttcatatggagtttctctctctgaaaacaagaaatttttttggggggtggggaggtttgaactcgaaattcggtggatttttctgccgtggttagatccgtgcattccattaattcttacaatttttttattttttggccttattagtgatggatctatgcatgcaaaaatagtgaaagcaccatgttttgcatgcaattttttttcatttttatgatttgttatgctatgattgtggttgatctatgtatacaccatggtgtcatgttattctctcttccattgtgcctaaattaccaaactatatgtatattgctctttcccagtcacctagatctagtgtagagagagaaaaacatcttccttcaaagagagagaaaatatgtattgtccacactccccacataataggaaaaatttatgtgttgtagatccccatcccctacttatttatatttctctttctcataacaagcacagtttagtttggttgtaaatatgtactattatgtcaatttaatttataatataattgtaaatgaattgtttgcaga

SEQ ID NO: 43262 - DNA, 253 bp, Oryza sativa
tatcgcaacaataaaaataggaactctgagtgcacatttcagaaaacaaaattaatagtacacacatacaaggtctgaggttttctctcacgtaattccgcccgctttgacttcttcctaatgcttttgtgctagtttacaactgttaggttttatattagctcaagggtaattttatcattcttgaaaaggtataggaaggtaccacattttctagcgtaaaatttagagagattttaccatccttgaggga

SEQ ID NO: 43263 - DNA, 1501 bp, Oryza sativa
aaatccgtgtttattttgacaggaaatataaaccgagctgtataccagtttcagttccattacgttagtctccagatttctttagtttgtcactggaataattttgcacaattaatgtgaaaaactgcatcaaaaatagaatatattttttctgcgagaaaacccttagtatactaaaatataaggtctatatttgttaacttctactccctccgttccttaatataggacgtggttgttgtagttgcaaagaccaataaaactgtttaaatagcagttatgctgactaattctctccgttcgaagagcgacgtttcggttgttgcgcggtagatacgctagcattaaccaccatgcatgcagcatgcgctcgacctgcactttccgagcgaatagccagcatgcatgcagatgcacatgcaccgagaagctgccgccttgtattatggaatccagttgaaaagaagttacgtcctgtatttaggaacggagggagtactaatagccaaactaacaatatattactccctacatgttgataatacttatcgtttaggataagattaatgtcaaattttatatttgactaataataatttctaaaatatttttcttatagactaccagattaatttaaaaggtattccaataaaatatattactatatatgttacaatagaaaatagtgataaagatattttttaggggttgtgttcttatttatttgaaacgacaagtattattaacctggagggtaatcgtattttaacaagtacgtctagtcacgtagccaagatctcttatattttagaatagaagctatatatatttagagtcatttatgccatatgattataatcgtattttaaaaaaactttcaagcgatgtttacattgtagctgtttgataatacattagaacaaatattaattgtgaaagagtaatataagagatcatgtagaaaacaatggaaatttactaattaaataattttgaaaaaaatacttatattttgaaaaagggaatagaaatttactaccgcgtttacatttccttttcttaacttcatacattaattattttagatatatttcaattgctttcgataattgatagtattttctgtgaacttttctcaaaccaaatcagcataaatatgaattttattgctgtgtgctgtgtggtgagctgtgaaatgtagagtatcaaccacaaaaatttaatgatacctcaccctccaaaaaaaaaaaaaaatcctcgcccccaaaaaaataaaaaaattgcctccaatgttccgttgcctcctatgcaggaggaggaggacgacgacgtcacggacacctcgcacttataaatgaggtcgcgatcatacgagccgaaacggtagatcaattcgtcgaacatctcgcgcgcgctccagtgacggcgagaacgaagcacgccggggttgggagagagatagagggagagatgggggaggccgcggccgtgtccggcgacg

SEQ ID NO: 43264 - DNA, 1501 bp, Oryza sativa
ttattcagtcatcacccgttttcacaaatatccaagatactgcatatattcgccatttctgtgtgaaaacatgaaggatttgactatgatgccaacaagtaaattatcactactcattttgctagttgagatatatcattttttaagataatagttgagatatatcataggttcaatcgttcaagttcctttccttttgttttcacgaaatagatccaatttctgagttttccttcaaatctaggaaatgttgtaacctactcccagttatttttttcggcgttcctagcacttgttcttacagataatggtgtgaacaccatggaaaaatgctgtgaaacaaacggattaacagagggcctgagtacgccaccaacaaatcacccaaaaacaaaattttcagaccgagagccttcggtaaactgattttgacggcaatccactcacaattgatcataattgagtgtttcaaaatccaatagaggtttggcccaagaaattgatgggccggcccaatgcacgtcaacttcaagtccaacatagtattatgcaagtgaaaaagtatgcaaagtatattttaaaatttttatgcgcattgaagtttatatgttttcatttcaatgtatccgatgcaagtatttgtggcaagagggaattaacaatcaattattttttccattcaccagatcatcactgacccagcctagattacatatttaaatttaagaagatgggtttggtttcgatggacggtgatacgaaatgggatgccatgccggcggccggcggctagccgagctcaacgctggcaccgcggcgaggcgttgtcgaaggcgaggctgatcggcgcgctggcggcgtacgtgaacaccaccggcgaccccttcacgatctgcaggccgtcgttgacgaggcagaggccgtcgctgccggcggtgtggatcttgctccggtcgacgccggcgggcacgccgtcgaggcaggacaccacgacgtcgccctccgggcacgagcactcgttgccgatcgtcacctggaactccggcaggccgcccacgacccgcccggtcttcaccgtcgcgatggtgatgtccgacgggtcgcacggctccgggtcctcgccggcgacggcgacgtggacgtggcagaggagcgccgcggcggcggcggcggcgaggaggaggagaagggtggtggccttggtcgtcatggtggtgagctagtgattggatgcgtttgcttcactctcttttgtgtgaagaattagtgtagagaatgtcactatatatagaaaattttggaggagcatatatgtatatctgggcaatatatatcagattatcccaaaattagcgatttgattgtatcttcgtgattacggcgatggatttaattcaatcccctgatgagtgaagatatattgttctacgtggctgtgtatatccattttgagagactggatttctatccactgtctttaaattctacacatttgttttct

SEQ ID NO: 43265 - DNA, 1501 bp, Oryza sativa
acatatattcttctattattgtgcgatgtgatggcgcgaataatccatagaactttgaagccaaaaaaagagtggaaaaggggataagagaagcatctcacacaaggcccctttgccctttgtcctgccttttccttttatgaaaatgcacaagataccatattccatcacaagtgaagtgagagcagagatatttttctttttcatgtcacaattttcacaatgtaatatatgcactcgcagatgccatctttagcaatgagcttacaatatgcattatcttttttattatcaagcaaaactatatgagatgtaagtgtgtgaccccctttttttgggtagaaagattgcagtgcatcaatgccactaatgtgatgccttgccattggcctaggaaccccaagaaatcaaaaatctttgtagatagcaatttttttcttgaggtgacatggctagctagtggtggtcatccaggctgtggactgtgccatgatatcctttggaatattttctggtttcccctgtcttgatctttttggaactctggtctcatgttcttcaacatgatattcgagcccgtcagcaatggcaactagtcccccccctctctctctctctctctcatcgacctccatctccccacctccatttcatctctagctatacaccatactttcatgcacaattatacatatctcaattctcataaaataaatcaatcccttgcctagactccaataacaaaagaaaatgtaatacttccttcggtcattagtatatgttagtataaattaaataattaaacaccttaaacaatattttttcgtcgtagtttgatcatcacctaagattttttagtcttttcaaaatgatcatcagctaacaagtgtatctttatttatttgtgcaagaagtaaatgagcatcattgaatgcgctgcacacatgtaatgcaaacaaccaagttaatttttattggtgcaacggcgcgcactatttaaaacgtgacgcaatgcagcgatagagcaccttgatagataagaattaatttcagcatgatgtagattttgttatccttaatctctactcactttgcataggtaataaattaaaccgctgaactattactacatggtttacatgaaaggtgatcgggtagggacgagaatgtcgcgacacacataatatatatagtagcgtccttatgtttgctttgtgtccgcatcgataccgtcttcccactcgcatctcctcacctcctttccttctttaaaaggagagcatcaccactccatcctcaactcccataacctcccccttctctctctctctaactacacactctctctctagctagctagctagctatagctagtgttgttagcttcacatgaagagtaggaagagctatgggcacttgctgagcccggtgggcagcccgccgttggacaacgagtccggcgaggcggcggcggcggctgcggctggcggcggcggctgcg

SEQ ID NO: 43266 - DNA, 212 bp, Oryza sativa
agcatcaataaatagagctgaaatgcaacccccattgctcacaaaccccaagaatttcaccaaaagggagtgcttactctgagctaaagaaagagtactctgaagtctgaagtagtcttacttcttccaagcaatctgaagtctgaaccttagaatggatcagaaggattagctgcagatgaaggagaatacattccaggaaggaacagcca

SEQ ID NO: 43267 - DNA, 1501 bp, Oryza sativa
atgggagaaaggaccgagcgagggctcgaacttttttcccccttgcgcgtcgggcgcccgaggtaaatcattttgaagaacaagttggacggattccattgtcagaccgtatcaatccccttttcatttgttaaagaaaatgttaaaaaaagaagaagagaagtatacctacccgtcccggttttcccccaaacttggctgcactgcagagctcctgttgttgggtgttcgattacagacatctggttcgctgtaggagtttattagcacgtgattaataaaatttattttagctatttttttaagaaaatagattaatataatttttaagcaacttttatataaaacttttataaaaaaacatatcgtttatcagtttaaaaaacgtgcgcgcgaaaaaagagaggggtgagttgaaaaaaagattctgttctttaggtgtaaagttttcgaaatatatggtcgtacatttgaaatattaaatgtaaaataataaaataaattacatattctgtctgtaaactacaagacgaattcattaagcataattaatctgtcattagcaaatatttactgtagcatcatattgtcaaatcatgacgtaattaagcttaaaagattcgtttcgcacatcctgagggcagcaattggttttttttcccatatttagtgccttatgcatatgtctaaatatttgatggcagcaattggttttttttttcatatttagtgccttatgcatatgtccaaacatttaatatgatgtttttggccaaatttttttaatctaaacaaggccatagctcatagctgccctctccctgacttctgaatctcttttagagagagagagagagagagatgagttcttattcccttggcggcatggatgctccggtgagtttctccctaggtgccatgggccctctcctcaggaagctcgattcgcttccggtggctcccgaaatccggctgcctgagccactgaaggacggaatcgagctcctcaaggaagatctagaagaaatcggtgccgccctcgtggagcagtccatggtagattccccaagccacagggcaagatactggatggatgaggtgcgtgacctctcctaccacatcgaggactgcatcgacaccatgttttcgatgcgctgcggcggcgacgacggcaagcccagatccgttcgccgccacaaggttggccgtgtgaaggttgacggtttctccaagacgcagaagccgtgcacgaggctcgccaggatcgcggagctcagggctctggtgcgggaggccagcgagcgccacgaaaggtaccagcttggtgacggccgcgcctcgagctcgagctcgagctctcaccgcgtgttcactgcgcacggccaggttcctgcgccgtgcagaaatctggttggcatggacgaaccgaagacgaagctcaccaatatgctcaccgacgaagcagagctgcatatgaaagtggtatgcattcttggatcag

SEQ ID NO: 43268 - DNA, 1501 bp, Oryza sativa
atggagatggcggagaggtcgtaggcgacggcggcctcctcggcggtgtcgaaggtgccgagccagtggcgctccttggtgtacgggttgcggatctccgccgcgtaccgcccccacggccgccgccgcacgcccaggtactcgctcgacgcgcgcgcccgccgccgccgcatcatcatctgctgcggcgtcgtcgtcgccgccgcagtctcttcctgccggtgatgctgctccgccgcgtccgccattgctgacgtacttagcttagcttagctctgcctgtctgtactgtggatgtaggtggtagggcttaattaggtttttagcagccatggaattttataggaaagcatggaggtgatcgacaaagcttggtggagacgttgcgggctctgcatgcatggcatcggaaagcgtgccttgctccatgttttcctcgacatgataagcccatcatcgatcactttcatgagttggcaatttgtaagttgatcctacatttctacttactccctccgttccatatcgtaattcataagttgttcttaccttttttttttctagtcaaatattttaaagtttaactaaatttattagaagctatactaatatttttaatataaaacaaacatattatcgaaatatatcaatgttatgtttcatgaggctaactcagtgtttgtagatatagctaaattttcattcaaacttaatcagatctaaagaaatttaacaatattttttatagttaatgagatcgacatacaacctttatatatacgtttttacataagattaaatatgaaaatagaaatagcaacctaagtgtcatgccattaccatcatcattttatttttcttataaaaaacttggatatgtcattttcatatgactaataaagcttactttcctaaacaataatcgtagtcaaaattaacttatgttaatagtatacatattctaaaattaatgacattcttacacgaccagaagaaaactccctaacccaatcaattcataacatgttgtttgtgtcatctttgaccgcaaattatgcatgtactccctccgtttcaggttataagtctttttgattatggtcaaagtcaaaccgctttaaatttcaccaagtttatataatatatagtaacattttcgaccaagataaatttattataaaaatatatttaattattgatttaataaaactaatttgataatgtaaatattattatatttgtatataaacttagtcaaacttaaagtagtttaactttaaccaaagtcaaaacgaattataacctaaaacagggagggagtatttgagaggtatcatcaacaaaactagaaacaaggttgcacaaaagtatggcgggtgcgtagtgaggtgctcgtgtatgtctcttccgtgtaatcgtaaaaagtatatatacattatggacaggtcacaacatggtcctggcacctgatgttgcacaaactgttgacacacttaactga

SEQ ID NO: 43269 - DNA, 1501 bp, Oryza sativa
taatttaaaaaggctacatatatccgatacgatgtggccgagttaaaaaaatatcattctctaaaataaaaggctataacttaatttgtgagtaattatagcataatcttgtgaatcataatatatactaaaatgttaatcatgagacttgatcacaggctcacgaatcacactacatgtaatgagtttaacgagctaactcggacattttaacgggtcaagttaagtttcaattcgttcccaacttattgtgttaatgagtcgagccgaacaaactcgttaacttaacaagtttttacgaattacttcctccgtttcaagttataaagctttcacattgcccatatatatatatatatatatatatatatatatatatatatatatatatatatatatatatatagagagagagagagagagagagagacctatacctattaacaaaacaactaaaatttaactttatttcacaatccatgattacatacctaactaattatatgtatggatgctatatacctagaatcaaaatctaacaaaaacaagttcaaattcagtataaacatgctttgaactagttagtaaagtacttaatgttaatacctaagtaattgaaaaagtttcatactcatttgaattgggtatatactcaatttcaacaatgatgcccgggcaccatggagcaccaaacaaatttaatatatatatatatatatatatatatatatatatatatatatatatatatatatatatatatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtaaattaactggtgctacatggagtatgggctccaagattcaaattgagtatatacccaatttgagtgagtatgaaatttttttaaatgcttagatatgaacattaacttctttactatgttagttcaaacaagtttgaactttttttttgttagattttggttctaggtatataacatccaaacatataattcgttaggtatttaataatgaattgtgaaataaagtttagtttgagttgttttgttgttaggtatttgtatgaatcaaattcatatagctagatatatactcacaatttgaaaattttaaaaaatttaagagaatttgtgtgttttataccttaccctaccatagccgccacagtcaatcaatcgctacaaatacaagtactgagattgtgacaacaacggaatccccaagctcttcgcaaaaactgcaccaatttttattttccttccaccaaccgagccgatcgcaggaagccgagcgagacgtctttccttcgtctcgccgccagccatggcgccaccaccatcggtcaccgtcat

SEQ ID NO: 43270 - DNA, 1501 bp, Oryza sativa
gtatattatttacatgattatagatataaattaaatattataataaataaacttaacaaatagcttacacaaagcatcttaaaaaaatacagaagaatgttttttttagaaaacatattaatccagtgaagttcatgatgaattgattccacccaccccaaaccaacttccaagtttcttactacgaattactctagttttcgccacttggacactaaacaaaaatacagtactaaaaatgaggtgctctttcaagcttcacttgttctgtggtgctaccaatttacacaaccgtgtttggcatattccttttaagtgaagtacttacatatttttcacatttactacatatgaattaatttatccttccgttctactctctccatcaaaaaaaaaccaaacgtaggactagatgtgacatattcagattcgttgtagcaggatatatcacatctagttctatgattttctttttggaccgaaagagtatattatataagtcatcttaggttggttctaaatcaaaatacttttagtttctagcaaaatatataaacatctataatcaaattaggcttattaaatctacgactaaacatattctatggtacatttattttgtgttaaaaatattgctatgtttttcaataaatttagttaaatcttaaaaagaaacagaggtagatcagactatctaggcgcataggccatggcccatttacaaaactagcccgatgccaaattgagcgggatatataccacggcccatttgaaaagattatgcaacgcaactacctcccctccttttttttccaatttattttcctactgaaaaatggtggttgccggacacggaggcggcggcgggcgttgctgtcagaggcgatgaggctgtccgcgatggatgccctgtggctcaccgctgccgctcatccagcgtgtcctcattttccttcctttaagaaaataagagatttgaaacatgttgagaattaaacaagagagactttacggttgaaaccgtacgtttcttattactgcactcgtgttcctaccaccgtccagcgacgtcgccgtcgactgctcctcatccgccacggtcgctggcgtcaggttcatcccggccgagggccgaggggctcggcgccgacgcgcgctgcctggggccaaagctgtgcccttgcttgatctccaattttgtgttgtaatgtttaattcaagtatcggttattgaatcttcagctcacttggagaccttggatggaatcgtataaggtcagaattgtgatcgaaagacacacaagatttacccataggaaccagaagcacgagtaatccaaatcatagagcccataaaacatggaaatttaactatttgtaactattaagtttggtaattgtctaaatatccttcttaatttatactttttttaccgcttttaagacgtgatttcttaactatttattatttttgcccacgtagcatgccaacgtggtaacg

SEQ ID NO: 43271 - DNA, 1501 bp, Oryza sativa
tacaagttgccgcggctgctggtttttgctgtgtgtgtaagttgctacgagacgtcgcttgattttggtttgatgcgtggccgctttgtacggatcctaccttttttactctccctcgcggaagaatcggagcattttctcgaatttttctccggtcgaatttggacttctctgcgttccaaattcactccgaattcccctagcctgtgaattgcttcaaaaatctgcgcaaagtcgggagctaaatttgcgctttcaaaatgtgaaacccttgtcggaaaaaagttgccatcgcgtttgatttaatttaatttaattttccatgcatttggatcatgtgttctattgaatgaagatttgaactgtgctgcgccgatgctgcacgtttcggagatttcccctttctatcgggtttctgcgtgcgcttgagagagctactgttgcattaaatcgcgttgctacacgttgcttgctagttgttcatggactaatctgctagagctgtgttaatcgattctttcccgtggttgttaggtcttgattaggacgtctaatgacgtggttttgctatttcgggccattgttagattcgagctgtcggtgcctaagttcgtgacataattgggttaccttttcgcgcgcgcgtgcgggttggtggctaggtgatttttcaagccggactttgtgtctaatcatggtacgaaatgggatggatcgtttcgattgcggattttctcgagcatggcttgtttagtcttgagatcccagttgcttaggcctgcctgggattgattaggacgttgatgcgcgtttgacgacgctagactgctaattttgggggtgggattggttgtatgtgtgtagttctagttggggattcggcaaattgtagtgggggcctgtgagctgtgggtcaaattgtattttccaggacaattggtagttgatgtgtgatcttgaagcttcaagcacctgaagcctgatggtgattgcttgtatttgaaaactttggtagtagtaggatataaagaggccaagttggtgttgtaattttcattttagttcgaccctttgatgctgatctcttacttaggtacttactttggagtgattcataagaaaatttaaaagcttattcacgacttacattctcataattgagatgttctcataattgatgatattttgagtttggctcactggttttaagtctagcgtctaagagttatctttcatgtacttatttgcccctttgtcatatactagagtaacaatttaactttttttaaaaacaaatcatactagctatggctgatgaaatggaatttttttgacatacaagtcagatagaattgtgccagatgcaatacaaacaccacatgaatcatgcatgctagttgaccttttggtttcgctccttttctgcatgatgatttggagtgttttcctttggacaaattctattttcaatctacacaacaattattagctactatttatg

SEQ ID NO: 43272 - DNA, 1501 bp, Oryza sativa
ttttgaaacaaaggattgattcttaccaattcctttgaaattcatatggaatggactattgtaaagtaatttttgaggaaaataagcatgaggtcttacctcatgttttgttcttcttgtgtgttgaaatcttacgtttttttttcctgtcactatcaaatagtagttttaaaactttcatctgttttcgaatcccttaggtatccaataaatatgatattctatttctacttttttcctattcctgtgtcagtgaatatgatattctatttttatgatttttttttctattatcatgttttgacaattctgcatttcaaagggcacttagccttcacctcgtttctattttgctttgaaccacaagaaagtggaaattttggttgagcaacttgctttcctccattccgaagtccaaacacctccatatgaggagtgaaaaataaaatcttttatagatcgttgcagtaactatgtcccaattaatgtctcgtgtagccagccgtgaaaacttttgtcaccaaagtaaagtggcaatatttatctttgcaaatgattatacatctgtaggtaacatatatgtttaccaagtaaaaaaaacataaatattagggaagtgcctaatatcaaataaataaaaggggtgaggctttgaatctaggccgactaggccatcatattgtggagctcctaagcgtttctcatatggtcgctaaggaaaattttgataatttgacacttttttcgttgcccaattgttttaattgatatttgtgaggatgacatgtgaaaccatctaagtaaatgaaagtgggtcatgatgtcgaataatcgaaacacatttaaaagagtgttaaactatcaaatctcttgccaaccatgcttaaccaattatagacacacccaaatccctaattacctatgcaattgattaccactcgtataaacatatatctaccgtgcttgtctcggttgagtagaaaaagaaatatatatctacagtgcagtgctatgtacagttcctcaattcaatgtactatcgaatccaagtcttcaagcgctcgcggcgatccggcgcctccgccgaccatggtcgagacagcagaaagtttcaacccaaacaagagacggcgcggcgcagggctcgccagggtggtggccgttcgcccgtggtcttgcccatgcgtcggcgagcgtgaagcagtcggtcggagtcgggagagccttgccgaagaggggatcgcggatcacggggttctccgggcgctcaggaggagggccagtgaacagaggagcattcttcttggacattggttcgaccatctgcagaaagtccaaatgcttcatgggtcagctccgtttatcagcattgagattcgttaatcagacaaaatcatatcaatattgtagagatcctgccacaatattcatctatagataaaaagggaaatttaaaaagtcatttgaattttgaaaattacaccccataaatcattttgtt

SEQ ID NO: 43273 - DNA, 1501 bp, Oryza sativa
gccagatgcagtatgttagcagcgtgtatttgtttgacgaattgagtttgcagcgcatatgtgaaggatggttattgtaatgtgtgaaggctagggatcatggtcacttctgtacatgccacaacacggtatttgcactcttctcatttaatctactagcccataggccccatacaaaactaaatgttagtacatgccagatacactattcataattttgccactgtttataggtcaattttttccatgattgataaaagttcaccttcacatctttttttaatcaacgctgacattaactaactccttaattatttacttgcatcctgtacattgactgagcagttctcttcaaaaggaagaatgtcatcacaaacaacaatgtgggcatgatctactgtcaatgtatgaatactaattgaatatttgttttttttttcatatacactaattgaaatagtactaggaagagagctataatacagtaaggtggttgttcgtcacaaataaaaatcaaggatggttattcaacaaaattatttccacgctgattcggcacttcagatttctactgcttgcattgtatcaatatttttagatgattatattactaatattattgatgtacctagaaattatacatgttatgttgtaatgtgattcgtttgttaatgacaggaattaggaaatatgggaagtggtgtttgatgttttctcatacagccatatttatattatatctggtctatgcaagaccaaattttgcttaggaaaaaatatttgacaaagaaaaccattttgcaagtccaaaaaagaccaggggacttacatttttgggctagtctcatattagccaaagagtcttttcaaaggttcggttccttcttattacaagatggctcacaagtaagattttgggaggattgttggataggagttcaatcctttgagaaggagtatcctaacctctacaatctagttagaaataaaaataaggtggtggccaaggtaatgagtggaataccgttaaatctgtctttcagaagatcaatagtgggaagaaacttggaagcctggtatgagctagtgtcgaaagttgttaacactgtattgacagatcagaaagatcgcttcttttggaaaaacaataaagaaggcattttcacagtaaaatctatgtacaagttcctcatgtatgaagggctggttcctaggaagaatttcatttggaagctcaaaattccacttaaaatcaaaattttattgtggtacctcaaggaaggggtaattctcactaaggataatctagcaaagagaaggtggaagggtagcctaagttgctgtttttgtaactctaaggaaacaatacaacaccttttctttgattgctcaatggctagatatatttggagtgcgctcctttttacatttgggattaggcaaccgtgtagcatgtctcaaatgtttgggaattggctgaattgtgttgaacctaggctca

SEQ ID NO: 43274 - DNA, 1501 bp, Oryza sativa
gggtccatttgtcattcacacagaaaacaaattgggggacccactcacatgtggaccccacttgtcatcctccctgcatccccggtcattcctctctctctccatcccatcttcctcgttcctctcccccctctgtatgtccttatcgctgcgtcaccccgcaacaatgatagccccaacgtcgacaaccatggttatggctaaggcagctgcgtcagagaccaagggagacagagaaggacagccgccgaggccagagcagcaaggagggtgttgatgcgaaaaacacacactggcctggaagatctgcttaactcctgtgcaggtctaaaatcttgcttttaggttcgtgagcgtgccagttgatttgatcctgcaaccaacaagaataaaagacaagaaaaacgagattaaatccataaatgatagccgatcggctaggagccgatgacatatcgtccatcattgagccgatgttattggtgatagatcggcaatgaagaatgaagcaatataaaactaaatctactcgatcggctgtagatattaacgatatataatccttctctcaatgcatattttgattaagtgattgggatagatcgagcatcatgtcgagacagtataaatcacatagatccaaagatacaataagatgacgattatatgaacgtttataacatagctgatcaaatagatctagcatgtatcggctaatactccgataccactctatattaagatattaaaacagacgaacatattaagcaaaggcctaatatactctaatgcaataagatcttgatataaagggtatatttagcataacaatcaagcatataagatatgaaatagctaaatcaggtaagatcggctgaaaccccgacgatatctctttcagttatcataaaacatgctagatattatagttataaatattacttaatagatcgaactcaaccgatgcagcattaagcataaaaataaatacaagatctaggcaaggtgatgaaaacctctaagagatggtagatatgcgatacaatctagattaataacaagatttaactttatcggctgctctctagcagtaaaaaccagccgattgtgagttaaataacacaatcaacaaagattatgaagcatatatgataactcgatgaattaaataaacaagattagagtatcataaagatggaagcactaatcccgagaatgtaaaccgccatgacaagtttacctctagttgaagatcggaatcgatgcagctcaactcgaaagtaagaactcgtcgaaacaaacgaaagtgaaaaagggtggcgatgcgtcgagagtgttattgaaccgttatttctagatcacacgggttcgggtcatatttatacccgagatacatgataggtccttgccggacacaactcttatatctaacaaactctaagatacacataagtctttacggtagacttttacctaaacatatctctaaggaaattacata

SEQ ID NO: 43275 - DNA, 1501 bp, Oryza sativa
ataagggaaaacctagcctatagtgaaagagagaactcattgtcctctacgcatcctttgccgccgcgcacccggatctagccagagccgatcggtgcctctccgtgccctggcaactcatgcttgcaccactcgtgtgatcgtggcgttgctactatgtgcggccttaggccttgcgcccttcaactacctgaacccatgcaatcacgcctgcctaacctccacgctccacaccgactagccacctcgcggttgtgccgtctctctccacatattcatacctccttgttacaggccatcgccccttccgtactacgctgatcgggtcaagaaacaacagatccaaccggagggacattggatctagttgtctttgtgcactagccggccttagcacgagcaccttatcaagtatatgactaatagccaccttttcctcgtccaactcccctgcacaccattttgcctccttggccgcttaagtagtgaccttctccatgagtcacgagagccttatgacgtagtatgatgaaggaggaaaaaaggacgcctcgccactaccattgtccttggctccttgaagccaaatgggctccagctggactgctctagcagtagcgatggggaagaaagaaagatcgaggttgcgacactaggtggtcccatgggagtgacgcacgggcttttatttgtttctatatatttgagttcactataaaacactaaaagattacaccatatatagatttacaaaggacttttgctctaagcgactttagatacctttatttatatagaagaaaacaaagttcttgttgagaagtatgcgagtgatacctgcattttatagttcaaactttgtatatactagttggcaactcggtatgcaaacaagtagtgacgaaggcttttgctttgtatgatacgaaaagggctcctctaacacactactattctctaacacactactattctctaaggtaggtcgctgacatgtgaacccacggctatagaattcacatatcagttactcaaaagttactcaaagttagatgatctatatatgcaggatagctggggtgagatagcagcagcagtagaatacagctgttgtcttcatctcatgcagcttagctatgaagctaggtaacgtacgtagcggcacatattccgattcgcatagcatagcagagtagcaacgcggcacccgaaacacgttttacaccgcgcaaactctcctacaacctgtacccacccggattcctacgcgcctcccataaataattgctacgctctctcccgccgcatgcactaattaaaaagcccacacgcgacgcgacacgcccggcgagccgcgcgagcgcgacacacacagaggaggaggccgcgcgcgcgacgcgagctcgccctctgcgtgcgccgccgcgaggtcgccgccgccgccgccgccgtcgatcggcgcccgatcgatggggggctgctactccgcctacgcctcctc

SEQ ID NO: 43276 - DNA, 1501 bp, Oryza sativa
aagattccttcctctcaacatatatttgtccagagtcgttgtactagaatatatcacatccagtcttagattcgatttttaagtacggagggagtactttagaatttcagcagctgatcatggccatgtcgccgtacgtcgtagaggacaacggcggtgaggtcggtcgagtgccggcaataaagaaggatcgagaaatgttggatcttggacatatgttttgattcaacagtttgtttttgtttgtgggaggggtcggagaagaaaactccgaacccccaaggccctaggttctcctcgatcgctctccgctgcgcaatcaccttcaaggatcggcgacttggataattagttctctacgctgctccactatcctttttgtaattgtacatcgtgccttctgctgagaagagaatgtctgaattttctgaattcatttttttttggtagtgttctcttgagaatgttgttgttccctctgataaaaacaagtgaagtttatgttctgaactttttctgtggcggtcagtctttgttgcaagggactgaaaatactggcaacaaaagaagagtgaaaaattctgagagaaatcattcacaattagccactgaaatgagcaagggcattgcttgctgcaatataccaaaacttcacaaggtttcttattgtctctttctgcaggattgaaatatttagaaaaaaaaaacatcataccaggtcacagcaatgtgtgaccaagtgactggttgcgtctctgaagtctgaagtatacgagtcattcagagaaactacatccatacatcggtacattgcggggaacagacacaaccgggggtgttaggaatccttgttctccctgacgtgttttaggatgtgatggcccccaaccgattactattagcttgctagaaaaaatgatcgtgcgttgcaacgagtgaaggctgttgttatatgatttagttaaggtgaaatttactgtgagaattcacttggatatatatacttttagaaaatcatgagctgtagttaggagtttgttcatctcaagttagcatgcgagtttttgtaaaaagatttcttatacggatatgcatttctaaaacaaacttaaaaaccgactcaaatacgtatattgtatatttctaaaagcgaacgaacttagaaccaactcatacacagatgacatatcaaaataccggcaaaaacatcttcaatttgttaacagtagagagtagagaagagatagagatactcgtggatgaaaatttagatacttgtggcacgtttttcaaactgctaaacggtgtgtttcgtgcgaaaactttctatatgaaaattgttgtaaaatatcagattaatctattttttaagtttgtaatcattaaaactcaattagttacacgttattattacctcacttggcgtgaaacatttaatttttatcttcatatataggagattcaaacaccaccgtgagggggggggggagtactggtacag

SEQ ID NO: 43277 - DNA, 1501 bp, Oryza sativa
gctaatacaagctcccatgcatgccatggggtccactagtgctcaacctatggctgaccaacaagccttcatcttgctggtgagtaagttgccaattcagctaaaatataattttgatagttgtccaaatacagtatcaatatccagctattgtacaaatccttctagctcttcacttactctttgctgatgtgtatccttttggaatcaatagtcagctacacaattaaacttgctcttagtaaaacaatgttgaaatcagggaagagaaaatgtactctaaggcagatcaattgttgaacttactacaagacaagagaagtccctcccatgatgtccactgcaccattaacttgtatgttgcttatacaaacacaccacatcaaactacatagattttgggcctcttcatgctattttcaactttaccgagttttaataaagttactaaaaaaatggctacatttagtttgctgtcaaattttgataactatataagaaatcctgccaaaattttatcaagttaccaaaattttgacaactatgccaaaattttagcattggtaagttttttttcatcaaagtgaacaggcccttttactccgtaatttacacaactttattgcaaaatatcagagataatagtcatttctagaagaaaagttatgtttattttctgatatttatcatttaatgccaaagggatatgctagccacatgcaagtttgtattctttcatccaaaagaggagaagatgatggccatgttcatccctactctcaagtgattatgcttttggaggctttcggctgcaggagcccacacatggcaacagatacacgtagatcaaacaagacagtgccacatataccagacaggtgggtcctggataaggcagaaatcaaaacgtcgacaccatccacgtgtaatgtatggcgatctgaattattttaggaaagcaaaaaatgtttatctgctttaatttgctttcactctaaccagtgatttttttgatggccgccttggcgccccattggaccataaaaaaagagaaactattgtgaaagtaaagagatataaaggagagactaactaactccactatggtgagagtgccgacaaattgtaaaaacagacactaagagataaagcagagtaaaattgttctaaagcatatagcatgagaaatgcatctttcattagaaaagcaaaatatttctttaacattttaggtgaaaatgtctacttataggcacaatttaattgataactatattttgtttactagttaatattagttgctaatatttctttcattttaaaatataagggatttcagataaatgtgatatatcatattactatgatgtgtcatattcacctaaaatctcttatattttttgacggagagagtctgactctcctagtcccaaaaaactcaatctaagagggtcacatacaacaaatctagattgcctagattcattatattaggagggga

SEQ ID NO: 43278 - DNA, 1501 bp, Oryza sativa
gctgataattctggaaaaagggatttaccattatacctaactctgccatttccacagtgtgctgcctgtaataatctccatgtcacattaaacgtgcgcgcgtgcacaccagtaaagtgtctactcagcttccaggattgctagcaacttaattttgcaagcaacgaaaaccagaaacctggtgcatacaaattctgagagtccccatgtgcgattgaagaatatttattttcttaagtgattgcaaacacagtccttcacattacaacttgtgattcatgccccgtaatggaactgaattaacctcttttaaaagaggatgaatgattaaaccgttttttatacattattataccttttcttgctcttttgggtatgataaataattgtggtttctgaaattatcaggtattttttatcttatagtattcagggtctatttcaaatcatcatgtaacatcggaattcaagttatgtcacagcctgtgctagaatgaagtcctttcgtactcaacatttaccaatataagtacatatatattctgactcgtggtactttttaccaataacaaatggtagggcgccgcgaagcgcgcctaaagttctagtattgtgaatttgcgacgaaaatgtttcaccttactgaaacttgtggatgattatgtgtctgaccaagcggttcgagatgtgaaggttttggatacattctaatgaaaatggttcattgcgtactctatttttcccagagaaacatgtggctcaatgtaaaatttgcttaaattttaaacctctgaattaacagtatgtaatacagtactacgtgtctcccacaggtcaccaaaggcaacgaacctcacccatttcggacttctacccactctcctctctccccttccctccctcctccctgctgggcttcgggcggcggcggcggcggcggtgggggtggatggcctccgcggcatcggcgccggcgttcgagaggctggccgggatccgggcactggcggagtccggccgcttcaaggtaatagcccccaccaccattaattaagcagctttgcgcggaattactgctgcttttgctcaatcagtaggccattgattattcgtgggattcccagttctggaactgaatcacgcggtcgattcagttatggatagggaacggggggaaatttcgactagaaatttattcctctgcgcgtagcatttgccactaccactgctgctcgtttgtttatatctgcatttggctggcttgcaggcgtggttcctcgatcagtttggtgttcttcacgatgggaagaagccttaccctggtgccgttctcgcgtgtatgttggtatacagactgtatattgttcagtttatattttccccttcgttgatgcaatgcactgatttaggttcattttggctgttgcagtggagaagctcgctgagaaaggggcgaagatggtaatcattagcaattcgtcgaggaggtcgtctgtaacca

SEQ ID NO: 43279 - DNA, 1501 bp, Oryza sativa
aaggagctaccaatgaagattgttgcagaaccgtgaaatgggctttacggaataaattgttgtctaccgtcattattgctttccttccgagagttccctttccccgtagtctcccttcatggcgtgattcaggtaccctgattgggcgaaggttttcaataaattttacgcaaaattcgatgacctcctctgttccataccccttggcgatgcttgcctctggacgagcacggttacgaacatacttcttcagaacacgccatgtacctctcgaaagaaaacatgttgtgtaggtacacatgcccgagaatactgttctctttgacaaggtgacaaagcatatgcttcattatattgaaaaatgaaggtggaaatatcaactcaaaactgacaagacattgcaccacatcattctgaagggcttctaatctatccgggtcgataaccttctgcaaaattgcgttcatgaaagcacatagctttgttattgttgcccggacattgtctggaaggataccccttattacaactggtagcagttgtgtcatcaacacgtgacagtcatgagactttaggtttatgaacttcttctccttcgtgcttattattcggttgatattcgtggagtatccagacagtacctttatgctctccaagcattcaaacatactttccttctctgccttgctaagagtgtagctggctggactcaagtaatggcttcctttctcctttggttccgggtgaaggtcgccgagttgttccatatgctttagatcattacatgcttccaatgtatctttcaactttccatatacacctaggaagccaagaaggtttacgcaaaggttcttagtgaggtgcatcacgtcaattgcgtggcagacgtccaagaattcccaatagggtaactcccaaaatatagagttctttttccacatcgctgcgtgaccaccttcgctctctataggctggcttccaggcccctttcagaacactactttaaggtctttaaccatagcaaacactgttttcccgctgcgatatttaggcttcgtacggtggtccgccttatgttcaaagtgcttgcctttcttccgtaccgggtggtttgcagcaaggaatcgacgatgacccatgtacacaaccttcctacagtgcttacgatacgtactttctgtttcatccatacagtgagtgcaagccttgtaccccttgttggactgaccggaaaggttgctaagtgcaggccaatcgttaatggttacgaacagcagcgctcgtaggttaaactcctcctgtttgttctcgtcccacacggggacaccttcctttttccataacagtttaagatcttcgaccagtggtcctaggtacacatcgatgtcgttaccaagttgcttggggccttgaataataattggtatcattatgtacttcctcttcatacatagccaggagggaggttgtagatacacatcgtaacgggccaagtgtgtca

SEQ ID NO: 43280 - DNA, 1501 bp, Oryza sativa
taacttggaatgagattatttaatagcaagtgctaaagagaattgcaaaagcttcaactctagctgaggaactcagcaataagagcttgcaagtcagagttgtcaccttgtgctccatcttgagacggatagtccacttctgcatcatcatcattttctggtggtgagtacggagctcctttgctatctgcaactttgcttgcttttaatgaggcctcctgtgtttcaaaaccgacttcctcctgcagccaaagaagtaataataatgttaacttaatagaaagtaaatttatagaaaggcaatgagccaaggaccaatgaaaagatggaagccatgagaggttcagctatcctagaaaccaaatgtcatttactattaggtggagtattgaaatcatacatatagctttcaaactcctggtatggaaatggtacctctgatctctaacaaaaaagattagcaaacaggccattggtaacaacttacaaggatatattaaggtaaactatgaacataaccaaactaacaatatcaataaatgagaacactgcaaacactgaataacaggttaattctaaacggcattcgcatcattgtctggcacccaattttcaaaagttacacatctattatcacggtatcacctatggaacatggtagtgcaaagcatggtcagcagtattgcttagtgcacaaaacaatttaattcacgccaaagatgaaactagtgcagcacacctactttggtttcttgattttgtccgatacataaagcctccatctccttgattgccacatcaacagaaccgcgaaccatattgcacgaataaattatcaaaatccaataaattattacaagcctgaatgacacagcaagaagaacataagcatcagtattcagtacacccaaaattccaagcacaactaaatcacaggacatcaccgagtgcacttattcgccattccactcagaaaataagcgcaccttctagaatcaacacgaaaagctcgtggccatggcgcggcggcgaccatagaccacccctcacatgacataccttccttagtacaggctagaggggaggtgggggggggcgactcgcgagttcgccggaagagccgccggcgatcgcccgccgactgaagagcaggagagagcggcggaggcgtggctcgccgccgctgcctttgagtgagtcgtcgtcttgagtcacgacgactgttcttgtacgtgtcatcgccgccgacccaacctgaccggcactacaactgggccacaccaaccagcaagaaaaagcccaacaggcccactacaactgggccacacatcattaatgggcctaaactttcgtgagcccggcccagtaagagatgaaaaggccataataagacggtgagacccagacaccgccgatccccgaaacccttctccctcgcgtcgttccgccgccgccgccgtcgtccagggcgaagcttgcgtagagatagcggcgacgatga

SEQ ID NO: 43281 - DNA, 1501 bp, Oryza sativa
agagggttaaattacaccgatttcaatagttatgggagccatcctacttgattttctgataagggtacgaattagattcggcatacttttaatttctctgtgctttttttatatgtggttttggtctagttttgttgaaaaaaaatactgccttgtctcgtaagaggctgctgcaagttgtgtgaagtctaaaatgcaaaatgaaaccagcagttccccgaaaccatattatacattaataaagaggaactcgttgcatgtattacacgcatccaatatagtaatcacactgagccaaatttgatacatagccgtgagagtttaatttgcacaattcggttattagccaaacaattagccaaatgataaatattggttcactgtgatttggttagtcagcttctgatggttttcgtactgataagcaattagtgttaattgaccaaatgcaattagagtgttaattgaccaaagttaataagtttgcacaaattttattcggtcacatgcattgtgtcatatttgtgtacaggtttacatgcgtttaggattttctgtgtgtgatcaaggctgaaaggaagaactatgatgtgaagtaatcgcagaagatctcgatggccaacatctttgctgtcactaccgtgccactgccgtcacattttctatcttctttctcatctgcatgtgggtctcacctatcagattcatctttttcctccatccttccctcttgtttttcccatctctctccaccacctctcagcctccctagcaatccatctcatccgctcctccctccttaacccgatacgcatcaccatcctctcctgcctcctcacccggtgttgaagtcgaggccagagcgaccggagacggggtggtggcaaacggtcatggcgcacacaagggcgggcggtgcagcccggttgagtcgtttgctccctccgcccccatcgctcctcctccccctccaccaccgccgctggttgccgccgtcgctcccaccttcgggccgacttcctcacagccaccgtcgtcgctcctcctcctccaccaccgtcgctaccatttgtcacctacgctcccttccatcgccggtggtgcccccctccactctccacccctgtccctttctcttctctctctagctccttgtctcctctttagatctggaggccacatcccccgtgtcagcccgttgggtgaccgcgctctctgccaacccctcctgcctctctccctcgccgttgccagagccctcgcgctgacctcctcacagccgcggaggctgactgccgcaatcgtcacaaaactaccgatgtctgacgctcgcaaagcaagaagatgagaagagagaaggaagaagacggatggaaaatgtgatggcagtggcatggtttccaattttgcaaaatgtgtgtggcacgcggttacgaatctgtcaaaaatatgtcgaaaatctccgttaacctcaactgcatgagggacctagctgtcagtt

SEQ ID NO: 43282 - DNA, 1501 bp, Oryza sativa
tttttcactggaattaaggagagaagaatgagggctgggggctgggcagcaggccttttataggcagcgaggcctgccgtccggccagagggcggcaaggggccgcctgcaaaatagccagccccgactggcttttttgtattcgggccccttgccgccccaccagagggcggcaagggttttcctgcaaaaaaaccctccctccgtcaccgcccgttcctcccccgtttgccacgtcagcttgccgccccagaggtgggcggcagggtctatttttgtaatttttttagccgatagattatttctgtaaatatttttttaaaaaaaatctaaaaccgaaaaaaattctcgaatagaatagggcgagcatgtgccgccggcggccgccgctccaggcgtagctccaccggtcaccgccgcaggtaccctcacctgaagatccctcaaccgaagcgccgcttccgacagtaggctctgccctcatcctcgccgagctacccgtggagcggatacggcggcaaactggtctccaacaccgtgctgcctgttcgccgtggcggcttgccggctgacgtctccggcggcggagcgtggagtggtctccgctgcgaggtacgcaactaggggtttgggagttcgggtttcaggtttatggccgcacaggcttcttcctctctacgatttactgtttccggattactgtacatcccgctataaattcgttagtgccaatcctttcgtagtttagttcacttcactaccctagtgccttaggctcttagcaggagggggttggtttatgtttcagtaacatttgcattttctgagatgttagtcaggctgagaatgccgtgcttagatctaccagaaatttcaggccaataaatatgaatgagcaagatgtagattttcccgggaagaggagatcaatttgtgaatccaagtataaaagcaaattgagtaagaacttgccttttttatctgaaaactaaacatgagctctacatcatcctagccaatcctacgacttgaattgaacctgggtaggctgaccacaacattggtttttcttgagtgaattataatattgagtgcagtaaagaatgctctttgtcctttaatatataggcaaggcctgatagtattttcaatcaaaaaaaatattagagtgcagtaattgtaagtttgtaacctcccagagtgtacaggtggtactgctttaatctcagcaaacatatcccttgtgtacacccttttctcgatcggtaattgcagttcctccctggccgtcaagccaaaaaggccagttactgcaaaatgcaattaatacacaggaaagcaagtttttcagatgactaaaaatgcagaaagactagactagcagcgaagaccagaggtcatcaggtcaactggtcaagtcttcatctcagcacttccatttatccaattaggtgcaactcgacctatcttctctattctaccaccagctactgagtactga

SEQ ID NO: 43283 - DNA, 1501 bp, Oryza sativa
gaactttctcgttcgttccttgtcaggttgcgcgtctccctgtatgttccacttgcacgagattcttctatggtctgcaggggaatggttagttcatggcagttgtacaaatgataccctgcatttggcaatgggatttcatttgtacaaccggggaaaaagtatatcaaagatccatctgctccatgtttcaaaatatgcccttgcactagataggcctcatcaatacgcggacaagcggctgagataaaagcaatttggtcgctaacgacccctagcccttttgctatccgagtaatcagagaagtgcactcaacaggagcagagaactttatactttctaaccattgccttatcatacatttcacaggagaatattgatttttctaaccatggcaaacatgataattaattcatctcccctaatgggtctcagatcacttctaggaaacaaagtcatagcaatccatttgtgcatgagcctaagtgtaggattatggatatcatttgttctaggtttcttgcaaattggagcaccagaaatatcttcccaaaacctatttttctcgaacccagaaattcctttctagagatcgattttacaggaatcgtgaaaaccaagaagtgtactcaagcctttccatgtgagcgtgaactccttacggaaaaagcgaaaagaaataccatcttctatttctttcaaagtgcacagaaattgcaaagtaagcaaacgagaaccgggcttatctaccacagcaaatctctgccaaccaacagctttccaaatagaacaaaattcaacatccatacctatctttttcagcaactccggtgagtattttcacgtgtgagcatactcccggtcgctcagcatgtagtaggcttgtctctcccgatcactgacaaggtctaggtcagcgtcgctcaggagttgtcgtggagcgtcagcgtcttccatcgagacatcagctgatgagcgagtgctagactcgtcatgacgacttgatggagagcccgaccctttgaacagacgagacagtcgcctcctcatactgcacaatggagcaagaacgggctaactcggcgggggttagaaatgacaagagtttcacccgccagttagtttcaccaaagcaacttgtatatatgcaactaaatgatttgaacttgaggaaaactatcaaagcttgaatgaacttgagagcaaactttggagagggaatgaaaatgtgttgaaatggggtggaattccttctctcggccggctggcttttatagggtacccacaacggtcagaaatgacatgtgggacccactagccattaccctgccaaaaatggcaagtaaccgttgcctagccggttcggccgaaccagtgagttcggccaaacccctggtgggcccaaccggccccactttcggtcgttggaatccaacggtcagtgtggtcgtggtatagtgaattttcgttgaaaattttattttagtttgctctaaaaaa

SEQ ID NO: 43284 - DNA, 1501 bp, Oryza sativa
gaccgtatagcgctttgtcgagtcgcaacaccatgtgctccttgccggcgtccacgaacccggctggctgcgtgacgtagacttcctcctggagctcaccgttgaggaaggcggacttgacgtccatatgatgaacggcccagccctcactcgccgcgtgcgccagcagcacccgaacggactcgagccgcgccaccggcgcgaacacctcgtcgaagtctatcccctgtcgctgcacgtagccttttgccacaagacgcgccttgtacctggtgacattgccagcggcgtctttctttgtcttgaagacccatttgagtccaatcgggcgctgacacggcggcccgttgacgagacgccaagtgttgttggcttcaatggacttgatctcctcgatcattgcctggcgccagcactgatgttgctctgcttcatcgaacgacgccggctcttccgcagagaccatcaggagatcctcgtcgaactcccgtaccgcctgtccaggtggtgttgctggggcgagcacgttgtcgacggtgcggaacttgagtggcgcgtcatcatggtcgacgtcgaggttgtcctccagacctgatggtggtgacacgaactccaccgtcggtgttccagcgtgcggaggagtgcttggcgacgcctggctcggtgacgacacgaacggcgagcctggcggtggtggcgccgcagctggggaaggtggcgccgtctcacgttccacgaagcgccgtgtcgatggcaccgcatctggatgctgcacggtggcgtactcgacgacgaagtcggtgtcgacgcctgtttcagcctagccgtcccacctccactgagcctcctcgtcaaacacgatatcgcgggagatgtgcacccgtcgcgtcacggggtcgtaggcgcggtacgcctttgatcctagcttgtagcccacgaaaatcatgtgtttactcctgtcatcgagtttcttcacatttggcatggtgttcttcacatgtcccacacacccaaatgtacgaagatgatgaaccgccggcgcaccgccgttccatagctcgtatggagtttttccgccgatgctcttcgacgacgacctattcagcaaatagactgccgtatttactgcctctccccagaacatacctgggagcccttttgcctttaacatgctcctcgtcgtgcccaccaccgattgattccggtgctcgacgacgccgttctgctgtggcgaatacggcgccgtgagttctcgacgcagtccgagctcggcgcagtactcgttgaagtggctgttgacggtcgttatcaatcagtttcgaccgtcaatattactaaaataggagagaactagtgatgcttccaatgcataaatatgatagaacaataatattccactagtattaggtttactaaccattttgcagagaatgacaataaagtggaggagaatcgacatcaacacaaacgataaatcaatcggacgatgtcaagagataga

SEQ ID NO: 43285 - DNA, 1501 bp, Oryza sativa
ctaggaggcaattgcagaatggacggcgtgtgaggggttgaaaccatgtcggtggcagcaaacctccacggtgttagaatggtgggaggctacctcaaatatccaggaggcacccaagaaggctcttcgcacactgatcctgctggtcgcatgggagatctggactgagagaaaccgcagaacctttcagcaaaaagagctatcgaccacctcccttctggctaaaatcaaggaagaggccaaaatttgggccttagcgggcgcgaaaaatcttcataattggctttcttttagttagctcggaccaaaggtcttgagctcgttttcgcctttgtacagttttactccttctatattcaatgaaaattggcagcttgccttttcttcaaaaaaaaatcatatcaagttcatcacatttctttgactggttttgtgcaatactaattaatctactactccttccgtcccaaaatataagcaattttaccatagtgtcaagttaactatttttaatttggactattaatagaaacaaatcaataatgtaactattgatgttactagatttattattaaacaaactatcataatatacaattctttttatttaaagcatcttatttttatacttattgttggtgaaagtagtatctcgaagactgtgccgaaatctaaaaatgattatattttgggacggatggagtaccacaagatagatatatataaattaatatgcataaagaaaagatagggaagaacatttcaacatcgcaggccaccacacggcataatatataaatgctattcaatttgacaaaagtaaagctaatactgcctagttgacacacttgacagtgataatcaacatcaaggatctaatggactataacctcatcatcctgttgtatgccatctctttcttcagctagatttgacgttaccatcagtccatcactaacgttaacctctcctcgttgagctacaaattacacgcaaacttttgaattatctttccggataaactatttatcggttaatcgtttgtatgaaatgatacttgcatatttagcgactgaaattgatccattgaagatgaaacgtccaattttctccagggagttgattgtctgctatttcttgtttttttttcagctactagcagctagccttttatactcctaaaagatgtactttttataaaaacaaatatataaatttcttagaatactttttaaaatccattttcaactttttaatatttaattcatttattgttgccctcgaaaaagtcattacaaaattagaataatctatagctatcatataattcggaatgggcctataaggctgacgaaaatgcatgctatatatatttttaaaaaaagtaaatattttattaaagaataaaatcatatccaatctttgcacctatcaggatgtatacagccaacgtacatactgtgtgtgaggctagatatatacatgtagatcgtacatgtct

SEQ ID NO: 43286 - DNA, 485 bp, Oryza sativa
ggattctgttttgtgcattgtcagcgcatgagcctcaacgtgtggacgcggggatggacgtgatcaagccgcgagtcatgggtagcgatccgagtattttggcgtcactttgcatgtttcagttctgcacaataaaaggagagaaaaaaaccccgaaaagctgcaagcaattcaggcagcaccaaaaactctgtttctgctgtctgttcgtctacagtattgtgttctacgtgttcttgtgttcttccactttcaagtgagttcatccagtgttcacaagccaattgattaggggtttcctgacaattggtatcagagcaaggtttagggcttggacacgtgatcgtgcgctagaagaagcacttatgccaaggcgtcacaagctccccgtgccgttggtcggtgtcgccgagcgcacgcactcctggaggttccagcggccgtgcctcaggcagcggcgggaatgaccgcgggctggttataca

SEQ ID NO: 43287 - DNA, 305 bp, Oryza sativa
attggacaataattcgctcctggcttgtcgctctctttcttgagctgtggctctgtgcctgtttccttccaacatttgcaggacgtacctcacctgatgcttttaataagtaaaaaatgtgagattggatcatacaaagcaatcagtagctgccaagaagggattactggaagcgaagttccgctatctgttttctcaataataatcatcctcacattcatttttctttttgtgccatgtgtaacagggtgagacaagtcaagagtttgagggtcagggtccagatgaggcctatcctcgccagc

SEQ ID NO: 43288 - DNA, 249 bp, Oryza sativa
ttggtgcgggtataatgtttgcttatgcaattactctctgtcatgacgatgatattagagtagtatctggtagtttagacgtggtgtctagattacaggatatcattatttggggttatatattgcggatgagaggtgggccgctgatggtgacagctcagtacgggtattcctccgtgcctatatataatcctaagttaatttcctggggagggtattcctccgtatttagccccggttggatggtca

SEQ ID NO: 43289 - DNA, 508 bp, Oryza sativa
agcgtgaactaaacacacccaaaatgtagataccttttgggtttaaatatgaactactccgttcaagccttgatttcaaaatggaatatagatgccttttgggtttaaatttgactagtagcagcatatacgctcggtgcaccatggaccaggcaggctgcaacgtcactgtgcagagtagagtacagagcagaccaataggcaacggaccgaatcaacacacacatatcaggtcagaagatgcgggttcactgtttccatggggacagggcatggaggccagctgcaacgagtaaaacagtgacacgtagctttggcacctcgcccaacccaatgtttccttcctggagacgggggtggagagtgggagagagagcggagagaccaagccgaaaccccaaaaccaaaaccaaaaccaaaacccggacccaggcaggcggagaaaaaccaaggacaaggaaaccccttccctttcctggagagcacgggtgatggagagtggagagag

SEQ ID NO: 43290 - DNA, 1501 bp, Oryza sativa
ttgattcaactaaagaaaacccacaaactttttaggttttaattgtaatttaaaatgacatagacagcacaattcattgaagagtacatattttgtaatcatatcaaaggacatattgttagcacaattggagtcatctatctatactgaaacaaactatgccatttttctttctgtttgttaatacaaagaagctaatatttgttgcaacacggatgtaatttgtttgttgctgttttgaatctggtgtaacgcacaggtatttggctagtctatatttattatttgtaccttttgaacttgcttgtttcattagtcgattatttgttttataagatgttatttgctatatttgtatctctttttaccaaatttatacttgcaatgttcaaaaatttttggcatgtaatgtgaaattgtgaagtagggctagtcaaccataaattcctggctatgccagtctccgtccggttaccagaggagctcaatccagttgcttgcagcttgtatcaggcggtgagcagctcactcctgtagatccgcttgcttgcagcttggatcgggctgggagaagcttattttgggacaaacggaaggaggcaaagatgaactttttatggaacggagggagtagggtggaacagaaaaaaaaaaaagaaaacctttgctttgctttggcaaggaagttaaaccgcatgggtccttactccttaaatcctagctttgctagctctgctccccttctcatttttcttctcttcctctggatcaaatggagcacaaactttgtttaatgcacacttgcaaaaattgagcaccgcaccaacactgccggatgttagcaccctaagcagcagcccacaggttgtcttgctgggaggagctcgctctagtggtggcgggctcatctgggtagcggggtcttcgatttgggtggcgcgagagtacccagccattgtggttgttgtccagagagcgagggagggtgtacggtaggaggtgtacaaagtgagatggaaatggatccccgagtaacatagagaagaggccaagaagggatccaatcacatctctctcgcaatccaagattgggaattccgaccaacataactctcaacgacccgctgcagtgctgcgatttttgcatcccaacctccatatagagggtcaaacaacgagatctctttggttaagacattgaatattctatcattgtgctgttttttttttcttttgctatttctactgttgcagcagctctctctctctctctctcgttgcagtactatgctgctaattgctttctttttattattttgtttcaaaaggttgtcttattgtataaatctataaatgtttgctcctagttgtagcgcctctttgatttttcatatttcgtttttatttaaaatgaacatcactataggttcatgattgggatttattattttgcagttgagttgccatggatattgagcgacaagttcaagagacatttagt

SEQ ID NO: 43291 - DNA, 1501 bp, Oryza sativa
cagtttgaatttgaatttcaaattatgacaacttcaaacaatattttcaaatactaaatgatttcaactgaaaaagtcatcaataacaaagtggtataacttatcaaaatctataacttttattttggtcatttattcatccaaaaaagtgatttgtaagattattcacaaaatgtacatatctcttatatagttttataaactataagagagatatgtaaattttgaaaaaatgttaccatcactttgtcagatgaagaatgaccaaaatagaagttatagatcttcatgagttgtacaactttgttattgatgactttttcagctgaaatcatttagtatttaaaaatattgtttgaagttttgaaattcaaatttttaattgataaaacaaagtcacaagaaaaaatggccaaaataatagtagtaagaacataataacatggtagagcatgattttagaaatatttaggaaaaagaattatccaatttggtgttcatatgagtgagatacactattttcaaaattttcaaaattatttttgcatacggctgcttaagacgcccgtatggaaaaatcgattttttccatgcgggcgcttaagtgagccacatgcactcttaagaggcccgtataggaaaatcgatttttccatacaggcatcttaagcagccgtctgagaaaatgctactcgatttttgcagacgccactagttatggtccgtttgtaaaaataaaggggtctcgtacagaaaaatcatttttgtagtagtgaatacaaataagatatgttaacacgcttttacttgcaacaataaggagcatatcaagtaacatgattttacattaccatgaccatgccttcatgcattaaatatataaaaaaaacacatctggacaaaatcgccaaccttcttttgttccacaaattagaactatggagtgaatttaattctaaaagatcattcatggatattgccatagatggatcattcatgatatagccaataggatcaatagttaaatacacatacctcaaactctcaacatgctggtatagattatctcgactcactctagcccaaaaacatgttgtcttattgaacctctcctatcccttagcttcaataaattgaccatgttctagacagatggccctccaataattgttttcttcttttaaataatcttccttcacaaactgcagcaagtatggtactaaaatatgtgccatgttagaattctagatctggacatcacatttgacagacgaccatataatttcattgtaaccttgaatgtccacttaaaaaaaatgaagttacaaactgcgatttttttagagataattgtttctctgcgaactttaggaccaagagtagtctccatatccattccaagaatttgtttgtctatcttgctgagcgacaaattaacttctagattactaaaagcatgaacacacctgatgtagactgagaagcggcaagggcacagcaa

SEQ ID NO: 43292 - DNA, 1501 bp, Oryza sativa
cccacttcggcatagcgacgctatagccgcctgaccccaagtggtgatggtacttcttcttggcggcattttctttgtttctttccatcatcgcctacccttgttgacctgtcttatatgcaacgaactcgtcctagtgatcccttagctttgggaatgtgtcgaagttcggtgtctgccccttcaggatatatttctggtacagatctcccttgaagctctgaaacagttctgccattttctttagagtccaccttttcactttgtcctctgtacccgcgggaagggtgaatgtctcgagcattgtggtccacagcatctctttctccgaatctgggacaaagctctcatgatctccgcgtgcccttgttctgcgccagtacaccatactgacaggcacgttatcccgcacaacccaatagctgtgtcgtacgtagttcttggctgcttccgctggggcactaggtcggccatcttcgtccacttccgttatgatgtgccgaccctctagtttcttcgtggcacctcgttgcctgcgtgccctcttctgtccagcggagggttgacttccactagcctcctcctcctggttcccctccacatccctctccacgttcccctcctggttcccctccgcttccctctccacgttcccttcctcgttcaagtactggtttggatcctcgttcccctcttcttcgttccagtactggctgcttccctccacgattgtattgtacagtatctgttcctcatcgcgatcagccatctgttcatacaagaaatatttgctaagtctataggtcatttttgctttaacaatcttatatgctaacaatcatatatgctaagtcaaatatactaagtctaactgtcgtatattagaaccctacacaatcctacatgctaagtcttattaaaaatctaataatcttatattaaagctctaataatcttatattaaaactcaaataatattgtattaaaactctaatagtcaactatgctaagtctaagtgtcgtatattaggaccctagacaataattatatactaagtctaattacaaatctaataatcttatattaaaactcaaataatcttgtattagaactctaataatcttatattaaaactcaaatagtcataaatgctaagtctaactgtcgtatattagaaccttacacaatcttatatgctaagttttattacaaatctaataatcttatattaaaactcaaataatattgtattaaaactgtaatagtcaactatgctaagtctaagtgtcgtatattaggaccctagacaataattatatactaagtctaattacaaatctaataatcttatattaaaactcaaataatcttgtattagaactctaataatcttatattaaaactcaaatagtcatatatgctaagtctaattgtcgtatattagaaccctacacaatcttatatgctgtcttattacaaatctaataatcttatactatg

SEQ ID NO: 43293 - DNA, 1501 bp, Oryza sativa
tgaggaggcaggagcaggaaggaggagaggaggcaggtggtgggagaagcagcgtggggcggggggtacgggccgcggcgaaggcggaggcgtgtcgctggcttcgctgcctgcctggctgtggcctgtagctgtggctgggggtgcatgcgacgggagccccggacggctgcaaggggtatttttttaacatccacgaggacggagcaagccgcgggcgccgtggcggtggcactagtctggagtatagcgactagtagtggtaggatgcttgtctgagcgcgtgtgactgtgaggcgaacttcatgggtggcgccgtggcggtcaagcgggactcgccggtggtccaatggaaccatcgccctggacggcagactctggtcagtgcgactatctgagcacacactcatctggaccaccacacgggacgtaggagtatatgatactacatggcctacgcatggatttctcttaattatattccggatgaaaaacaactgccttgtaaaattcaacgtatcatatagttccacgttaaaattagaagtttgaaaaaactagaacgatgtagtgaaaaaattgaaaaaattgaaaatttgtgtgtaggaaagttcgatgtgacggaaaagttgaaagttgaagaaaaaagttagaatttaaacagggcctaagaagacttcattggtccaacaaaccttctaaaatatcatcggtccgttttgcaccttccattcaggctttataaaatccggtaactacgcatgtttcgtggtaattgagtttaccactaggtaagataaaaggtaaaatcatggtaactataaaattaaataaattttaaaaattttgataaattttatacggaatcttacggtttgtcacagttactgttgtacctgtgcttattgtcaaggcgcggtaaccccaccaccgacggtaagggaaacccaactttcggtaagagaaacccaactttcatctcacctaacccatattcatatagcgaatatttcagttcgaattccttcttgttaattccccgctgaaaagtcgtcgtccgcgtccaaccccaagctcgtgctctcccgaagtacgtcgagacgggagagcgccacgacaaggcggtctcctgactttctctcctcacaccaccgataccacgatcacgcaccacggttgacaacgcccaatacgccagccttggcgttcccgcggtcgccaccccacccagaacaatactcctgcttgttgttggatcaaaaagcaaggggagatccatccggatccggccgccgcgcgtggggatggcaaaaaggccacccgttataatactcctagtagtacgcggctgaggcgcggttcgcgcgagcggttcttggccgcttccgttcgtcgccatcgatcggtggcagccgttttggcccggcagcgtggcttggcgtcagccccggccaaaggccaaccgcggaagatggggagggtttggctgcctcgctcatgt

SEQ ID NO: 43294 - DNA, 1501 bp, Oryza sativa; identical to SEQ ID NO: 43186

SEQ ID NO: 43295 - DNA, 1501 bp, Oryza sativa
aagcaactaatgctgggtttaatttctaaaaaaaagttaaaagtttaaggaaagttggaagtttagaaaaaaagttaaaagtttatatgtgtatgtaagttttagatgtgatgtgatagaaagttgaaagtttagggtagttgagggtgaactaaacatggcctaaggtataacatgcattagttgtatcagtttttctacaccaatttttttttgctcgacttgggttgttagaaaaaaatgcaaaggagggagagtagtaagctacaggtgttggaagcttcatggatgacggcaatttgtttgcttcttctgtgaggaagaatagatcgataggaggagctaggtgggtcccggtagcagcgaggtgaacgcaagggccagtgtggtggggtcgtgggtgagtggagaggtgagtgcaacgagagcttgttgttctcgttcctgctatcatcgcccggcgagcaaagtggccggatttgaaagagaagcactggaaggataactcgagggcaatttgcaaaccaggggtactcaccgtcattttggaagtttcctctcccctaaacagccaaaaacatttaaatagtagcaaatattcactttttaccgatgcattccacaaaagattcactactgcggtgttctacagctagtacgtcacggtgttttatagcaaaatttgccaaaaaattgtcataattttaaaagtttaggggttgattcggtccaaatttaaacttgagagaaagttataaaaggaagattttttccctatgttacttagaaatttaattagaagattcattttaagaacgggttaattttcaggatcaggcttgacaagtctagcatttcccatgccgggtcccaaaaccttaattcatcccagcgcacacattcaggcatttgtttatttggcaaaaaaaaaattttgccctctgcatgtcacgtcggatatacggacacacatttgaaatattaaacgtagtttaataacaaaacaaattacagattttatcagaatactgcgagacgaatttattaagcctaattaattcgtcattagcaaatatttattgtagcaccattatcaaatcatggcgtaattaggcttaaaatattcgtctcgtgatttcttggtgaactgtgtaattaattttttatttacatttaatattctatatatgtattaaatattcgatgtggtagcgcgaaaaattttgttgaagagctaaacaggtccgtcctcagtcttacaacggtcaaccactcaacccaagctccaatgatgcgacctcaacccaaagctctcgacggttgaggaacaacgtggttgtcgctcattttcctcccgtacgttccagctagctcaggtcaaagctgtcaaacctactataaataattctcgttgattagccttggcggccaagtagacgatcacaacgaacgagaccgtggctgccaagcaacctcaacctcccggccggcacgggcgcag

SEQ ID NO: 43296 - DNA, 1501 bp, Oryza sativa
agttccattacggggcatgaatcacaagttgtaatgtgaaggactgtgtttgcaatcacttaagaaaataaatattcttcaatcgcacatggggactctcagaatttgtatgcaccaggtttctggttttcgttgcttgcaaaattaagttgctagcaatcctggaagctgagtagacactttactggtgtgcacgcgcgcacgtttaatgtgacatggagattattacaggcagcacactgtggaaatggcagagttaggtataatggtaaatccctttttccagaattatcagctaaaatccactgctagatgctccctcaatcataccagcttacaaagaacgtctttcggactaatctctgcttgaatatctggtatttggtacataggcctaagaaaaaaaaatcagagagaattgtccatgttctgatttgtgattctgacttctgcagttactaaacataatccaacaaaaaagaaaatattttctatgttctgtaatttgagtcttaattcagattagattgacctgaaatctaaagaggtcatgaatcttcagattttgcatttgattctctgagattatatcaaacagctagatgacaccttaaaaaacacaatgaagcagaatcatccaaaccctgtcctgaccacctccttaaaatatgtaatggagcagagcgacccacagtggtttcatgaagtgaacatctaagcttttggttgttggaactatatacaaacacaaccaaataaaaagatatgcagtacaaatcagaaatactgtagcattcttgataaaaaaaaaggtagactatcatttgcaagggaataatggtatatgaaaaagcaaagctaacgagggaactggaggcaggaaagggaagatacacgccaagcatacataagtgagtgtagaaaggaactggttgtggcttaactcaccaaaagtgaccatgggaaacaaactgcaaatggaccctgggcaaggcaacaacacatggttccaatatcaccagatatggaatcgctaaacagtggtggtgccgcacggccgacggagcttcaagctaaccaacacctacaatattggcaaacttgagcaccttctatggcagcaaccaatcctttttatacagataagacaaaatcaattatcatatttgatattcatatttataattagattgcattctttttctcttttttgaaaaaagattccacttatctagtgaccaacacttcaaagtatcacctagagtagaaggcaaactgaagagaaaaacattgattttaacaatctttcaccttcttgtacatagaaacacaactgtgatgtacattaatcaacgttttcattagccgatgaggacggtaattttaacagagctaggatgatgcaaaataaatggctcagcaaaaaagagtaagttgtgtttcctaggcaagaagttttttggatttaaatcaacagcaactatgaaattgtaagtccctt

SEQ ID NO: 43297 - DNA, 1501 bp, Oryza sativa
ctccatgagcagccacacttgcatgtggacgttgtccatggtgccatcaaggcatacaaggcagcacacgccatcctccatctcccctatggcgtacttggaaggctggaacaagcttacagggagactgagcatggagaattccatcgtgagcgtgtcaagcaatatcacaaaattgtcctcgcatttccagaagataatccccgccgcatgcatcgcctggccccggcgaggccgcctcatgttttccacccacgggtggaagctccactctcgagtaccggagttgtactccgcggcgcgcatcctccggccatggcgctgcacggacaccacgcggaacgacgccgcgccgttgtcgccgcgcccgtgcagcaagcagtcggcaatgtaggcgtccgagaaggggtcgtcctgtgggcggcggatggagacgcgccggcgggacaccgggtcgtagacggcgacggatctacctccgcagaggagcaggcggccgttgcggcagtcccggagttgccagcggggatcctcgccgtccccgacgcggatgagcgagaagtcgcccccgagtaccgcggcgccgaggtcggggtcggagcggacggtcgcggcggggtggaacacggggaggccggagctcccgtgggagacgaacaggccgaggagaggcgacgaggtgtggcgggcgcggaatcggcggaggaagtcggggccggaggcgacggcgagccagcacttggaggctagcgcggcgcgttggagggaggccgccgacgggaggcggagaaggatctcggcgaggaggtcgtcggtaaatggctgcaatgccatccggatccggaggagtgggggcggcggccggcgcgctacgggaagaggccggaggagacgggaggggcgcggagttcaccggagtggcgaatagcaaggcagaggcccgcgacacatactgacgcacgacgcaggtcgccgccgcccgccggtgaacccccaaaggaacggtgggattggaccgttgagcagtgaggtgagcacttttcacttcgcacgagtccttgtcttcggtcgcctttcctttttttttttaacgaaccgcgtgatgcgaggttccatattaataacagaaataaattactccacaaatgtaaaaaaaaacaagaaaaaattattatctagattacctcaataaatacaatgaaagcagccaatgatactagagatattacagttgaggattaaacaaacaaaatttaagggagacgggtgtgctacttaattgcattgcatgcatacatgcgtgttttttttattatgaaacataagaaaaatagttgtcttatattttagtataaacattaaaaaaataatggttatgtcttatattttgggataggggagtagtagaaaaatgattataatagcttggaaggttataataaaaggaaaaaacaatacgtcatgttgcattcctacaacacattgctcactgttgagggac

SEQ ID NO: 43298 - DNA, 1501 bp, Oryza sativa
gggagcttgcggaccttgaggcgggtcttcatccggacgaagtcgagctccttgttgcggaactccctgacgaagtcctcgggcctcttgatggcgcccttgccgtcgtcgcggcggcgctgcctcttggccgccttccgctcccggttcttgaccgcccagtcctcgttcaccttccgcttcttcagcaccgtctcccgcacgtacggcagctgctgcgtcccctcctccgccatcatcgtcgccgctatctctacgcaagcttcgccctggacgacggcggcggcggcggaacgacgcgagggagaagggtttcggggatcggcggtgtctgggtctcaccgtcttattatggccttttcatctcttactgggccgggctcacgaaagtttaggcccattaatgatgtgtggcccagttgtagtgggcctgttgggctttttcttgctggttggtgtggcccagttgtagtgccggtcaggttgggtcggcggcgatgacacgtacaagaacagtcgtcgtgactcaagacgacgactcactcaaaggcagcggcggcgagccacgcctccgccgctctctcctgctcttcagtcggcgggcgatcgccggcggctcttccggcgaactcgcgagtcgcccccccccacctcccctctagcctgtactaaggaaggtatgtcatgtgaggggtggtctatggtcgccgccgcgccatggccacgagcttttcgtgttgattctagaaggtgcgcttattttctgagtggaatggcgaataagtgcactcggtgatgtcctgtgatttagttgtgcttggaattttgggtgtactgaatactgatgcttatgttcttcttgctgtgtcattcaggcttgtaataatttattggattttgataatttattcgtgcaatatggttcgcggttctgttgatgtggcaatcaaggagatggaggctttatgtatcggacaaaatcaagaaaccaaagtaggtgtgctgcactagtttcatctttggcgtgaattaaattgttttgtgcactaagcaatactgctgaccatgctttgcactaccatgttccataggtgataccgtgataatagatgtgtaacttttgaaaattgggtgccagacaatgatgcgaatgccgtttagaattaacctgttattcagtgtttgcagtgttctcatttattgatattgttagtttggttatgttcatagtttaccttaatatatccttgtaagttgttaccaatggcctgtttgctaatcttttttgttagagatcagaggtaccatttccataccaggagtttgaaagctatatgtatgatttcaatactccacctaatagtaaatgacatttggtttctaggatagctgaacctctcatggcttccatcttttcattggtccttggctcattgcctttctataaatttactttctattaagttaacattattattacttctttggctgcaggaggaag

SEQ ID NO: 43299 - DNA, 1501 bp, Oryza sativa
acaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccgcgccacgaggaggtgttctccaatggcctcaacatcccggacatcatcaacgagcacctcggcgccgagccgaccctcccttacctcagcccggaccttcgtggcgccaagctcctcgtcggcgccaacttcgcctccgctagcgtcggcatcctcaacgacaccggcatccagttcgtgagtgccactgactgatcactgatcgatcgcggtcggtgagatgcgttcatggcgttcatggcggtgttcttgcaggtgaacatcgtgaggatgagcaggcagctgcagttctttgcggagtaccacaggagaggctacgcgcgctggtcggcacggcgagggcacggcggatcgtgaacggcgtgctcgtgctcatcaccctcggcggcaacgacttcatgaccaactactacctcgtccctttctcccttcgctcccagcagttcgccctccccgactacgtccgcttcctcatctccgagtacaagaaaatcctccaggtctgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgtgtgactcgccgagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaagtggtatcagagcctgagtttaacatgtcttccgacagcgacagtggccgctacactcctccggggcggcgtggcgccggcggcggcggcggcagcggcagtggcagcaagcagggcggtggttcaggcactggcactgatggtgctgaagtccccatcgtccaacaaccagcaccgagggatcctagcgtagccgtgcgctatccggtgctgacgagaaccaactatgccgaatgggcaatgttga

SEQ ID NO: 43300 - DNA, 1501 bp, Oryza sativa; identical to SEQ ID NO: 43255

SEQ ID NO: 43301 - DNA, 1501 bp, Oryza sativa; identical to SEQ ID NO: 43256

SEQ ID NO: 43302 - DNA, 1501 bp, Oryza sativa; identical to SEQ ID NO: 43257

SEQ ID NO: 43303 - DNA, 610 bp, Oryza sativa
aaataaattataaagggtaaaaagggccgatgcaccgaattgtattgatcgtagcgatagattacatagaccccgggtgtacatatttatacccatgggttgatacaagtccttgtcggacaagaaagaaaccttcctaaagataaaaggaaaagataaagtccttataggacactaaacacactttcctaaagataaaaggaaactaacaagctattcctaattaatagataacttgtcatgccgcattctatttgaactcggtcccttcggataagcttcctttagtagatcaatttccttaaccgaatatagcacgaatccgacaactgacgacttgacaactctcatcggctaatctcaggacttcaaagccgatgttgactctaagccgatgactactctgggcttaccaaatttcactgttaacacgtgcgtaccgcttcattccttcggtggtcttttctctcgactcctaggcgctgcgccgccgcctgttcatcttcttcccaggaaaaacgctgctatcacgccatggtttagctatctagttgaaaatagtggttacaagagacttagtagcacccgaggtcctgggttcgactcccca

SEQ ID NO: 43304 - DNA, 1501 bp, Oryza sativa
ggatgaggatttgtcccaatggccctggtaatcacggtgcctcaggcgccatgacgagaggccgatgcacacgataggaccaaaaaagttgaataggagtagaatattgaacatcggaaggactgggcttgctagtattgcagtaaatgcgtgagcaatcgccccctccccaacacgaatgtatgagggcaacaatggcaacgtcaacaagtcggaggcagtaacgagtaccatatttcttatgttccaaacgctgactgtcaggatgtcctgcgactgcaactcgttgaagatgctgtgggatggacaaacagagtaatgttaatgatatgcacgtcccagagaaagtcatagtatagacgattgcatcacacactgtattcgtaaatcttagtatgcacatgcgcgtgcatcccgttgtaaagctatgaatatttctttttacatgacttttatatatgatattatactgttacattttttaacttatgatcttatactttgagttaactatggggaattattctaaactctcaaataattatgaaaacttttgaaacaattcagcaagatagaataaccaagatcagcgctgagagaaattatgttgcttgagatgcattctacaggtgtcaatcggcacgcgcgagatgtacaagtctgcatagagagcctcctccttatctcttcccacacgagcacacgcggttagagtggagcgggtgacgacacgcccgcgcccccccccccccctcttccagcaaactggccccatggagaagaggggatgtagttgagcgacggcgatgtccgtccagtgagttccctcctcctctaccccccctcctccaccgttccgctgctcggcctcgccaacaccaaaaggcgtcaacgtgctaacgtggccacgccaaccggtctccttcccttcccctttgccccgctttgcctccgccacctacactggattacctcccactgctggcaccggggttttggcggcaccaccactccacctcaccggcaccaaaaacatcaacttgtcagcgtgacccagctggcctcctccccctccccctccccttcgcctcactttgcctccactgccaacactagcctaccccccgttgctgaccccatggcttcggcgatgccaccgccgcctcgccgtgtgccctagtccgtcacccaccaccggtttgctgcctcccatgtcatccctctaagcccgatcacccactcccccttcccatagcgctaccctttccccaccctaccctcaaaaccttaatcctagcttgtcgccatgtggtcgaaaaccgcacacaacttctctccctggcgcttctaataagtattctactccctttgttctcttatatatgacgttggttacaaaatacaagaaaaccccacgaaaatcgctcctaggcctattcgacgactggcgccaattttcagtagctgccaccccacaacactctgtactagccgagccact

SEQ ID NO: 43305 - DNA, 1501 bp, Oryza sativa
cctcccccatcattaattaccgattgtcagctttgcccaaggatacgaacggagcagcaaactcacgcaagcagcgaactcaagcgatgacacacgcaagagtagcaaattgtagtggacacacacgatagatcgacaatggcgacgcacacgcactaagcttttctctctatggctcaatggagatgaacacagggaagctttgcggcaacaaatctctttatctgtgactcacacacacaaacacagaatttacatggagcttataaggcccaggcgacgacgtgagttacacgccgagcaacgtcctgatggccgagtctcacgcacatatacgctcacacgatctatacatgcatagccaccgactactgcatgccatgctccacgatccgcatgagacagctaacaaccctgaggaatcgcaccaactaatccatgcaagacacacacacaaactaattatgcactaacaaattagttagtctaccatgcaaacacaaacacgtacttcacgttgctgcctatacacaacacatgcaattaaggatatatcaagcctactagtcaagattaatactaacacatacgagttgtgagactaaacaggtccactaaaaattagtgcatccaaagttaaggtgtttcgatttaagctaatatgttctgatatattttgtgtctgtagattccttttcaaatttcactctgtctgcttgaatctgctagacctattctaacgcgacgcgcgacgatgactgccacgacgacgacggtgccgatgccttggtctaaccgccggctgcgacgacgcagcctggatccgccgccggctcgcaacgggcacgccgatccactaccggctggtctcaggtagggaaagggaggcgacggctgcgcggcggcgaaaaggtgaggcggcggctcggctcctccctctttcggcgacgggcatatatatatatagttgcagcgacgtaagtagcaccccaaagtcttgagttcaaatctttataggagcaaattttatattggattatataagggtgtatgttcttaatttaaaagtaggcctggtaaaaatatacccttctctaaataaaaaaaaaaggcccaaacccttagcaaccaggccttaattagcggagtcgcagactcgcttgttaaaaaatatacccttctcggagtcgcagactcgcttgtaatttggcaacgtttgcgatcttaattagcggagggaaagcttaggagacgactacggatcggacatctgatgcgattgttttcgtcggacgtctgttctactgttggatccacatccatccctttatgtccatctgattaaaaaaaactattacatacgtatgcagagaagagcaacaacaagaaaagtttaaccgtgcatgctcagtaccaaatgagagaggtacatggatagtgacaagcttcaaactattttttctcgaaaactatttatccaatttacaatttgattacactg

SEQ ID NO: 43306 - DNA, 1501 bp, Oryza sativa
catatttgaggccgtatcaccctaggattacaaaacataacttagtttcttagttaaccttgtatctcaccaagcctaacaacttaggttagttttgagtatgtgtcatttagttttaaatcgcctattcacccccaactaggcgacatcacgatcctacaaggtgaaaaccataacctggttttttagaacgggcaacgacggcactcttggcatcgccacctccttggaggcgttgtttagaagattcattcgtgttgtgtgcctgttaggcttttcagtagcaggatcaagcgcagacgcgtggtgtggttgtattttccttttccttactatagtctcccagtaatgtagacctttttttcttgttatatatcaatataaacgtcataatatcttgtaccgatttcaccgtacatgaatgtcgcggttgctgtttttgatggtcgttgagacagatagtttggtactatcagatttcagttccgtagctcctggatcatgatagcatcagtttcatcatcagttggtctgcgatttcatcgtaggctaataaatagtacttcttcttcttctgtaccctaatatatataagagatttcgatattttgcttacactgtttgactactcatcttatttaaaaaatttgtgcaaatataaaaagtaatttagataataaaataaataaaaaaataaaaaataattctaaattttttttaaataagacaaatgataaatagtgcaagcaaaatatcagaacctcttctatcaggagagggaggaagtatgtgacatgttctagccttttggaaaggagaatctactgtttgacctgagcatctgaacagtgcgagccccaaaactgaagtcaacctggtgaatcttgggaagacaaatgatgccttttgccatggaaaaacatttcaaaagtccccaagaccgaagcagaaatggagatgctactactgctatttgtctctttggcctatttttagagcgctcatgtctttctgcctcaccgctgcctctgcctccttccaaatgcttcgccccccgagctctcctcggcgtgcgcggcgcagcgccatccaccccgacaactcctcccaacccccaacctatccaaacacattttcttgcccgcccctgcagctccctccaccgcgccacccatccatcgccagccatgcacaccctcgctctgacgaccctgtcacgttgagctacgctcggaggaggacgccacgacggcgaccgggaagaagatgaacccgctccctcccccggccagccggctgtgggaggcgagcatccgcaagctcaagtactccaccatcctccgcggctccgtcgtcccctccggcgccgccttcgatggtgcggcggcggcggccaccggaggtgaccccgtcacgctcaccccaagcctctccgtcagctcctccacctccaacaccatctaccagtacgaagacggcgacgacgacatcgactccgtcc

SEQ ID NO: 43307 - DNA, 1501 bp, Oryza sativa
gtaacaatctgatacgtgtgctagatcatggtcaattggatgggcgttgccagctgcatcaaagaatttgagattactaaatgaggcagcatttttgggtggagcaatcccactgcccatcggagggctcggtttatgttctttccagaaggcaaagcccccaaacacaatgttcaccggcttatttgacaaggatgtaaagagagatctcggatagtatcctataatcttggccttcccatcaaaaccaaagtagatttcccagtcaccagagttttgatcctagaatcatgtgtaattgtattgttatgtcagatatatacacgcagaattgtaatcattgatgagtgaatgatttctccattgttggacaaaataatgaatggtaccttggatactctgacagtaatgtattgtttccttctagaggtgctggaaacagggttaatcacctgtccaggaacgaatgggtgcgagccacctgtcctttggaatccaggacagcgcatatctaaacaacctttcttggattcttcaacctagcattggagtagtcatgacatgataaatgtaaaatctatatgatagttcagtctccatctgaccattgcaaattctttttaggatatggcactccctgtctctctcatgggaattaacttaaagaaaaaaaaataatatgtcgaataaagaactgtattgttaatgaagaaacttacaaaccaacttgtagtgaagtgcgtctgtgaatcgttgtatgattcaggatcgacctatatgaggtacaacaaaattaaacataaaaactagatgaaatgaagtaattgattaatttcattattagctctacttcacaaggattttgactgtatgtttaaacttgtttatgtcagtattagagaagtaaagaagaaaaggtaattcaaaaacatggagataaagttcaacttacattccatccagcatgaattacatttgcagctgttgtttcatctgaattataaatctatatgaaacctctggtttgttgcccgtgctctagattaaatccataaacatccatagtagcctctaatacataatactcagtagcaccgtcgtctggaggaatccatccatgtactgcaagctgccaacgtatttggtcatgaaaatcgtaatcatgtcagcagatgcatctttcagaattagaagacaaaaaaaaaacattgggttgggcactcacatattttgcgctagattgatttgattcatgactcgatttagataagtttgcatgaagtatgggggccatcaatgctctccaattcttttgaaccttgttaattgtgttcaggaaaagcagaatgaacaatatcaactatggctgccactactagtacattttacattaaactcaatcaaatttgaatcataattaaagacagtataaagttgtagatgtacttcctcaacagtagggaagcatcctcctattgttgaaccagtaagaaacaacaca

SEQ ID NO: 43308 - DNA, 1501 bp, Oryza sativa
aaaagggtgagactgagacccataagaagtcgtccaggagtgcagaatctcgctctggagccaccatcactcacgtgagttcaggtaaaaattgcaagtctccaggatgcacaggaaccgcagacggagtcaccatgctctgcgagaagcatcgcatgaaaatggcctgctcatttccaggctgcaccaagatggcatgggggccgagtgcacactgtgtacgccacggagccggcaagagatgtaagtttctgggctgcaccaagagcacaaggcgaagcaccgatttctgcaagacgcacggtggatcaggaggtgcagatgatactctgtgctcatggcgaggaggggaatcaagcgttggtggtggcgaggacaagtgtgatagaattgctcggggaaggtctggtctatgtgcagctcacagcgctcttgtcctggacgaccgtgcttcctgcgatggcacaatagccccagcagccgcccagctggtccaggcagatgaactcatcaaacccgatgtgatagaacaccctgccgtggaggcaggtcgcgatgacaaagctgatggtggtgttggaggatcaggatcagcagcggctgtggctgaccaaagactagatttgaatgccgaggcgattattacacaacatttctttgtttgaggggaaaaaaaaaacaggaaagctagtcctgtgttgatttatttgttgtaagcgccaatgtagttcattacttagtactgctggtaattaattcatgtacttttgtatatataagagagtagtgcaattgggactgggggcggttgggttgaaagtaaaaattctgagtaataactaacctaggagcacaatagagcctaaatcatcaaatgagatcactaaatatttggcatacgcatctttcttgtattatgcttctgcagttgtggttgaagttttttttttttttaggtaaaagcaggagctctgcctatttcataaaaggagaagagagggaaaccgagtctgtacggttacaaaggatcccatggggaccccttccgaggtgttgacagaggagttgacaggaatttttatatagtgcagagcaactagcaggaggatgcgagaactactcatctaaattgtgagctccatcataggccttgcacatgtcgattattgactcaacgacttgcaccactgtgccataagcacccttgaagattctagcatttctttgaagccaaatgccccaaactgtgtagatgaagaggccgtcaaaatttcttctctgttctttcaccatctctctcctgcaagctgtccaccatgctagcatgtctccattgaaaagagaggctagcggcatatgaaggccaataatataaggttgaaagaacaataatgtatcttagtattttttgagaaaaaataagaaggaaatgtatcgatcgtataccatgttgaatacgcagcagacacacgcgcagcatcgataagttgctcgaccacca

SEQ ID NO: 43309 - DNA, 231 bp, Oryza sativa
ctctgctaatctagtcttagcatatcaatttagctctatcggctgcttcttgttttagggtttctactagtatcggctaaatcgcgttgctagattagattagcttagatatctaccaccctgaaaactcagtcaacggcttaattgtctagatattattttttttcatacttagtgctgtatcagttaagtttgatctactaagtcgtgcttataaccataatctctagc

SEQ ID NO: 43310 - DNA, 226 bp, Oryza sativa
cctgcagcccatcatacttgcataccaaagttgatttagcctttcctacaacaatagaagcataaaagtgaataatactagataggggaacaaaacaaacagtccatatacttatacatatcaatatcaggtaggagtgcatctccagtttattgttcaatgtggcatacttgaattcaagcattcaccaactagcccatttgtataaattgttctgctccgcagt

SEQ ID NO: 43311 - DNA, 192 bp, Oryza sativa
ccgattgatttatcgtttgtgttgatgtcgattctcctccactttattgtcattctctgcaaaatggttagtaaacctaatactagtggaatattattgttctatcatatttatgcattggaagcatcactagttctctcctattttagtaatattgacggtcgaaactgattgataacgaccgtcaacagc

SEQ ID NO: 43312 - DNA, 1501 bp, Oryza sativa
tcctgcggtcggtggagtcgaaggcgtcctcctgctcatcaccaggtccctctgagcgactcctagagcctggcagataagtctcgccgctgcctggctctgagccactggagctgctgctgctgcggtcacggctgccactgggagtagctggcaaccaacctccgttgccactggcggggcccctgacggctgatgcaggtgcgaaggagagcgcggatgctagagctgacatgggaacgggagctggagctggcgctggagctgcaggaactgctggagctgcgggtggaactggaggagctgctgacggaggtgggttcctgggcgcaagctggacgtgcacgggtgccgttgtcgacttgcgaggcgtagtgcggatccggactccccttggcgcgggaagacccttcaactgagcattctccctcttcaggcgcgctatctcgtccttcagagcgacgatcctcatgagcttcccatcattcaaggccttggacgccttgtgcaggtccgagtgcatcctgtccatccccctcatcacagcgcacatgtgaccgaaggtggtgtcgttctcaccggctgtcggacggaaagaactgacatcgctgccgctggctcgacgagggtggaagcggtacgccgtgtcgtggaagatgtagttgtggcgctcccatagtctggccatcatcaggtaggctgcctcctgacatgcgtgatctgctgtgcctcctgacgcctcaaccgccatgttagcgaggcaagtccccacgtagccatggacctccaagcggacacggtgaggaagctcgccactgagcggtggaatagtcgtgtactccggtgcgttggggtagcccaccaccagtgtcatgcgtgccaactctgccacgaagtcatccatgccttctccgtggtggttgggtgggtgctcggccatctggagaagacaaaggggtaggatcaatgcatgctcaaatccaaattaaataaagcaataaaggactcaaataacagaatcgaataagagcgaaattttatgcatagatcattttgcatgagagcgaataaataagacggacttacatagaggtaaaataatggggaaattagatacatacttataataacaataaaagcataaataccttacaacccatattcctgagctaaaacctagtgcattcgcccatcaaatcccaactgacggtcaaaaacatctcaaataatttttactaaaaccctagaccgacttgttttgacaaatctcacttaaacgagcgacacgatttttcccttgaaccacaagaacagatcccaaattttcccggaacaattccaattgcaaagaacttatgcaatgaaaaggattcagagggctcttaggtttccatttggcttgtcctacggtcaaggtcggctctgataccaacttgtcacgcccagaaattcccaaatagaattccaagcagaatgtgcattaaaacccccgtccaggacc

SEQ ID NO: 43313 - DNA, 1501 bp, Oryza sativa; identical to SEQ ID NO: 43273

SEQ ID NO: 43314 - DNA, 1501 bp, Oryza sativa; identical to SEQ ID NO: 43258

SEQ ID NO: 43315 - DNA, 1501 bp, Oryza sativa
gtatgagctagtgtcgaaagttgttaacactgtattgacagatcagaaagatcgcttcttttggaaaaacaataaagaaggcattttcacagtaaaatctatgtacaagttcctcatgtatgaagggctggttcctaggaagaatttcatttggaagctcaaaattccacttaaaatcaaaattttattgtggtacctcaaggaaggggtaattctcactaaggataatctagcaaagagaaggtggaagggtagcctaagttgctgtttttgtaactctaaggaaacaatacaacaccttttctttgattgctcaatggctagatatatttggagtgcgctcctttttacatttgggattaggcaaccgtgtagcatgtctcaaatgtttgggaattggctgaattgtgttgaacctaggctcaagagaatattgtgtgtgggcatagctgtatttctttgggcaatttgattatataggaatgatgtggtctttaatggctccaatcctacatctttcttgcagatcattttcatgggaacacattgggcaaggacttggtctttgcttcttaagggaaccgatgaagaaatagttaagaactattgcaaagtgttggagaagcatgtggtggaattcttctccgtgtatggctggaaccttagaagaagattggaagcctagtcttttcttcgtttgttgttcttaaaacctttgtttgtgctgtcatctcttatgtaatgggagaggtcagttgatgcattttgtacccttttattagggagagtcttatgtactcgtgttcggattttggctgtgtataccccacaaaggtgtagaggccgggtttgataatcctttatctaaaaaatgcaagctcatgtggttaattcattctaagaattcttccttctgcctggctgctctgatcttttcttactacatcgagataccgtcagatcatgacatgtcttctcttcgtccgttgcaaaattgtgtgtgtgtgtttttattaatcactccatcttctgccaaattgtaagtccatacctttcatttcatctggaccctgtgaacgggaccggatttcctgtctagatttgtcttttttaactaatttttaacttttttctattcagtgtactgatggtctagatggtgcatggatacaggaggctgttctacactggtggagaaaccatctttcgtcggtcggccgaattccacaatagtttcggttgcaataaaaaccggggctaaagatgattttagtcccggttaaaaagggtaacggacatatttaatttttagtcccggactaaagatgatctttagtctcggttcaaatgctgtcagggcctgccaggcctcccccggattaccaaccgggactaaagatcgtaactttagtcccggttagtgttaccaaccgggactaaagatcacggggatctttagccccggttcataacaccaaccgggactaaagtcccaccccta

SEQ ID NO: 43316 - DNA, 727 bp, Oryza sativa
cccggttcaggaagcaggccccacacgccatggccccaccaccactgacacgcgacgaaaacattggtctcgctctcacgcgcccacctgcccatgttagcggagcagacattttacctcgaacatgccgcggagacagctcatccatgatttcctcccccccctcccccccgattctccatcggattctaaaaaaaaaaattctctccacagattgatcgatttctccccccaccgaatccacgagatttcggagatttcttcgcggcgcggtcggttcatcgtctcttacgttcgtcggcctcagcctcgctcgccgccgccatttgggaggggagtgcgtctcgaggtcgtctggttgacggattcgtcctgtggatttgaaactttttttttggcttctccacccccgcaaataagcttcgatgcttttccctcgcgaatcgaatcgctcggttttttttcctcctgtgtgctcggtttgatggcgacgtgaagaggtgggcgtcgccgtcgaggttgagagcagccgcgctggcgatcgcgggcgagccatttgggttttttttttcggtcgtttggtttccgccaccgccgctgccgctaccgccgccgcgtcgtcgtgggtgtggttttgctttgctgcagcagctagtgctgtgtcgtcgtgcggcttgggcattgcggtgcccaaacacatcgccttcgtgggcgcctcttcctcagg

SEQ ID NO: 43317 - DNA, 576 bp, Oryza sativa
aagtagtatcctttgcatgatcaaattaatcggtactgtagcatatgttgtaaactctgttaagagcatgttaatgagttgtccctgtgtactctagtctatgtgtatcttcaattgttatttcttttatacggaactatgagcattccataaaatctgcaacacaactaaattgcagaccacccttaggctaaaccaatcacataatgcaactagtgaggttagaagtccccctgaatgttgttatatttgctgcagtgtaataacaagagtagtcttagttatcatagtatatttattatgtctattttagggcataatatgttgcgatttgtagatctttttttatttggtctcatttaaattagagtactgtatcatgacactgggttgttaccagattatcactccctcctgcagaggggcatgggcatgaatatggtgaagagcaagcaagcactgctactcctggaagactcttgttgtcaaatgatagccacatagcaggttttcaacaagtatgtcaaccgcaaatcaaaataaacatgcctgctggaagagaatccatctataagt

SEQ ID NO: 43318 - DNA, 203 bp, Oryza sativa
gttcatcaaaatttcagaacagaacgtcaagttgatgccttattccaaccattcaaagagtagcgtgagtataaacgaggatctgtcagccaatagctcgattattgccggagtccccaaaattcacacacaaaataaacaactgactcaagctggaaatcctcatattcttcacctaccgagccaccgatgtgtttcgcagc

SEQ ID NO: 43319 - DNA, 1501 bp, Oryza sativa
tttcatgcactggatatttgttcccttctcttaacgaacacagccaagcatcccttgctttggatactcccggtacggcaatattcgaatgtcaacgactccacgagctctgcgaatgaagcgacggcccagatccgcccgatctcacgcgaagccatctccccaccgtccatttcgtaccggaatccctctccgcgcctccttcccgtccattttgcagaaaccaccccgaacccaaaacccaaaacttaaaaaagagaagaaaaaacaaagttgtcaaatatcccatccgcttcatttctcccacgctctgaaatttgaaatcgcagacgaggcgagacgaagacgaagaggaagagcaagagctagggttaggaggaggcgatttgctccgcccgcagatcggatcccccacctcgtctcgcccccgatctcgcaccccccgccgcctccacctctgccgcgccgaatctctcagttggagccgccgccgccgccgccgtgggccggtggtcggtgcgccgcaaatcgcgccgctgccgtggccgtcgggctcccacccgcagatccagcatccaggaatcgtgcggctggggacggcgctccgcgggaccagggcggccagggtcgccgtcgccagggcgattggtatgtatatctgcttgcttgcttgattgttgtttgggatgtccgcttcgaatttggagctggaggaggaggaggaggaggaggtgcttttgtatgtgtgatgaatttgtctcagtgagatctgtatattatacatttttgttcggtaaattccatggcaaaaatcaaactctctttggtactaaataaagctgaaattcagacaatgcaagcattagaggtccatatggcagtgcatatcacccacacccacccacacacaaaccattagggtgtgaaattagcttctttggtagctcggagggtagaatgagccaacaaatagttttgctggttaattgatcctgcagaatagttttagaaaagcaaagatggactattttttttcccaatctataagttgtacgcttggctggatatcaatcgattgcctccatatacatgatacatctgtgtgaatgatgcaatttttagtttttacgaaagatgtacagtgaagggatggtgtactggtgtagatacactatcacctcggctccttctttttgatagaagattgtaaaatccatctttttaagaaagccaaagtgacatgagttctactccccattccttttaaatgagtaaattaatgtccttatgagtgtagtcaatgccctctatgcattcctgaacacttctattgttacatcttgtgacaagaacttcattcctccatttctattgcagcctatgatcgcttattccttgaagcaactccctgaaggccttactcaggcttgaccgtataatgatttttatatcccttagaggtttctattgcaaagtgaggattgaatgtcttcagtcatga

SEQ ID NO: 43320 - DNA, 1501 bp, Oryza sativa
cgtaatctagacaccatgcctaaactaccagatactactctaatatcatcgtcatgacatagagtaattgcataagcaaacattatacccgtacctatgcttctcccagataagctaccagtataatcagtataacatgaacataatgtaaagttggcattcatatactcgaaaagtatttcaataccagaaatgtataaagaagagtattctaaacaaagtacaaagcttacaaaagaagaaaggaaagctactagagccatacccgatctcttccgaaggcttccggactccgatttctattctattcctactccactagcataagactactaaactaaacttgagagaatatgagagagctttgcttggagtgtgtggaggaagtgagagtgagagctacttttatagcttgagaatgacagttgtggcggttggaatggtcggaaataccctccaaccgccatagggagtcgatctcagccgtccagaagaaccctggatcgagtggtgccgtggtgggttagaccgaaccatgggttgggccggcctagcccaaaatcggcaggtggccttctctgctgctctcatacgcagacttgtgaattttgccacagttcattgtgtcaattctgagttcttggcccattcatgcataagtctaatcctcgacatcgtccgattgatttatcgtctggtttgatgccgattctcctccactttatggttattctctacaacaggttagtaaacctaatactagtggagtattattatttctaacacaaatatgcattgcaagcataactagttctcctctattttggtaatattgacagtcgaaactgatcgctaacgaccataaacattggtcagcgatgtcatggacagggagctcgttgggcacggtggttgaccgacacagtcgcacgacaacgtcgaggcacgctagctctctcagtcagccaccggcgcatccgtcgcctccacctcctccagcgtcggtcgtgccggcttcggccggcattggcgcatcgcaaacaacgtgccatctgcacgaggaggacgcccacaccgtcctcggcaaccttggtcccgcacaaggccgaggagctgccatcgagggtggccaagtgtgactatgcggcgctcgctgagggcgtcagcgcatgcgggaaaagagggaagacgagagagagggcgtggagaggtgaggatgaaatgtggtgagagtcgttgacacgtgggttgcacctgctaactcagcaagtcaaccacaatcaacctgcctatatcaacagaaaccgcttcctaaaccactaaggagatagtttgcaccagttttcaaaaataggggtggtgttataccgggttttgtagtggaataacttcacccgaggtctctcaactttacgtcgagtctgtttaagatccctaatcctcaataccagaaatgtctacctctcaaatatttaaaaccatgcaaaataggttctatggc

SEQ ID NO: 43321 - DNA, 1501 bp, Oryza sativa; identical to SEQ ID NO: 27793

SEQ ID NO: 43322 - DNA, 1389 bp, Oryza sativa
ttcgtccaatgcatgtaaaatacatatcataatggtatcactgagattacaaataaacaacaatggcatagttacaaatacacaaatagtaatggcatatttcaaaactagcaaatctttaatgttattctgttaataaaaaatgtttattaactaattacttcgtgtcaagtaaaaagaaaattcatcccgccatccacaactctgcctctccatctaacctctctctcctagtctccttctccctatgttgttgctcaatcttctgcactccccctcccttcctccctattttacgactctcacactcctctccagcgacaacactgttacagccactgttcaccatacggcagcagacaatctgatcagacggaagccatgttcatcccgtgtgcgtcagcatagcgagcaaaattgcttggcccgaataggttgaagttccaactgtatccggtgcatctatataagcctggatgaagggaggagaggggtatgaaaattgtaaacactaaactacttcccaaaactcaatacatctacctcttctccaagacactatactctgttcttcgtgttcttctttatcctgccaatttcccctccaatctctctctctctagatctccggcccctacatggaaattatctttgattttgcatgtttttcaaaggtcataaaaaaattgacacgatgcatcaacatgtggcatacagctggcacatatatgatatgccagtatttttgacatgcaaactcgaatttccaacatatgtgaaaaattaataattttgagtccaaacaatacgtgtatttttgttatttttttccattttgtataggttgaattcaagcatggattgatatattatatatgggtctattatatcaaaaaaagttataagtttttcttgacatgtacaaaacgagtaaacgttcccttgagagaaaaaattccacctccacctatatagaccatattgcgtatcagaagaggaaaacaaattcctacaaaaatgtttatgcgtgtttttttagataaaatgtttctgcatgttctggacacacggttgctgcttcatttagtgctttgttataaagaatagcttctcttcttattagatgtaaaaagatatataagttgaggattgaaatttacaggtaatgaatatggttattcagtttgcagagcttatacatgaagtcgtaaatatgttgcattgatgccaaacttttttggcaattgaaacatctttcacgacagccttagcgaatactaggacaaaattcttcaaaaaaaaatgttgccacactttgctatgccacaaagttttagttaacgggtatgcatggttgattgaaaatttccatccaatattttgtttagg

SEQ ID NO: 43323 - DNA, 988 bp, Oryza sativa
ctcaatatgtggctgctggttgccacgggctgcttgcttgaagatgaagggatcaacgaatgagcttgctggggctagtttgctgcttgaagaccacgacgaagacaaagactcaaatcccatcgctggcgatgcctccctgttgctccctgattgggtcgagccgtgcgcatctgccgttagaattcggagcgtcagacagcactgcgcaggccgttgtgccaaatgaccttgtcagatgcagtgatggggaagatgaacagtagagaggagaggttcaagaagatggggtaattttgtccaaaaagtttagaaaatacaataaaggagtaggtagtggcataaaccaaataaccacgaaattataatggtatggttacaaatagttgaatactaacggtatatttcaaaactgacaaatttataatggcatgaatctaattaacctttaaaaaaagctaccatgaaatatcacaaatgtgtaaaaaaaacccaaatataacaaggcagtaagttaagactatattctaacctccctcttcccaccttccgctcgtttttcttgagcatatgcttctcaaattattaaatagtgtgcttttaaaaatgttctaaagaaatgttgttgtaaaaatacatattaatccatttttaagtttttagctaataattaattaattacgtcctaataagctattgagcaaagaaaaaaaaagttaactgctgcttgattatttgggttcaactggcaagaactatgaggggatatcgattacctattctgtggtaagcatacccattaattaatttacggccactttcgctactcgctaaaaatagaactaataatgacttaaaatagaaaacaagagaggagcaaacacgtactctgaatgaacggaggctactgacgaccaaactgaaccaaacacttgtgaagctctcctgccaaataccactccatacccgcgaaaaacgctattcaatt

SEQ ID NO: 43324 - DNA, 1501 bp, Oryza sativa
ttctgaaaattcgctcatttcggacccctctgatatgatattattctggccgaaattttttacttttttaaatttttcatgatttaggtaatatttgttcaaatttaactaaattttgttcgaaatttcggtatatcggtgaccttcgatcaaatcagctaaaccaaaaaagtaaaccctaggctgacgtctcgcactttgttaccactagaactacggatgttgacaacaagagtagaaagaggaagtggaagctgctttggatctagacagcccagtgacaaggacggcgagcttggttgggtgatctcgaggcatcgacaacattaaggaggaggtggaaagctccactatgggaacacaatatgtgcggtagcggtggagttggagcaagaggtgaggccatggcaaagagggcaagtgcgagagggtcagtaagcagcagggtacgagcaagagagaaggtgagcagtttggtagacggggaacaaagatacgtcttccgtgaagatagacagatagaccttacaatatatcactgatattgcaaccgtcacagacgtggggccaaaacgatgatcctacttttgtgatggttcatcttccacttcctccatatcttatcttagacagtataatatatcttttggggttacgaatgcctggttctgttgtaatgtgtaggtctgattgccccctcgtcatgaccaccagatcgagcatgagcgcgagcgaaggaattggaattggcaatggcgaggacagatagctcttgaccaactccacaaccaccgtgatatatgtttgtggagtaatgtttcatattaatctatcttgtcaatgtcttttatttttttaatgactatttaggtggcataaaaaaagataacattccttccacggataaaaacactttctccaactatagtacacatataaagttttttttacatataaagtacacttatatgttagaaaaatagaaggaaaaaattcaaatacccccccctaaattttagatgaaagtccgtctagcattctaaactttgtaatatagattgtattgtaaagtttagggggttaaatgtccggttttaaagcttaaggtgataggcggagcttaggagagtatttggactttttccaaaatagaatattcaatgagcccagaaactgaaaatatcgccggcatcctttttaggtaatcggcacgtcacaattcacaaacagaagtatacatgtagagttctactccgaatcaaatctaaacttcgaaaccgctacaaattgacgcatcgctagctgcaacgccacctattataccggattaggttaacatctcgtgcagccagcaagccaagaagtcgtcgatttgccatggcggcggcgaaggaggacgacacggtcggcggcggcgaagcctgccggtccggacaggcggcgctggcggcgcgcctgctgaagagcctcgcgtcgggctcgtcgggcgcggcgggcggca

SEQ ID NO: 43325 - DNA, 1501 bp, Oryza sativa
gtgtttgtctttatttcttgtcgcttgacactcgtattacgctagtaattatactcgtccctagatctactattcggtataattgcaaatcctttaaccagtagaattacaattgtactctctccatccacatccacaaaagttacacatattacttttgtcaccaaaatcaaaaagaaattaaatcatcttggatgttataaatttaaagagtgaatgtaaccatgcaaccaataaatatttagatgactttttgggttctaatcaaacatttaatttatctcttcatctaagtcttgaatgcataaagattataaatagaaacaacttatttggaaaaacttaaatgtgaaatatgtgtaacttttgtggatggatggaatacaaaataaagcatcacggttcacaatcaacccatgaaaacgaaaataatatttcagttgcacacactcaaacgcgcaattgggccaaacatatacaaacgggcgaatacatcatcgtctcacaaccgattcacattcagacaagccacgaaaataaaagaaaaacgaagtaacctctaccgcgcgcgaaatctcactctagcatatacaatcaaacatacatacctatacgcgtcagtacacatatatagctatacgcgtcgccgcgacgtcgatcggccggcgtgcacacactcacgtactaaggagcaaccgagagctagcaagcgtctcgtcttaccaccgtgtcctgcttctgatcggtgacggtgacgccgccgccgccggccagctcgcggtacatcacggcgaccgctaggaagtaagtgatagacaggatcagcaggaggagcggcgtggtttccgcagccgcctgatcaggaagctcgtcgtcgtcgtggccggcgagaccggccgccgcagcccatatagcggcagtgaatgcgagggacatgagtggcacggccgttagcccaccggtggagctaagctaggcgcgcggatggtgatgactgacgatgagccactgtttagtcaaattgtgtgagagagggggcaaagggtagctacgcctgttgttacccgacacatgtggttatatatatgggcggtagagtcggtgctaatgttaccttccggttaaaaaatggtatgatgtaccgagtaccacctgcctcatcttttcgcttaatagtattaactccaaatcatctatagccaattcatataatagttgtttactatactattaatacctggtcccacatgtcatacacacattacatcttggagtccgtgctgcagctggctacagatctgtagcccgctgctcttctctctcttcctttatctctttaaaatatgtttatagctggcttatagcctgctattgtacctgctcttatgcttatacttatcagccaaaatttaaattttaaattttaaatttggagctaattttgaggttttttcatcgaagtttatttttcaacctttgcttttaaattactaagaacacg

SEQ ID NO: 43326 - DNA, 1501 bp, Oryza sativa
gtccgttcttacttccgacaatctgacctagtatcataatccaaccatgtttcgctttagctttcgtatttcattttaaatcatctattcacctcctctctaagcgatatcgaggtcattttacttttctataaaacaaatggttcaacctgtatcaatacgtaaatggtgccatctgttaaaaccattaatatacgaatggatgaaaatggttcagatagttataatactgggatgctttttcggaaataaataatgtcggccggatattattttttgatagttttgacaatagaaacgaatttagattttttttttcagaaaaagatacagtaaggttggtatatggcgaaaacgaaaaatggttagaaaatatatggataatttttaaatagttattcggatagctttataaaaccatttatctccatctttaggttcacatctctatcccaacatatttgttaaataattttattttagaaacaaggtatgcagctatccagtatgtcatatttgctagttacaaatcatacactatattcggtactattatctataataaaaacattatttattatagtaatatatcaaataatttgtttttaatggaataccttattattttaaaaagagtaagaagtgtccatgtcaattacatttgttcattactaataactttgaaatgaaacaaattacatttaaaattgagattctaatatgaatattgaatacaacttcatatttacaattatattttttattaaaatctagaaaaccaaagagcctaatttagaataacatattatatataccacgaatttattttcttttggataaaactgcctatatttctttgttgactttgtaagaatggtaaaaaggtctttctttatgttccgataaatattcgtgcccgtattctaactcatattcattatgtatcagtattcgataatattcgactccatttgattttcttttctgattccaaaaattataggaacattatccccgtataaacaagttaggctatgttcgggaggtaaggttgggcacctctcgacacggaaaacaaagcacgcgattatagtgaaattaattaagtattagcctaataaaaaactttaaaaatagattaatatgattttataaagtaactttcatatagaatttttttttaaaaaatatattgtttagtagttttaaaagtgtgcgcgtgaaaaatgaggcaagtgagttgggaaagaggggaaaagaacgctatcttcacgggaggcagttcccaacacaaacacgaaaacggattggtccattagcacgtgattaattaagtatttgctattttttttgaaatggactaattttatttttttaagcaattttcgtatagaaacttttttttaaaaaaaagacatagggagagatgatgggaaaaggggcatccggacacaacatagtatatacgggtacaatacatagacacaactattcaccgatc

SEQ ID NO: 43327 - DNA, 1501 bp, Oryza sativa
tcaaattgtaggacttgatagtcacatttacgctttcatcccagaacagggcaattcctcctccttttcctataccattgacagccagacatcctcgaaggccaatttgccatttaatattctccacaaaaccttgattctgtcgtgtttctgataaaaacaccacctttgggcgatgagtctgcaccatgcagacaagctcttgaactgctcggggtcgcccaaggccccgacagttccagcttaaaaacacattaggcccggcgatgctcctccaaggagcccgccgatgttgccaaatcagaattattacttgaaccctccatcttttgtttcttgacatctctacttgttgccccgaactcttccatcttttggatctcgtcaccagactcctgtaccccttgggtcctcttctccaccatctcagatgattccagaagcagaatatcactggttgcatctttttggtgttcctcctcaagatcaagtcttctcttgcttgaagacgaagatctggtcggtccatgattaatctttactggactcgatgcagtatccatcagctcatcgtccgtttcccatttattttctgtgggagtccaaccacgtcctccccttcccctaccagatcgtcctcctctcctccctcttcctggaccaccgttccagggagcacctctgcgaaagtcaggtgcagtcagggattcaggatattgtatagtctccgggggtgcactccatctccattgggagaattgggagaattggaatgaaaattgggagaattttcattcaaaattttaaggatttggatgtgaagtttttgaatttttagttcaagtttcagatcttcaattaaaaagtcttttgaagttcgatttgggagttcttccaattcaaaatggaagtttctatactttcggattgaaagtttttccaatccaaattaaaaatttcaggacttttgggttgaaagttaccatcagatttaaggaaaaaccacttcggaccacttgtgaagactcacgcggagtcacggttggaatcgattgatggggaacgcctgcctgccgcacgagggggtggtatgcggcttctttctctcttttttctaagtgtgcactagaatcataagtagcaaacgtgcgtcaaatagcattcccaatatgcatattcatattggctgattcagttcaatgcactacaaagaaaaaaaaaagagagcatttcaattttccgatgttggactggatgtcagcaactcgatccgctggtctggcaaatgtgggccggcacggactgggcctaaagagtggcctgtcgaaggaacggcccgtgataagatgggcctggatgccacagcggcccgagttcgacccattgttttccagtccgaatcccagtcacggagtcacctcttctgcggtattccgacttccgaagggatcggagatcggcggtgcgaactccgaatcagaatgggagtcgaattgattcg

SEQ ID NO: 43328 - DNA, 1501 bp, Oryza sativa
atggacaatgattcaagaatcaaattcctgattccttgctaaaatgaaataaagaattaccatgttgtttcggtggcaatgcccaaataaaccgtggatcagaacaccgccaccttgtgatgatcttgacaaggaagtttttgctacaacaaccaaggtgacaattggaaatggtagaaaagcatatttctgggaatccaattgggtgggacaccagtcgctcaagtacctcgcaccagcgctatataaccactccaaagggaagcatcgaacagtctgcgatgcactaatcgacaaccagtggatcagggacataaggcacgagctgaatttggcactagttcatgaattcatcaaagtctaccagtagatttgggaaggtgaaattaccttaacagataaaaccgaagacactattctttggagatagacaaacaatggcaaatattcagcaaaatcagcatatttgggtcaattcagtggcagaattggatcaagagcagccaacctaatctggccgacctgggcgccgtccaagtgcaagaacttcacatggctgttgctgcaaaaccggatttggacagcggatcgccgacaacgccggcaatggcccaacaattatttttgtcagctttgctacagaaatttagaaactgcacaacacctcttcaaggactgctctttcacaaaggaagtgtgggacaaggtctccttaagactaaaccacaatcacatccctacgccacacaacgacgacgagactctgctggattggtgggaaagaagagctaaccaaaccgaaaagggcaaaacaaaagggatgtgctccctttcacatgatgataaattgggagatttggtgtgaatgaaaccggcgagttttcaaaaacaaagaactcgcaatgccacacttgctgacgaagatcatggatgaaatcaacaaatggataggatgcggggcaaaagatttagcgagattagtgctgtagccttcccgtgatccttgtagctctgctttcctctctgctccctcttgtctatgcgtctcctctgttttttcttttggtcctttgtttctcaccgttatcggtagtgttgctgtacagtttcctccccttttaatataaaaccagcaaagctggctcaggtttcataaaaagaattaccatgttcatatttatattcggttcattcaatttaatctaaagcctacaaagcaaaaaaaaaaccggtttccgatgttggactggactgtcagtgactatgctggtctggcgaatgtggccggggcacagagccacagattgtggtaaactacggcctgttgaattaagcccatatcgaactgggcctggatgtcacggccggcccacttttttccagtccgaatctctgtcgcggagtcatcacttctgtggtaacactggtactccgaggagaggatatcgcggcgcctcggcggtgcgaactccgaatcagaacgggagtcgaattgattcgt

SEQ ID NO: 43329 - DNA, 1501 bp, Oryza sativa; identical to SEQ ID NO: 27791

SEQ ID NO: 43330 - DNA, 965 bp, Oryza sativa
gtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacactgtgccttaatgagttctgttggctttaattagcgaagatgctgtcctgcagagcattcttgaaagaactcacctttgtaagcttgactgttggttgcagtctatggagattttgggtgaatcttctaggaagcttactaaagacctaggagtatgacttatacgctccacccaaggggtagtctacagtcggtctaggaccagataagactctgagtgaaacttgcttgcacaagacttgcaattcaaggcgtagtccattgttcaagttgtgagtaagtgtagcttggagttctaggtggatgttcaaccttaatcggtctccatcgaacagctggtatataaacagtacattggaaaaggcaaatctacgagggattttgagatttggtgggggattgttggaattaatagatgggctaaggcccattcgaagattaattctttggaaaatcacaaaaacccacctcatgggatggcatgcatgtggagtttagtacaaccttgcttattctaggagagggggacctccttaaaagggaggatgccctc

SEQ ID NO: 43331 - DNA, 1501 bp, Oryza sativa; identical to SEQ ID NO: 27788

SEQ ID NO: 43332 - DNA, 1501 bp, Oryza sativa; identical to SEQ ID NO: 27786

SEQ ID NO: 43333 - DNA, 1321 bp, Oryza sativa
ccatctaaacaccctaagtacggttttatgatagacgagtgatctgattaaattatttattagaagagttttgaatatacatagtttatgtcatcgtaacaattattgtatgttatgatccgatgataattatgcagtagagtaagttattataccaaatattacgatatttttttaaactatcgatcattgttctattatactaagttttgtactaatatcatacatcaacaaatgttgcgcgtaggcaccagcatggcagcatatacttggctcattcgttgaattacgtcagtgccaactctagaaactgttttatgccagtttacttttgtgctggcatccctgtatcaatggtcacaagctaatttgaataaaagtttagctgtgatcaaacatgtatgtactaattaatgtttatttcaacgtttgatgccaactctaaattagctggcttatacgttggtccgaccatctccatatgagtggtagtaataattaaggaggtattgtatactgataaaagcttagattattggaatattatagtcgttatgattacattgtgacatatttttctctatttaaagggttgtcgggtcacaaagccgactctaaccctatccttacaactaggggtgaaaacggttacggaaattccgatcgaccgagcgccgttttcgtatatagggcaccgttttttaccgtaccgtttttgggtatttatgaattttgtttttttctaatttctttatgcatcgtattaatgtcggcgctgagtagtttaaatgataaatatagtcgattatcgaccgatcaagcgtcgcttccgaagagatgttactgattcctaccgttttcacccctacctaccacctattgaagtttatatgtaattaaatataaatagtatattctatatctattttaataatataaatggtttatatgtatatatattttttgtaggattgaatcgattaagatgcactaaataaaatgcttatatttacgaacgaatgcagtgctatatgcattatcatccctttggtaatcgagatcgatcatgcaatgcacgggtgggaatatttttgggggatgaatagcaattagaaaggattgaggaggttcctttggccgaaagggaacagaaccgacaaaaagggaaacatatagccggcggttccataactaaagcacgcgatatctatgccatattaaaaagaaaacaaccgtggtatccgttcccaccgaactaccaggctgacttgtgggcccacattgtcagtgggagggggagcgggtgccggatccgagtgcg

SEQ ID NO: 43334 - DNA, 1501 bp, Oryza sativa
tttccacttctacgaaacgaatcagctacaagcaacaatacatataacgtgaatgcattgatcatgcgctgcagaagaaccatccttgtactatcatgaaaatactttatcaacacctactagctgccgtaagacaaccccactatgctaagtatttataacctttatatccctgctatatgctgcttgtttctctgtaaatgttatgttaaagacatcatcttcacctactgttgtagtgtagttgttaagaacaaccttatcactgtcattgacgattttgtttactcatatacccaatgaacgatgcaccaccttctgtataacttgctatgttatattatgttgctgatcattttattaccttcataaaccttagtaatatgacacttatactcttacagtctaagtcagtttctttgcaccatatccactccattaactgaactgataatgctatgacattaacgtttacacccggcaatccaactatccacaggcggcgcgccagggcgcgcccatccatctagtttacatactacttataaactatatgcatgtacacatcatgtaatctatagaaacaaatgggtccaagaggaatagtgccactgacaagactttaagcaactcaagaaaataacaggcactaatgtttcaagtttagtaagcatactccctctggttccataatagttactctctctgtttcacattgtaagtcattctagcatctcacatattcatatagatgttaatgaatctagacatatatacatgtctagattcgtatatatgtctagattcgttaacatctatatgaatgtagacaatgctagaatgtcttatattatgaaacggaggaaataacgttttggacaaagattgcagtcaatcttttataactttgactatcaataactttaaacgtatttagtttaaaagaactagaataacatatatggatctatctttcaaagctctataataaaagtaaacatgtatttatttaggtccccatcgtttggcttatttcctaataagtcaaaacggcttattaggaaataaaaataaatttatagatgaaatttttataaatgtgttcttggtgacttaaaagccaatgttgtaaaagaaactacgttgaaaatatctcaaaatcaatctcaaaattaagtttgaaaattcaaaatctggctttttcttttactgattaggccatccgatgggagccttattgtatactccctccttccaaaattctaagtcctattttattttttggtttttctaaaagtctaagtcctatttggagtcaatatgtgctatattaaattttttattggaatccaataagtcattttaatacttattggttgcatgttcattggttgtgttacacgatgaatgagtttacaccttgatcctggtgaaaaaagaaataagacttttttggaagaaaggaatacattacatttataatagaaaaacacagaccgtg

SEQ ID NO: 43335 - DNA, 1501 bp, Oryza sativa
atatataaagataaagtcttgttgtttctagggctaagaatgtaggttatggatatatgtggagttcaagtgataatgcaatcaataggtgttattctaacaagttttacaaggttttagcgtattaatgtacaatcgacatgcaggatttgcaaacattttcaataacctccaaaacataggagcaatgtattcaaagagagggaggtgggacttgccttgttaatggtaaaagtcagggcctaattcacttcttcaccgttattgcgacaatctatataaattacatgttatgcgattaaacaccgaaatatgcggaaaatccaaaatgctctaaaatgcatgatctgtgcacagtgggtaggtgctggtttaaactgaatttaggtgaaagaatttccattttatctcattccatttgagagttatggattttagaagttttatcggtatagtatagtatttgcttaggtgctgctatgaaatgcttttgtaaggtgatatttattatatttgagtttgctggggtgaatatatgagttctctaagactaacacatttggtttcacaatttttagagtttctatgaatttctaatgtattttacaagttgtaacgggttgtaggcatatggtccctatagtgtatgatatagaggttctaggtccataacttgttccatcttgccagtgatgtacaaaatgagtaattgagttaactaatttaactttggtccataattttagagtttttagtattttactacacgttttataaataggggcatgatctatgttaattattcactatgctaatctagaagtagtttatgtatgagctaagtgtgataagttttgatgcataggaatggaactatggtttatctggtctattaagttttagttgaatttagttagagtgcatttaaataccactacacctatataatgcctaaccattactatgtgattagctcttaggttacctattaaggtttagagctataatctgtatagaagctgccatattttattttactatgttgaagctcattacttgccagttctataaaaatttggttcacttcatttggattaaagatgaattttctacaaattttacaaattgaaatgtacactaggttgtttattccttatataaatatttaagggctattgttatagagtaagaatatatttttattttacaacctggaagtatatgttttgatgattctataggatctgagttcacccaaaaaggagttaagatgaattctatatgaatttctaaagttcagcttatctaaatctagtcattttaaagatattagttttaaggcatttgatgtaaaatatgtacatattttattttactttgtttttagataatatgttggtggatctatagaaattaagtttgcaccaatttgagctaagattaattttatatgcattttataagtttgtgcatgctttatgtgtgacttaaattagatgag

SEQ ID NO: 43336 - DNA, 1501 bp, Oryza sativa
ctcatgatttgggtggaatattgtttattaacatttcactgcgccttccaatccaattagtatagttcttttttacttgattacatgcacgcgacaagcaacttaatacattacaagaggaagaaaacatgataacggattggattaatttagcatgctcaggccaagcagatgcatcaagcattcaagctctttccctagctaatgagaggaaaatgttatgtgtttcaccatgtgtatatgctcagctgctgggtagtagaatcctatcagcccagaatccatgtgctgaagagtatggatggagatgaagatgccttcattctcccagccggcgttttttcaatctgtatcatcactacagcaatgaactagcgcaagccactgttcactcatgagttgttcaccccacaaggagacttgatcttaaatactaagatgtgcgacatgtggctaaatcgctttatcatttcctgttggctcccaatccaatattggtcagacttcgtggtcgagcatcatgtacatatgcattatattgcaagaagaaaaggaaaatcatttagaggatttcagcaaggggaaatgaaataggataatcagatggaaacgactctcaggcactcagtagcatggccatcaactcttgtctagtttactctcgggaaatggacctcttgccatcatgttatttcatctcatagatggtgtgtgtgtgagagagagagagttggaaggagatgcacaaacaaaaattgatattaaaagaattaaatgagattattggtttttgaggcccactgaaataaatgtgtttagctgccaccacttacactgcttgtaagagtggactataaaaaagacctgttcctgtttggtggtgtcacgaatttgtttgaaggatcgtagttgtatcactgcgttgggcatgttccatcagagagttaaacaggagcattcttcatccagcaaaggatcaataaaatgactgacacctaaatttactccaagttcttcctttctgttatcatctctgctaatattaccgggctctcaaatcgtcccgcgagtatcaagccatggttcatcatcacgattcatccatctgttaatcagtagtggcagaatgtgaagaaaacaaattatgtagcacgatttgttctcaagttcatgctttgtggatcatccagatttgaaatcagcccagtaaaaaggtattaatcatcagggtagggagactaattgctgtagacagaaaaatggtggagcatttcaaatgaatgcgattccttggcagccatcacagtaaactgttgcatacaattctctgctgtgtagtcagacagctaaaaatcaaacaggccatgaaaagagaacggcggaaatcatgccaacacccaaaaatataacatgtacagaatctctattgacaaatgagactgaacatgtacattggcattaccatctcagtcaatcatcagaatgtacagaatctactcag

SEQ ID NO: 43337 - DNA, 1501 bp, Oryza sativa
ctccagggcgtcgttcacggcggcgaaagcgtggcggcagctgtcgaagcactggtcgaccttgtccttgcactcgtccacggcggcggtgcagtccttggcgccgtccctcgccacgaaccaggcggtggcgatgcacccccgggcgatgctcctggcgtccttcttccccgcgacgatgttggacggcatgttcttcaccagttgctggcacgccttcacgtccgtcgtcttggggcacatggcctccatgttcaagatgttggggtcggggatggcgccggcgttggtgttggcgctggcggcggagtcgtaggcatcggccgccgagacgagaacggctaggaggaggaggaggaggagtgacggcattgcgggagaggcggccatgactgggcttagctagctttgtcgatggagatgaattaatggtgatcgatggctaaagaggccgtggttacgccgtttttatataggctaatcgcacagcgttttcgcctgcatggatctaactaataggagagcttcacaagtgtttggttcagttttgtacacttctttttttctattttaagtcatgggactagctatccatcacacgacagatttttgggtccaaatcacacagattttagattagttggattaggctcatttgatcacttgattagaagagtctatacatgtatcaacatatattaattatatatattgcatatattttatttgttagatctttacattgaaaaaaatatatcaccaacccatctactaaaagttacagtgtaattacactatagttacagtgtaatttcactatagttacagtgtaactatagtgtagttacagtgtaactatagtgtaattacagtgcacttacatgtcatatcaactaaacttataaatataattttagttatataggattgtaattttatattttaaaggaaataacaagtacatatttacttacacaacatttttaccaaaattatagtgcacttacatgtcatatcaactgaatttacgaatgtaattttagttatataggactgtaactttatattttatttcttcaatctgttcacctagctgcaacgacgtgcaatgtatgtactcatcaattatgtgccaagctagatgttgctggcctcatgcgtgcgtgggaaggaaacgcatcacagccgctaattaaatcatgcacagactaatccacaagggaagtaaatccgagtgatttcgtgccaaaaatttgtcgccagatttttagcaaaatcgttaagtcattattagcagcgaaagtatatccggctgtaaattaattaatgggtacacttagctaagaacaggtaatcgatatcccctcgtatatagtcctttccgattgaacatatatactcgtaatcagcgtaaaaccaatttaaaggctgtgtttgttagtagttgggaacttttgttttcctccgcacgtaaaataaagtagcttattagggcacccac

SEQ ID NO: 43338 - DNA, 1501 bp, Oryza sativa
ggatatatcataaggttgattttttttgacggttggaatatcttagaaattagaaataagttgtttaaagtttgattaaacaaaaagaaaagggagagagaatgcagagtcagacatgcatacgatgctccgccacccctagctccctgtacgcatgcaacgctacagagatgcggcaaagtgagcgacgtttgatggctagctttctccagaaaagtttggaggaaattatcgatccggcgcgttacgttagtgttcatgtccattaaaatcctgacactaattgataaatcgtgcaagttacatgctatgctaaggcttgctacatgtttgtattatctttttttttctcaaagtacaactccaataaaacttcaaattgttttcttcttctaaattacttatctgaattgaaatccgattacatcattatattcgttacaattaactcttgctaataagatctcacatgattatatttttttataaacatatatcttcaatttataagttgtctgtgtggaggaagaggaacaagaggaagcaccaaaccgcaggaaagaaaaagaaaataatttggtgtcaatcaaaagacttaatttctaaaaataaggatggaaaaaaaaatcactcactcactatacctagaaaggtacttaacattaatccaatttcaggttgaaatatatcatcaatctcccttcccaatgcaatcaagttgttaactagttagtagttacacatcgctggacactacccactctgaccgggtaagtagggaaaatatacggtggaaaccagctatgcagtgaaatcttgaaaactaccgttggataaaaaatggacgtctaagatttgttcacgtcattaccagtaaaaatactcaaggtaaaatctttacttatgagtaaatccgtgagtaaaatttttactcgtgatggcgtggacgaatgtcagacgtccatttttcgatccaaagatagtttctaagtttccacatgtggttttcaccacatatttttccgggtaagtggatcttataggaggcagcctttgtatgtaggggcgaattaaatttgtgctctctctatttcaaaaaaagaaatcaaattctaactataaaatatgtgttcgtccaaattcatagtcagcatttgtttttttagacggatggtgtaggtatttgaacccatagttttctccggacaatagaaatatgctatcaaacttagccaattacattaaaagttattgcactgaaagtgatcttaaaacccacataatcacaattatatatacttgatttacttcatatgaatgtagtctacgacgatatgttaatttcgatcctaatatatattgtagttagaccattactactattgcccatggttatatatttgaatgtccttgtaataataaactgctattgacttttaaaaattacgttggtaccatataatgtgtacgggcgccaaaaaaaaaaagaggacaataagtg

SEQ ID NO: 43339 - DNA, 429 bp, Oryza sativa
tacaaaaagcacttagcatttttaaacgtttgctaaagatgagaccgaggtgaaagacgagagttgagaagtcgaacactcatcactaaaaatgaaaaagggtcgaagtaataagccctcaaacaaacgaagcgattaaaaaataacaagaggaccgaaacaggcagacctggatggtcgaagtatattcacatgataaaaaaaatactttacagatagattacaatatccggatcaggacattttcgccttacccctgttacctcagacgaacatggttcgtcatcgctacttattttatatattactctaaggggggaaggaggtgaaatgcacgccaaactataccgacgtcaagcaatagcagcttggcaattggtcatcttgaagtttcgccaaaacatagctacatttttgcggcgttggaca

SEQ ID NO: 43340 - DNA, 555 bp, Oryza sativa
caggcatataacataccaaggaaatgactatggtaaaaacaagtcattccaagttaacccagactgcttttgtagcctaataaagctgacaaaaacagtataacacctttctgtcgggcaccttttaatttgcattgcaataattcaaagaattatatgaccgcataaaaaggattttatcagcattgggcaacactattgtgcgcataaattgccaaagcaaaaaatgcctaagtccctaaggaacacaatgggccacgctgttaaaaatactgagctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccatcccactcgaatccaccttcaaaaagttcatcaaaatccttcccgtgatccaccgccttaatccctcatctctccacagccatccctcgaaccaaatcagcgcattcgggtaaaatcga

SEQ ID NO: 43341 - DNA, 1501 bp, Oryza sativa
gttcttgtactagtggtcacactttcatgttctacatgactgacatcatgatctatgttgtcttgtccccctcctgaaattgtgaggcaagaatctgttttcaaatgtgatatatacttgcaaaatgtaatttaaatgggctgcgattacctgaatcctctagttctactccataaccaatatccacatgattggcataaacggcaaagtcgtcatctattcattggaacaaaaaataactttcagcttcaaactttgtaaattatgcatactgattatatggaggaaatagatgtgtttatcataaattgtgaacattgtacacacattaagttgtaaaaatgatttgatacctggttgatactcataatcctcctcttcaacctgcatgttaacatcagaatgacgagtagcgtcaccatgatattcttggtcttgtggcgcttgttcttgctcttgttggacttcaccataagattcaaattctacaaatatcaaaatgtgtcaataagttttaccttgtcaataagtttcacactatgataatgctttaattatttatggacataactacatccatctcgttgttattatgattaggcctattgtaaccatacctggttgatcttgataatcctcctcttcgacttgcatgttcagatcgaaatcatgcatgttcagatcgaaatcatgggcaatagtgacatgatattcctgtatttgttcttggtcgtgttcttcaccttcttcagcttggtgggattgttcttcatcttgccatgagtacattacaagtatagtgtaaatgaggatgttagatttgttacatgccattcatatgattctagattatgtcaaatgcatttttagattccaagcacggtactacgaaaatgaccatatactactactacttgctgggttttggcaataaggtaggagaagtccgtaaacttgtacactaaaatctgatttcccccctatattatttttgagtttttaacattgctgccattatcatgtcttgtcctaagtcctgacagcaagaaagaagccttgtgcatatgatgaaaagcgtcaacaaagccactcctctcccgatcagaggtatgcatatactactaagttcaacttatgcatggaaagcaagctactcatgatccctcctgatactaaaatccttagcatgtataatcttcttgtctttcatatcactggtcatgaaatgtgctcatcacaatcaatatcatcatataatccctttgttatgcaaaaacttaatcatgttctttataacacatacctggttgttttccatacttctcttcttcagcttgcaggttgagatcaagttggagggcagcattaccatattcttcgtcttgcacatcatcttgtcggagaccatgttcttcaccgcactcttcatcttcttgtagtgctaggttcagatctatgttcattgtggcctcgtgtatttgttgggttgtggatggatggt

SEQ ID NO: 43342 - DNA, 1501 bp, Oryza sativa
gcaagtataatagtaggctataaacttatgtggagaagaaaaaattaaaaaataaagagaattgggtctcatgcaagagctagctattcacatattttaagattaaaaacattaaatgcataggtgagattggtatgtctatctgacgtggcatagttggttgttgcaaccttcttcaaacctttcagtttgaattggcctatgatgtcacacgttcgcacgactttaaccatcatgttatatgtgtatatgagcatgttatttaaattggcatcagtaaacaaagttcattttgttaagtatgtgcttgggagaagtgtaatggatcagtaatgacctgaaagcaacaggtatagatgaaacactagttcttaagccccacctatcactctctccttcccaaattgatcatcacattagatttttgaggttttcccaaaataatcatcacctaacaaagtatttctttgtttatttgtgtaaagagtaaatgtgcatggagcaacgccctgcatgcatgcaaccaataaatattaattttaattggctcaactcatgcaacatttaaagtgtgaattaatttttgttgaaaatgaaacgatagagcaccttattggatacgaattaatttcaatattggcctttgtgctctttagagatgatcaaaataagatggagggagtagcttttacgctaaagaggtgatccagggtacaacattaaaatcatagaaaattttattagatgtttatgtgataacaaactttgtgatattaacgttatagtgataatttagaattagtaggttgtaaggattatctatagataacatatgagcctataagccaagagtccatttataaataattttgaaggattatttataaaataacttttactgagtgtgcatagtgcaaattatatcacatgccataaaccagccaacgcccccactctctttcaatactgcttttctttcttttccctttctctcgcgttccgcattgctggaaagcttcgaaagttcttcgtcttttcctttcctctataatcaatggttcaactctcttctctctattttatttttttgtcgatccaatggctattgttcacctgatgatgtggctcatcctagtagcattttgaaatttacttttcactaggtaagatgtgtgaaacacatgcacacggcgagcaacacatacggctgtatcattttatcatttcctggtggcttccaatcccatatgattcgaacatcatgagcaaatatcacatatttatgcagtgcaagaagaaaggacattttttttactggactactgcaaaagggaaaatgaaataggataataagatggatacaccacactcgggcactcacctaagcatgaccaccatctcttctagcttatttcatctcatagatggtggtgtatatataagcaagttggaaggagttgcacaaacaaaacttataaaggaatcggatttactaaattta

SEQ ID NO: 43343 - DNA, 1501 bp, Oryza sativa
ccatacaaaccctaagaaaaatgagatgaaagaaagaggggattggacaaacaaataaaatcatttggcttagtatgttggaggtagtgtagatgtggtgtattgtctatatatatatatatcacatcttatcttaaatagataaaattaaacgtggcaactgtccttactataaaacttgcccttagctagtacagtagttatcagttatcacactttcctttcattgaattctgacctagttcaattaattgagtttttggttggcccgatgacccagagaaaacaaaacttgatatctctattgtgtctaattgatgtcaattttttattgaaaaatttattcattcatgaattcagaatggttagtgtctggtttatttctaagtccaggatttttaatggctagagatggttgatgctgctttgaatcaattgtcatttacagcctgaccaagttctgtaatgctttcttttatcatgttcatgttgatccatccagattgatagaagaacatttatagcttgtgctggtgagctgtgtcgagctgatgttctgctaaatgcatacggcaagatgctgcgtgagcaatgtgacaagcttgttcctggcattggcacgattatcaaggatcacgcgaagtatgcaaatgttatggtgatgattctgacccctcaaatgatggtaaaatggttaccctccaaggtagtagatgaattcatatctgtataaattaacattcgcaaccaaaaaatatttatgaaatatatagataaaacaaataaatgtgtttttttatggattgacacagtgttttccagctgatgtggtacgaaagatagaggaggcagatgctgcggcagatgatgcacgggaaaaagttgattgctcactatattattccataaatcgcaaggccgataaacttgaagaactctctagacttaaagcaggagcgctccgtaaactcaagtctttggtttgtgattgttctggagggcaaaagaggagcctcacagaagtagatgatggcgttcttgggaagaagaaagtgaaggggacaccacggctcatcggtggagccaaagccaagatgaggtctctgcggcagcgagcaccgcgccactgcagatgctgctgctgatcgagtgcatgcaggcaaggcaaccgcggaggggaatcaggattcaatcacatgcatgttccttgctgttttccattctttcttttttttttatgaaatgatgagctgaatcctgaatggaataaaagcttctggacatggcttgatttcttcttggcagtggagtcattttatccccaatatatgcatgttcttgttaagctattatcatagtgttggctgttctctatcctatccttctccatgtaggtgttggaacggacatttttagtttatacgggtgaaggtgtgaggtgagtgaacccggtgagctgtaagcctgcaatgactccaatgatcgggacatttgattattt

SEQ ID NO: 43344 - DNA, 1501 bp, Oryza sativa
ctcattttatctactctcatatagttattttctatttttacaaattttaatgtaatgattataaaaaatgaacttattacgggacaagtgataggtgtgctgtgttcacaagactacagtatatgatgggaaaattaacccttctagatgatgagaggagtatatatagttttatatattaaatagtgttaaaaaaactttaagagtaaatttcataaagctacatatactttgacaaaaactatatatttaaggtattttaacacaaaaatatatattagcgtcaaatttaaaactacagatttaaaatgaagtatcacaaaactatatattaagtagcaaattttatcacaaaactacaaggttggtgccaatttaatcacaaaactagaacgtttataacctcaacataatggtggtgttagggatttgaactctaagatcattgttctgtgataacttcaatattaaattgagtagattgcactttgagtcacatatttttaccaaagttttattttggatcactcttactgtgttctttttttactttggactaagtattatggccaaattgcactttggatcgagtggcccacatgtaactgacacatggacaatagagattgttatagtctcatcgatatatgagccaaccggtccaaagtgatacatttggcaaaaaaacctagcctattttttttaaaaaaaacaaagggtggtcaaaagtgaaactttggtaagaatttgtggcccaacacgcaatttactctattaaatatgtagttttatggcattagccttttatgataaaattagccctaatgtgctgctttgtaacacaataccttaaatagttttgcaataatttggttaaaatatctatagttttgtgaaatttacacaaactataaaaataaggaataagttcattttagtcccttaacttgacagcaagttcgattttcatccttcaacagaaataccatatacaccgagtccctcaattgtcaaaactgatgcaatgtaggtcccatgatagtatagcgggtggttttgtttgacgtgacatccaaatcaatagtaccgagtcagtgtgggcccatcaagacctcttcacctatctctctcttcctcccctgttcccatctcaccaggcggtgagcggtgaggagaaggccagcggcgagtggttaggagaatggcaactggtaggagaagctagctcgaaggaggaaggacactgacagtgaccatcgacgaagaccttccccgcccacggactctaatgatggcggtggcgaggtggacaaaaaggaaggtgagaatcgggatgacgaggtgaggggaagatgacgagaacaacatgtcactggcatcatcgtcgggacacaaccgacacagaggtggaggcggcgaggaggaaccgcggtgggctccgagcgtggctcgcgaggttggttccacacttgtgcgcctggtcgctcactgccactgctct

SEQ ID NO: 43345 - DNA, 660 bp, Oryza sativa
cttcctacatcctcatcccgatccatcccctccacctcctccccttcctcatccgatcccctctcctccacctcctcctctccccttcctgcccatcctccccttcccctccacctcctccccttcctcatcccctcccctctcctccacctcctcctctcccttttcctgcccatcctccccttcccatccggcaggcggcggccagcgggctggcggcgggctggggcgacggcggcggcgggctggcggccatggcgggcggcagcaacggagttgttttctctttttttttaatttgtgattcacatgtataattttgtgatttattggatggatctaagatgacctgtgatgtatttgatttgtgtgtaattttttaggatttgtgatgtatttgatttgtgtatatatgtaactttaagatttgtgatgttactttatttgtgatgtggatttgggatgttactttgatttggggatatgcttcccacttgatttgggagaaaataagatttgggagtgttgacagaaaatacgaggcctgggagatctgcttaactccagtgcaggtccaaagctcgccttcgaatgtatgagcgtgccagttgatttgatcctgtaatcaacaagaaatagaagcaaagaaaccgcagttaa

SEQ ID NO: 43346 - DNA, 1501 bp, Oryza sativa
gtaaattgcgtgttgggccacaaattcttaccaaagtttcacttttgaccaccctttgttttttttaaaaaaaataggctaggtttttttgccaaatgtatcactttggaccggttggctcatatatcgatgagactataacaatctctattgtccatgtgtcagttacatgtgggccactcgatccaaagtgcaatttggccataatacttagtccaaagtaaaaaaagaacacagtaagagtgatccaaaataaaactttggtaaaaatatgtgactcaaagtgcaatctactcaatttaatattgaagttatcacagaacaatgatcttagagttcaaatccctaacaccaccattatgttgaggttataaacgttctagttttgtgattaaattggcaccaaccttgtagttttgtgataaaatttgctacttaatatatagttttgtgatacttcattttaaatctgtagttttaaatttgacgctaatatatatttttgtgttaaaataccttaaatatatagtttttgtcaaagtatatgtagctttatgaaatttactcttaaagtttttttaacactatttaatatataaaactatatatactcctctcatcatctagaagggttaattttcccatcatatactgtagtcttgtgaacacagcacacctatcacttgtcccgtaataagttcattttttataatcattacattaaaatttgtaaaaatagaaaataactatatgagagtagataaaatgaggaataattatcttgagatttaataaaataggggtattcaagtcattttgattttgtattggtatgatatgtgaaaaataaactttttcttaagaaacacagtagccttgtgaacacatgcacacctttcacttgtcccataataagttcatttttgtaatcattgcattgagatttataaaagtagaaaataattgtatttgggatagataatatgaggaataattatcttgggatttaataaagtagggtagggatttaataaagtagggtattcgagtctttttgattttgtattggtgtatgcgggataggtgaaaaatgaacattttttttagaaacatagtagccttttgaaggcacacacgttgacaagcacaccttatgagctgactatgggtacatcacctattattttagaattagctgtaaataaaaaacgttatgtctaagacttaaatctgggtaaattgatttcaccataagtatcctaccaagttgagatactttaacctaccgaaggaaacagaaaagccggagcttacggcgtccacatacggtgtactaaggaataagttcactggaggtccctcaacttaacagcgagattttttgacgtcccttaaccgtaaaaccagaaatcttcatccctaaactatacaaaaccatccaattcaggtcccatggcagtagagatgcctggtttcactgacgtggcaccctagtaagcaa

SEQ ID NO: 43347 - DNA, 1501 bp, Oryza sativa
ccatgatttgagctgcttgtttcgtgatatacctaggtcgctccaggatgaatttttcccggtttcacctcgaatccagccaaccagatcaagggagccccaaaagcttttgcggaatcacactgattaacagcgaattcccacctatctaatggaattttcacgggcggaccaagggaatcaatgaaaccaggaaaggaatcgagggctctgataccaattgttagctacctaacaagaaaactgaacaagaactcaagaacagatagatcaacggggattccaacgaatttccgccgtttccgccgccaccaatcgccgcggatttctttcttatcatcgatagccaaaaacagagttttcttccggtctcacctcaccaaccctcccattacaggccaaaacataggctacacaataacacacgcttacagagcccattccggcccagacaaacgaacattagcctcgcgaagttttctttccctcccgccatcagcttccttctgcatactacttccaacatcctggctatcagcagcaggcgccttaacagttcaccgcgggaggacgccaccgctgggtcaccttctccgttgccaccgctgtacagacctctccaagctgcggtcaaggctcggtgagcatcctggacacccaagaaccccatgcatacactccattcacttagaaactgcctccaactcgacatgcacgcacatccgagatcttccaccgctcggacccaccggcggcgctcctccgatgtccactaaccgaggaaagtagaggaatggaatcgcaatatcatgctcttcatttcgtcttttggtcgcgcccccaaacgagtcaccatttgttgccggcgccggcgagcagaggtgccgccatggctgctctgctgctagatcgatgggagaagaaatcaggacttcactttgtaaatttaacaaactgtagagtcttttcctcaaaagcacaagacacatagtactgttgcaggacctattcgtaattattaaaaacaggaaggactcttaatgaaaacagctattcaacaagtgctgaattgttcaaatctactttaaacttcaaaaatgcataactaattcatcttaactccaatttaggtgaaaccaatttctgtagattcacgaaaatatgaacttaaaagttatgacataaaaagtggtactcacagtatgaaaatttatcactaaaactcatctaatttaagtcacacataaagcatgcacaaacttataaaatgcatataaaattaatcttagctcaaattggtgcaaacttaatttctatagatccaccaacatattatctaaaaacaaagtaaaataaaatatgtacatattttacatcaaatgccttaaaactaatatctttaaaatgactagatttagataagctgaactttagaaattcatatagaattcatcttaactcctttttgggtgaactcagatcctatagaatcatcaaaaca

SEQ ID NO: 43348 - DNA, 1501 bp, Oryza sativa
cattaaatccttacttaattagttgcagattgatatatcatgcccatgcaacatgatttcatcctcacctttcaagtaagcatgtgtggctgcattgtgttatatgtgtaaaatggccaaattcaagaggaattgagcggatttgttaaactatgtgaagaagaattatacgatacatataccagaaccatgcctatgggttgataaattatctaaaagtattggacgttaaagtaaattttcaattaaagtatattaaacaagacataatttccccgcaaaaaaaaatcaacacatataattatgcaccaaagatgggtacacaagctacctcattttgtcttgttagaatctttaagaaattcgtccagcggagaattgatttacgcctgtttgatttttagctcagtctgactacccagcagagaatagtatataaaacaaaaggagtaaattgcattggtagtacacaaacttgttaattgcgtgtaatttagtacataaacttataaaatactcgttttagtacataaacttgtctatttgtgcaaacgaggaccaaaataacttgccaatgttgattttacgaagttgatgttgattaggatgtgatgtacacgtgtaatgagtatgaacactgctatatgtacgactgctctatccgaccggtgtatgacggaacggcagagcagcacaatacttaacggcgtaagtcggaacagcaccagcagcacagctcttgacgtcgtgtaatacgcagtcgtacgtcggtcggacacttaagtggtatgtatagcattttcgaatgagtatgcatacttacatgaaaaagtttttgacagcgtatatgaaacaatttactgtgatagctgccgaggaaccgccattgatttggaatgttccaccatttttctgcctccagaaattggtctccctaccgtgatggtaaataccatttactgggcggatttcaacatctgagtgttccacaaagcatgaatttgacagcaaatcactacttcgaaacaacacatcagtatcggttcgacaaaacctaccactgataatggtttttcatcctataaaacactcgcactagcattgatgagaagataccagtgtcggatcatataaacactactggaaaactgatttttcatgggtggtgtaaaattcacaataatcccggtttaaataggaaccgagactaaaattatttttagccctggttcaaaagaggcacgacactttatgatctttagtcagattggtgttatcaacctggactaaatatcatttttagtcctggtttaacacgttgtcaggctgtgtcaggccctccactatttttagtcccggttgtttataccagccgggaccaaagattgaaaaaaaaaccgctcccacacgcacctcctcttctccttttgtccttatctccttgtgctccccgtccttagtctttatctcttcatcctcgtcctccactcctcctctcctc

SEQ ID NO: 43349 - DNA, 1501 bp, Oryza sativa
tttgaatgcatgttagttcatccgccagaggagcagaatatggacactacgattggcagaaaccattttttctcccattgatgttctgttccgtttccaaataatgttctgctcctttccaatcgatgttctgttccgtttacaaataatgttatgctcctttccagttgatatttttctgcttctttttaatttcctgcctttcttaacgtcttctgcttagtgacgattttgttgaaggagcagaagatgtgcttctgttcaaattagttttctgctccctttctaaccgatgttctgctccttgcctcctttcctaggtcacatactccatactgcttcctttcatgtttctgctcattttcaagtcttataagcttcatatagacgatgagattcaatttaacaggcagaaggtattctgcactttttattccttgttctatgcgttcttacaaatttgaaatgacctgaatggacacaacagacgtcacaaattatgggccggggagcaaaagatgttctgcaattgtttctgccgagtcctatgtctaatagtgaatggaatcggtttgtgaaagagcagaagatattctgttatctctaccatccattgattcaggagggggattatagctttctgctgcacaaattctgttatgccgttgtgattaaaaagagtatcatccctcaactcggctgtgttgtacatccataccaacagaaactatcctgagcaaaatataacatacctatttaagtatgtaaacataaactgcaattagtaatcaataggcagaatatgaactgccgttacatagagaaaaaattggtatttgttctgccaacaatttgttttttcgatgatgttctgccattttctttttctgatgttctgccatttttttcaattggccagctacatatcttctgacggttagaagcagagcatattctgccaaggcgagcacataggaacaaactccaaccgaatgttttgcatgcagccgatgatttagcatttatttgaactaataaactatttagttaattacttaattaaacaacccggtctgcagaagtttagtagattcagggttattccgttaaatcgatccgttaagggaagggttactcccgggcaccatggtatcaaatgcacaaaatcattcaaatatttcaaaattttcaaattatgagtatatacctagttataagaattcgatttatacctacacctaacaacaaaacaactcaaatttaactttatctcacaatccatgattacatacctaactaattatatgtttggatgctatatacctagaatcaaaatctaacaaaaacaagttcaaattcagttcaaacttgctttgaactagttagtaaagtagttaatgttaatatctaaatatttgaaaaagtttcatactcatttgaattggatatatactcaatttcaacaatggtgcccgggcaccatggagcaccaaacaaattt

SEQ ID NO: 43350 - DNA, 1501 bp, Oryza sativa
tacgattaggatcggctgggtctgagtcgggctaggtaagccgatgcagccgattccgacaatgcaacttgatgtatgacatcgggttgaattgaggtgcttcaaggtgattgccgcacatggatagagtcctgagaaggcaattgtatctattaattaggatgttttatgtaattttcttagagatatgcttgggcaaaagtctgccgcaaagacttatggtatcttagagtttgttagagatagttgtcgtgtccgttatggacatatcttgtaattttcgggtataaatagacccgagccctatgtaacttttaacacacacgttcaatacaatctcggcgcatcaccaccttttttgctttagttttatttcgacgagttcttgctttcgggttgagctgcatcggtttcgatcttcaacaagaggtaaaacttgtaatggcggtttgcattctcgggattagtgcttccatctttatgacactttaatcttgtttatgtaattcgtcgagttatcatatatcctacataatccttggcaatatcgatatccaacctacaataggctaacatccgtcaatagaagacagccgattaggttaaataccgatgttgccttagattatataggatatctaccactctatgacacatccaacggcttgattgtctagatattgtccttcttttcatacttatagctgcatcagttaagtttgaccttatgagtcgtgattagaatctcaatctctagcccgcttcttggttgctgattagggtagtatcggagtttcagccgatcttacctgatttaactacttttatccctttacgttaagatcttgctgcatttaagtatattaggcttgtgtttagtatattctacttgctttaatatcttaatatagagtagtatcggagtattagccgatacatgctagatctatctgatcggctatgttatgaacgtatatagtctcattattaatatatatttcgatctaagtgatttatactgtctcggcatggcgaccgatctatcccaatcacttgatttaagtatatatcgatataaagattatatattggtaatatctgcagccgatcgagtagattcagtccttccttatttattaatgactgccgatcgacgcatatatgacattggctcaaagataaatgatgtcatcggcacctagctgatcagctatcatttatagatttaactgcggtttctttgcttctatttcttgttgattacaggatcaaatcaactggcacgctcatacattcgaaggcgagctttggacctgcactggagttaagcagatctcccaggcctcgtattttctgtcaacactcccaaatcttattttctcccaaatcaagtgggaagcatatccccaaatcaaagtaacatcccaaatccacatcacaaataaagtaacatcacaaatcttaaagttacatatatacacaaatcaaatacatcacaaat

SEQ ID NO: 43351 - DNA, 1501 bp, Oryza sativa
gtaaagatcatttaatttgtatacatgtatcaacggataaataatcagacatgatgaagaaaaagaacatcaatcatacgggaaagcacgatatgtcgtcctgctttatctcaagtagagcaagaattgacggaggaattagcaactttaatcaaccttttcagttggcatattcttttagaaagtatctacgtgtcctgttaaccgtttggtataatacaaatggaatcagatgatacaaaagtgggcaacgatgtacataagatccacacggactttgcgagtctcgttcgcttgctatctccacatccacacggactctcgttcgcaggttgctcgcgagtcatgacccacgcagtctcctacgcataatgggaattggacacggatgacgtaacaaaagttttgacaaaaatatcttccattttataatagtatatatctatacaaatatttaacatttataaaataatttgattaaactttagaaattttgatcaccaataattttttaagtgtttagtttaaaagcagaagaaaatatatacatagttaaagaagtactatcaaaaaaataatccagttttgaaatgaaggggagatcatctcatacctcccgtttagtgttcccattagaatttagaactgtccatagtcatgcatgtgtgtgttggagagctgccttgcttgggggctgggcgcagcaggctcatccgatgggaacgatggacagaaaacccaggtgaccagggaagagcaaggagccttcggctgtgtctgggaaacaggacttatttcaagaccctatcacatcggatgtttaacattaatttagagtattaaacatagattaattacaaaatacattctataaccttggactaattcgcgagacgaatcttttgagcttaattacattatgatttgacaatgtaatgctacagtaaagttattataattatggattaattaggcttaaaaaattcgtctcgcagattagctctcatttatgaaattagtttttttattagtctatgtttaatactccaaattagcgtctaaacatccgatatgatatggactaaaaaagttttagccccatctcttcacgtacaagagggatctggggaggaagacgagtccgatcggtcattatctaaaagaaatatttctatgcatgccaccatgctcgctactcacatgattcctgagaccgactcaatgatgaggcaacgtaccaagcttccagcaacaacaattttaattgttataatagtagagatatgtgagatgagcggaaaatgaacttattttaggatagagagtacatgtgtaaccacactaccataagaaacgttatccatatgaatatatacttacttcgtccaaaaagaatcaaatcctaactataaatctaaccaaatgcttgtttaggggttcatagccagagttcgaggttttttttggacggattacatctcagtggaaatctgacattgta

SEQ ID NO: 43352 - DNA, 1501 bp, Oryza sativa
atccttgccaaataatttgcggctaacatcctatttatttcccctccctctcatttgagtgcattaaataaatcccgttatattctatctctcaaaatattgcactcaaataaattagagcatccttattttaaaatccttctccatgtatcaatatctccgaattcaaatccttttcaaaatctagccgtccaaattcctctaaatcaattatttgaatctctaggaaaattagacttcctcctttttaactttggaccgaatttctctcactcacgcggcccaagccggcccagactgctgagccgcatcctcccacctccctcctcttcctgtgggcgcatgtagcgccacagccgccgctgccgtgcgccattagtgcgccgccgcccacagcgtcgccgtcgccgtggtttgtgccaccgtcacctgctgacctcatacgccgacgtcgatgccgtaccgtgcgccctactccgccgcccaactcttccacggccgccacgtcctcacgccatcactgcccaaccaatcgcaggaagaagccggcgccgcctccttcttttccacgccgccgtcgcaaaatcgtccttgtgtttctcctctacaaccgtcatccgccaccgcctctcatggcctatataagtgaacgaaccccctctgtttttcccacatcgaccgatctcttcgagctccgtctctctcttcccatggccgatcgtcgacgtcgtcggtcgatctccccatccgtagctcctcttcccctctcctcgcaccaccggcttcgcctccctccgacgagcccatttttcccgtttcccccttctctcccactccatagcagccaccatcatcacttctttaagcggtcagagcaagttcttgccgcctccgttctggtttccttcctcttcctctctaccagccaccgacctcctcgagtacgcatcgagcgggaacacgatatgccaccggcgtcgccgcattccggccaccggagggccggcgccccgctcgccctctcctctctctccctctcggttgccaacagaaaaagagaagaggaatcgggaggaagaagaagagaaaaaaaaaagaaaaagaaaaaggacagctaatgacaggtgggccccctacagtactatttcgcaatttctagatttaattcaaaatccaatctttagaagcccatatctcctaaaccgtaatccgattccagtaaaacttggacctaaattcaaatccttcattttgatatcaaatttgctattttaagattttatttgaatttccttaatttattcaaataccatttgaataaatatttgatttaaacttataattgaaacttatatttacctttcaaatatttcctgttatttttaaaataccctttagccactaaaagccgccggttaaaactttacaccttctatgtggacgtccgtacggtctactggccatgacgtcaaactgttggttgtaaaacctagcaaaaccc

SEQ ID NO: 43353 - DNA, 1501 bp, Oryza sativa
cggaataacggtctagcgaagctccggctccactcccacaagcagctcaactggggtataaaccaaacgtcttccccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacagcacacccatgctgcacaggcccaaccatcctgaacaaccatacccggctgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaactcaaagcagtgcaccgttcctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaatagtagctcgcgaagcggtccttaattgtcatgagcacgactctcaaaaccatgtgctcacaacccaccattatcaagttttagttggcaagtaattaattaaccaatcacgattgaccatcgtgaactattattaagccatcattaaataatacttccggcgcactcgcgaaccttcaaaacgacggaaacgacaagctaacacgcaaaacgaagaaaaagactagtaaaaaccaaataaacagtacataaaaagtaaacaaacatgtagatcataattttagatgaattatgagacttgaacggcctcattctgacttcatatgaatttattatgaattttactagattaaatctaattaaagcccatttaaaaagaattaaataaatttaattcaatttatggataattttaatatgtagatctttattttacacaacttttgcaacttgaaccacattaaaccgagttacaatgaattagatatgaatttttaaagattaaaccggattaaagcatttatatggattttaattgaattatgacgcaataatgaattatttttgaaaaggaaaaggaggattattgcgtcatccaaggcggtccacggtaaaccgggtgcacgggacagtctaaggaaacgaacggccgagatcgattctatccaaaacgggcggccgagttcaaaatggtccacagcgggtctacgg

SEQ ID NO: 43354 - DNA, 682 bp, Oryza sativa
ctgaaagagtaaattacacctacggtgcatcaacttagcagatgggtgtaatttggtgcaagaatttgagaaatgagcgttttaacgtaacaacttggcagataggtgtaatttagtaccagaactttataagtgatcacataaatgcaacaacttgcaagatatgtacgatttcgatacaataagttaacaagttatgcggcaacttaattatttggagcacttttttatacatatttaatttttaagtacttattttgacaatatactagcgtggatttgtatattttaagtacctagcatatgcttagctaagtttatgtatcaaatactaaattgtcaagttcttatactaaaacgcacctacttatcaagttgttgcactcgaacgttcaattctcgagttattgcactgtatcgcacccacccccgccaaattgttgtaccatgtgaaacaaggaaacatctttgggattgagctattcccattatcggaacgaaaccattgtgattgaggttgcgccaggccatatatagcttagctctaaatatttgcaccagccagagacatgtttacatttgtttaagccagcatattacaatactcaagcacatttaatttgtcaaagaaaggaagtacatctatatggtactgatatcaaccatcaaatattctatcaga

SEQ ID NO: 43355 - DNA, 1501 bp, Oryza sativa
cctggtagcattgtggttgtgaacagggaaattggcttgaatccacaagttttcaagagaatttagatctacttagatgcatgcaaaaaaggattctcagctggatgcaggagagttattggactagatgactgctttttcaagggagcaaccaatggagagcttctatgtgctacagggagaaatgctaacaatcagatgtatcctattgcatgggtagtggttaccaaggagaacaatgagtaatgggattggtttatggatttgctttgcagtgacctaaaaattgacactggagctggttgggtcttcatttcagaccaacaagaggtaatatgatcacacactaattcagtcccctctcattttccataactaattcagtcccctctcattttccataacatgttcctgactcaattttttacttgctatgcagggtatccttaatgctgtgcagaaatgggcacttgaggctaaacacaggaactgcgctaggcacatgctaatcggaagagacacttccatgacaagcaattccaaaagaagttttggaagtgtgcaaatgctccttgcgggatgttatttaaccttgctagggcaaaacttgttcagctgattcaggctggagcacaacccatcctcaacacacatcctaagcaaagcatggttcaggttagattctaactgtgacttagtggacaacaacatgtgtgaatctttcaacaaatggaaactagaatctaagttttatctaataatcacaatgcttaagaaaattaggagaaaaatgatggttaggatcagtgatcagaaaacaaatggtgctagatggacaactgttgtatgcctaggtattctgaaaaaaacttaatgtatacatcagtgagtcagctttctgccatgccatttgcaatggaggtgatcgttttgaggttaagcaccatgaacatagatttacagtacacatggacaagaaagaatgctcctatagttactggtagccatgccctatgtaatatcatgcatcttttatagaaccaacgagctagatgactacattgtaccttgttactctgtggaagccttcagaagtacatatgttcttggccccaggatgatagagagccactcaatactcctagatacataaagatgccaggcataccaaggactggaaggagcagaaaaatgcataaaccacccaagccaacaaaaatgtccaagtttgggacagtgaccagatgcacaaggtgcaagcaggttgggcaccaaaaatcttggtatgcaaagcataatgttgccggtgtaggatcaaggaggccgactagagagggggtgaataggcggttttaaaacttaatggcacttaaacaaaactaacataagttgctaggcaaggtgaggtgcaaggttaactaagaaactaagttaagttttgcaaacctaagtgatatgggctcaaatatatctctatgaatgtaaatagcacaaatgtaaa

SEQ ID NO: 43356 - DNA, 990 bp, Oryza sativa
tatataaaaaatatagtaataatatatgtcatacaaatatagatatttatcaagagaaaccacgttggctttaatatatttaactgatttctatataaacttgagcatatttatttacattttttcaaaccatcttattttaaataatatttgtagtatcgtagagatcgtagaatcaggataccacctaagatttcgtaggatggtgtagtaataaatagtaggatcgagctactatgaaaattttgatactagataggatcggtatcattttggtttagtaggatcgtagtatcgtaagatactatgatacgaatcattgtgtggaagtactatcttttgcatgcaggtctcctagctatccatcggcgaaaataaaaatattttataggcaggccacgatttttgcattcgggtcttgtctccctcgggaccgatagtattggatatgttactgtccgtctgtgaaaaccatttctatagcagtgattgcctgttggcgtaaacctctagggatgtacggagtacatagcaaaagggaaaaacaaacaatgaataagaataataattatatgtaacatgaataagaatagtgattatatataagaatataaaatactatttggatatcccattccaacgccattgccctctgttctaaaatataagtattttttgttgacatcgatacagtcttcaagatactactttgaccaacaatatctataagaataaaatattttaaataaaaatagttgcatattataatattttgattaatgataaatcgagtaacatcaattttacatgatatatatatttttatttttttactattaatagttaaagttaaaaattgttaacttaccattatgctaaaaatgcttatattttgggacggattgagtagttaataggagtaattaaattgagaaattatgatggaggacgaatatgggctgtcataggccttctttctgcgcgctaagg

SEQ ID NO: 43357 - DNA, 1501 bp, Oryza sativa
tttgttttctaatccagttgaccatgcatgcttaactatgtttgatttagcttgtagtgcaaaaatatgactagccactaagcaggccatttgatatgttttgtgcatctttcactaaaaaagtgtctcatgtgaatcatctgtactgggaagcaatttgccttctggtctctattactagtggtagtccttgttattcctaatttcaatggaccattgattttgtacttcttataattgacatttgatagttaataccaccctagttttgaagttctcataaaattgaggccataatctcaataatattaatatttttgtatgcattcttgacaattccttcgctagaggcaagcaatgcagtttacaaatgttgttagtttaactataatatggtaaagtgaatcgatgcttcttggagatgggacgtttctaatatgtagactatggatacaatatgcaaaagggcaggtgagttcaaactttcaaagaatttgacttcatgtatgggatgaagtgtgacctatttttttgtttgcatgttgttcagctctacaaggaagctacacgtatcagtctcaacgatcacatatgttgcctggtttgttggcagttgaaattgaatggaaaacaatataactagataagggaaatttatctccaagggaaatgtaacctgaagctatgcagatcatattactgaattcggtagctttaccggtgcccaataatatgttcatagatatgatttttatgtcaaggatagaaacaatattattcttgccttttctcaaaaaagattgaccatgtaatttctattttctaataatttttcatcataacacaggccaagatgcgtagaaaggtgtcatctggagtgaagaggaaaaggggtgcagatactttccagatgaacaacaaaaaaatatgtgtgccaaggagctgtgatggaatccaagtgaatacacaatgaattttatttcgaggagcactctgctggccataggaacgaggaaaacaatgctttggaatcaagaaaggaagctattgggacgaagaagaaagtagaaacagagtccttatctgtcacacggcattatccaccaacatggaattatggtatttgcaaagccaattgttcaagtgaactggacttaaaaaatcacctaagaggtaggaggcaccaagaaaacttagaagccctgaagagagaagacaaggaaatggaagcaaaggtgtatgcaaaggaagtggcgcagtttgttgaaaagaaccaaaagtttgtgccaagatggagttgcagcacttgcaaggctaattgcacatctgcatctgacttggagaatcacttccggggtagaaggcaccaacagaacgtaggaaggagttcaaacgtggtaatgctccgtgcataagcattactgcatacaactgagatgcggttgcagacctgaagatatagttggcagaggggatattgtctaattttggggggtttttc

SEQ ID NO: 43358 - DNA, 1501 bp, Oryza sativa
gagccgagccatttgcactcctaaccattagttctccacagtagctacccacctttggaaaactagttgttggttactcgacttgttttctgcattaatccaaccactttagttggtcaacctgccagaaacagtctgcagacacagccagagggcagcatagatatccacaatccctgtagcatgtcctgcaagagttgcatgccttgtctgatttggatttatttgatgggatgaacatctggttcttatctgattggaaactgacaatttctagtaggcatcagtagccatagttctggccatttgcagaaatactttgtccttgcatacaccccagacttcatttgtacaacatgatctgccttacttaactgtgcaatgtactaacatcaattcaatctttgcatggtgttgattcaggtacaggagtccagcctccgtactcatctgatgcaactgaaggaaggagttttaggatgactttgataatccaagttgaagaaaccagtcatgctttcaatatgtacaggcacggtgtaaaaatggagcgtacatacaaaatcctggagtaacatcccctggggacaatgcatagcggcgatgctgtgcaggctgcagttaacatctcacagtgcgtaaagaatttgaagaagaaacaggtgtctttgaacctaagaatacttctaacttgggtgttaggggtgtatgccaacacctctcaccgagtgaattaggctcacttccttgccaagtgagttaagacccacttccttacttcctccgtcccaaaaaaaagtcaacctaggtacagatgtaacattacatagtacaacaactttggatatgagcgtgtctaaattcgttgtattatgtaatgtcatatccgtgtctaggttggcttttttttggacggagggagtacgtcttattgtgtttagggaagataggagatgcttgattcaagtgtaaatgttttttcgccgtacagtgcactcaaattgcctccactcctagttttggtgttcctctcatgagtcatgacgagagctgccctctttacctattctcattgtatagtattttgcttgttaacaaaccgattggaaaggaaatagagaaatggggaaatagaaaagaggatatgtgttttttttctctaatcttctagtatctaagttgtttcttgtgaaaatcccacgaaattcttaaaattttcagatggggcaagtcaattttttccatttttcgctaccaaacatgccaatgtacttgcgacgttagcatatgcaatacttctccgcttcgaaaatgcgaattttcttttttgctttttgtagaagagccctcatatatgtgcattttaaaaattcgatatgcataaacagcaggataaaaacgaagtgggttctgaaggggatagacgaggtgcgacgtgggttcctgtggcagggagcggcggaggcaaaagggggtcactgccgcctagcctggacgaagg

SEQ ID NO: 43359 - DNA, 1501 bp, Oryza sativa
tctacccctcacaagtacaagtataatgcatgtcaatgaggggtagaaatataatatcatgtgtgtggctggatcaataatgataaagacggacggaaaaattaacggaagtgctaaaaatgggaacagggtgaactttggatgctattaaagtgaaccggtaactttcggtgctataaaactaaaaagtgaactttcgatgctatataaccaattttgccttttttttttgtgggggtagtggacgattcgagttggcccagccgcttcgcgttcgtgctcctgcgtgcgtgcgctgtcgtcgcgatccagacgtacagtgagctttgaaaagggtgagccctttgcgccgaagctaagcgtccctttccgtgcgattgggctccgattcgctgtacatcgtgagcacggataggcccttcaatttgggtcttatatacgccatcgagctagatttatttccttctcgttttcttgccacatttgatcgcgaagccggtttggagaattttggagattctgctcatgttttccagtgagtgaaatgtgactgttgcatcggctggtgccatgtgaataggtatctggtagatttggattttgttttcttgcctgcatcgaacagtacaaaaatcttacgatgcattgcaagtttgtagttctggtcttctggaatggtgaggtgttaactcttaaagagtaatttactcttcgaagaatgatcccattcccataatgtttgtttccgatgaagaaaacaagtagtgaaagcagtagaataaactttctagaatctagatacaaagatccatgttgcgtggacgcatgtgtccctgtcggctccaacaacttcaggggaaaaaaaaggtgaacctaattctctcctcgtccttggtcgaactcatccatgtaactagtaccatgtagcagcagcaattcgcatttcacatcaagaggccatgttggattaatttgcagatttgcagttactgcactgttgcaatcctgtactaggccccaaccaagcaaacacgggagctttccttttcttccttggggcactttacgcccacacgacgagagggaccgggtgggcagtagcaacaaattggacaatcctttgcatgtaaatggccgtgacactaggttgtcgtcatccatcgttgtgaataatgtgcaatcgtccatgctgtttggttgcctgcatttgccgttctttgacgtggtggcctggtgggggaggggagaggcggagagccttcatgtttgtttgtttgtgttattgtgtcagaaggttaatgcacgcatgcatgtttggatttttgtatcagtttatcctggtggttggcgtcgtcttttggtagatctctctggtgatattgcctgctgaggagagtggtgggtagctttggtgatagctggccagtacatcaatgtgggcgtttcttggagcagctactcgactccatggatgccgtgaagacagaggggaggaaggccg

SEQ ID NO: 43360 - DNA, 1501 bp, Oryza sativa
tcgactccagcaaccgtggccccttcaccggcgtctccgatggccgcgtcctcaagtggggcggcgactccgccggctggactaccttcgcgtacaaccggaattaccggtacgtacgtgcatgtatagaattttgacttgtatgtttgcatggtgtgtgatattattatgtactatatatcttatcaaattttttaaaatttttatataactatttaaattacatgtatatacccaggtgccatgagacctaggtgtagaaaatactttcttacgtatagattggttgacgagactaacatgtatatatccgtgcaggagcaaccctacgtgcgcgtcgtcatctgaggagacggagagcacatgcgggcgtccgctgggtcttgcgttccacctcaagacggggatcctctacttcgccgacgcctacaagggcctgatgcgggttgggccgcggggtggccaggccgacgtgctcgccacggaggccgacggcgtgccgttcaattacctcaacggcgtcgacgtcgaccaggacaccggtgacgtctacttcaccgacagcagcaccaccatcacacgccggtacgtatacacagatcgagaacaatccaaattaatttactttcaaatttgcattatgcatgcaatgcgttgttgatcatcagcattaacaggagatgagttgtgtgcatgcagataccaagagaacatcatgaggaaccgcgacgcgacggctcggctgatgaagtacgacgcgaagacgaagcaggtgacggtgctgaaggaccggttgccgtacgccaacggcgtggccgtcagccacgacgggaggtacctcgtggtggcgcacacggggccggcacaggtgttcaggtattggctcaagggggccaaggccggccagtacgagctcttcgccgacctgcccgggtaccccgacaacgtccggcgagacgccaaggggggctactgggtggggctcaaccgggagaagattacgttcaacgtgccggcggcggcttctccggccaagcacctggtcggcgtccggctcaacggcgacggcgtcgaggtggaggagctgacggctgctagtagggctgtgacgctgagcgaggttgtggagagggaccgcaagttgtggctcggctccgtcgatctcgactacgtcggcctactgcagtagaaagaagttatctgtttagtggtgttaggaataataaaggcaggctaattaggtatttagcagtagaatcaggattggtacaactcttttttgctggcagctatattaattagacgttttagtagtcttttttcagtgtgtgcttgatatacacaccttgatatataatctctctccgtttcgtttttgtttgacgccggttagttcgaaattgcactaatcaacgtcatttatttggaaacaaaggtagaataatataatttagttttgtataccagtgtgcaatcaaatacccttacaagctactccctc

SEQ ID NO: 43361 - DNA, 1501 bp, Oryza sativa
agaacgccacgaactccttaaagttcagcccatcgagcatcctcagaagcctctgacagagacatcgcatcgattaacaaatagcattcctcaaacatctacccaatcacccaattcattcctttcctaatccctcgttctcaatacagaataagaaaaggtattgaggaacaggctagttatgtcttgtaacctgagagagagggttcacggcgaactcggggacggtcatgaattcctcggcggagacgaatccgcccccattccggtcgagctggcagaaccggtggtacagcgacacgatctcctgctgcgagacttagctcccaaaacaccccgaatcagcaggtcagatcggaggggaacagcggcagacagcatcaatcttcgttgagagttcagaatccaatcgaaagagagaaacacaagcgcgcaaactcacaggcgtggtcgcagtggtcctggacctcctcgatgtcgtactgcgtcagcatcgacgaggtgctccccatctcggcggaggagacggggatcccggtcggccaaaattcggatccgggcggggatcctcccggaatcgaagtccaatctggatgttcaaccacgattccgcatcaacacacgatgctagggatcacgattcgacgtcggctagagcagacgaggaaatcgagagggaggcagagcgcgatgcgtcgagctgaggggtgcttacccttcaggcggattcctctgcaggcgatgcttggtcccctcgaatccggagctccgccgccgccgccgcttgctgccgccgacgagaggaagggagaggcggaggcgaatccggcgatggatgtgtggggcagtgtgggggatgaacgaggacagatgcaaaaatggcccgtttctcttttctctcttccggcccggcctggcccagcaatccggcccgcgggagtgcgccaaagcccagcccagctcaccaccctgtcagctcgttcttcctcctccggccgggagttcgcagtgcccacgacgccgcgtcctcaaccaaatccggtcttgtcgtctacgatctttttcgaatcaaacgatctcatccgagaaacagtataaacttcgccgccgctaccgtgtcgagctatgtctcctcatcctcgctatgtttcaaaagacagggataaacctcgtcgctgcaggcgtgtcgagcactgtctcctcttcctcttcatccgcacagcttcaaaaaaaaaaaaaaaaaaaaacagagataaacctcgccgccgcaggcgtgtcgagctctgtctcctcgtcttcatccgccgcttcaaaaaccagagataaacctcgccgccgctggcgtgtcgagctctgtctccaactcctcgccatgtcgtgtcggctgctgtctcttcctcttctccaaataaatagcgtcccgatggcctcctcgatctgtgtaacttagtccctcgaagtagtcgcttcttcttctcgtagcctcttcagatcgatcgct

SEQ ID NO: 43362 - DNA, 499 bp, Oryza sativa
atttgtgatgaattttgtagaagttgtgatgtaattttttaaagattttgttatgtatttagagattgatttgagaatttagagactattcggggatgattgatttgggattttgggatgagatagagtgaatcaatatattaaaaacaatgaagaaaagaatagaataaagtagcagcctgagctagcctctttagtctagaaatggatttttactcccggtttttttcacccgggactaaagatagcgatctttagtcccgaattcatagtcccggttagaaaaccgggactacatgggggttacgaactgggagtaaagcccctttctccaccagtgaaataaaactattccttaaggaacatttgccaactaacaaaatttgctatgttgttttcaaagataaccctattttggtgtgcactggactatgggggcatcctgctaaagctggaggagtgctctgtaattgctatgttgttttcatatgttggcagc

SEQ ID NO: 43363 - DNA, 1501 bp, Oryza sativa
gatctatagcatgtacaccatcaagggcgtcagtcccaacgccgtcaggctgtggctgtttccgttctcctttctcgggagagcgaagcagtggttctatgccaatcgtgctgctgtcaatacctgggacaaatgctctacggcattcctctcgaaattcttcccgatgggcaaaaccaatgcccttcgtggaaggatttcaagtttctagcagacaagggacgagtctattccggaagcatgggaacgactgcaggagtatgtagccgcctgtcctcatcatgggatggacgactggctgatcctgcagaacttttataatagactcaccccgatgtcccgcgatcacctagacgcggtagctggaggagctttcttctctaaaacggttcaaggagccgttgatttaatagagaagatggtctcaaatatgggttggagcgaggaacgactccagacccgtcagcaaggcatgcacaccgtcaaagagacggaattacttgctgccaagctggacttcctcatgaagcgattggacgaccacaagaaacggccacaaggcaccgtcaaggccttagactctcacgtcacgtgtgaggtctgcggcggcacgggtcattctgggaatgactgcccggaaacctgtgaggaggcgatgtacatgggcaacaacaacgggtaccgtccacaaggaggtcagcggtggagccaaccacatccatattatcaaggaggtaacaacaacggtaacttttctaaccagccctcttcgagggatctagtttttacataggctaaaaccactgatgcgctaagcaaaaagcttgcagccaataacaagatcctagaaaacataaatgtcaaattagatggctttgcttctacttttttcgcgctgtgatgcaccccatctcccaaagtgttgaccctaccgagcactggggatctgggtggaggctataattcaatagtggtgtcattgcccttgcctactttatcttacgtgagcaaagaaagtttaggggacaaggcgaatatgaagttgtatgtaaaaaataaaatcattaaaataattgattcgatagtgtcaaattgatttaacagtccaatatgatttaggtgccattgaaactagtgacacttttagtactcccttcgtcccaaaataaacgcatatatgaggaaactgggtttcctgttcaactttaatcgttcgtcttatttaaaaaaatagattggaatttgtattgatattagattataaaatatgaatagtgttttatgcttgacttatgtttttatttttttaaaaaaataaataagataaacaattaaagctggacacgaaaactcatggctgcgcttattttgggacggatggagtaattaatctactcccttcaacccacaatatagtattctagttacctccaacccacaatatagtattttataactagatgagacatcatctgaaattacatatgtgatgtacccactt

SEQ ID NO: 43364 - DNA, 1501 bp, Oryza sativa
aaaggtgtttgtcaaggcttccattagatatatattcatagcacagcagtttttctactgcctctgtaagaatatattttccattatgctccaccaccttcttttgtatttcataacagtagccaattaacttgactatatttctgtggttgaccttcataagactcccaacctcatttttaaattgattgtcatgaatcggtgatgtttcccgaagcttcttcgcagcaatttctgtcccatctttaagcattccctgttaagtcccccatacaaaattgacatcttttctgtgaacttttgaaaatgctgagaataagggcctgttcagattgtagccaaaataaaccttacaaaattttggtaagatggcaatattgccaaaattttggcaggatttcttatgtatttaccaaatttggcaacaaacattcattttttagcaactttgcaaaaaaaaaaatgtgtggctgaaaatggcatcaaagtgaacaggccctaaaactacaaaaatcttaccttatacactattccaaatgcaccttcaccaacttttcgctcatcagagaactcattagtgatttccttcagaaattgtgatgatagctcaggtgtcggtatttccatttctgattattgagcactaacccaataatagaaaactagagtcacaagcaaaataacacaaagctaagaaaacagagaaaaaaattacaattgtttgagacatagaaatatatgatttctcagtattatgtgaaagctgcttctgagtacccttcatgcttcagtagtcagtatggcttttctgatattgttgctagctggtgtttcgtagttcataaatattagtctcacagatattgaacagaaacaacttttgaatgcactagcattgagtagtcagtatggcttttgtgatatattgttgctaactggtgtttcataattcatattactgttattcaaactaacaagctttcaaattcaaataaaaacaagggtttctcacatactgagtcaggatgagctttcctcaaaacacacacacacatggacatacctaaagaagtaaagaacggtgtaatgtttcttagcctttgaacagaagcagcttttgaatgcactaacctggagaagctttgcagctgcagaggtgctagctgctgctcacacaacaaccaaaggacgcagcagggcagaggagatgaacggatttcttctccagggaagagaaggggggggggggggtgtgaatactgggtaagcaggagctgaaatgaagcatcagcagtacaacttggcaatagttgacttgactccaatattagatggatgtgaaatggtgaatatgatatgcctggtgtattttatgagtatacagacaagttgtttagtcaatggtcaatgatggttccattaagaggctgtgtttagttcatcgcaaagtttggattttggttgaaattggagatgatgtgactgaaaagttgtgtgtatg

SEQ ID NO: 43365 - DNA, 1501 bp, Oryza sativa
aatagagaagatggtctcaaatatgggttggagcgaggaacgactccagacccgtcagcaaggcatgcacaccgtcaaagagacggaattacttgctgccaagctggacttcctcatgaagcgattggacgaccacaagaaacggccacaaggcaccgtcaaggccttagactctcacgtcacgtgtgaggtctgcggcggcacgggtcattctgggaatgactgcccggaaacctgtgaggaggcgatgtacatgggcaacaacaacgggtaccgtccacaaggaggtcagcggtggagccaaccacatccatattatcaaggaggtaacaacaacggtaacttttctaaccagccctcttcgagggatctagtttttacataggctaaaaccactgatgcgctaagcaaaaagcttgcagccaataacaagatcctagaaaacataaatgtcaaattagatggctttgcttctacttttttcgcgctgtgatgcaccccatctcccaaagtgttgaccctaccgagcactggggatctgggtggaggctataattcaatagtggtgtcattgcccttgcctactttatcttacgtgagcaaagaaagtttaggggacaaggcgaatatgaagttgtatgtaaaaaataaaatcattaaaataattgattcgatagtgtcaaattgatttaacagtccaatatgatttaggtgccattgaaactagtgacacttttagtactcccttcgtcccaaaataaacgcatatatgaggaaactgggtttcctgttcaactttaatcgttcgtcttatttaaaaaaatagattggaatttgtattgatattagattataaaatatgaatagtgttttatgcttgacttatgtttttatttttttaaaaaaataaataagataaacaattaaagctggacacgaaaactcatggctgcgcttattttgggacggatggagtaattaatctactcccttcaacccacaatatagtattctagttacctccaacccacaatatagtattttataactagatgagacatcatctgaaattacatatgtgatgtacccacttcgtcccataaaaaaacaacttagtaccggatatgacgcatcctatcacaatttgaattgatgcccgtgcatatacatagtattaggatgtgtcacatcttatcctaaatttattttttattggacatggaagtatgtgaataggctttaccattctactatggccttgtttagttcccacgtaaaaacatttcactatgtcacatcgaatgtttggacacatgtatgaagtattaaatatagacaaaaataaaaactaattatacagattgcgtgtaaattgcgagacgaatcttctaaacctaattgctccatgatttgacaatgtggtgctacagcaaacattttctaatgacatattaattaggcttaataaattcgtctcgcagtttacagcaaatttgtaatt

SEQ ID NO: 43366 - DNA, 1501 bp, Oryza sativa
tgagattttgagtaagttgtatctagatctctttagtaaagtggataagcatagattggtgtgtgatgcttgtgagcttggaaaacatactcggtctacatatgttgggattggtcttcgtaactgtgagcctttcatattaatacattctgatgtttggggaccatgcccagttacttctgtgagtggttttaagtggtttgtcacctttattgattgccacactcgtatgacttggatttatatgcttaagcacaatagtgaggtccttcgttgctttcaggactttcataaattagtgacaactcagtttgatgcaaaagttaagattattcggactgataatggaacagaatatatcaataatgaatttgtgtcatatatctcagatgaggggattattcaccagactagtacccctcctcaaaatggtgtagctgagagaaagaatcgacatttgctagaagtggcaagatctttaatgttccagatgaatgtgccaaagtacctatggagtgaggctgtgatgacagctgcatatcttatcaatcgcatgccttctagaatacttggtatgaagtcccctgttgaacttttattgggtaagcgagagttcaaggtccctccaaaggtgtttggttgtgtttgctttgtgcgagatcatcgaccttctattggcaagttggatcctcatgcagtaaagtgtgtgtttgttggctatgcttcaagtcagaaggggtataaatgttgggatcccattgggagaagactgtttgtgagtatggatgtgacatttcgtgagtttgagccctattataaaagtaaaggagatcttgaccaatttcttgaggaattctcgactgtcatggaggttgatagtcgagagggggagatagagagaggtgacacacataggaaaaatgttagtgacaagaatggggagacagtggtggttggatcaataccatgctctattgacaatgcaagtaaagaagcagtggaagttattggagatacacaagacaaggatagagaaatggttcttcatgaggaggatggagaagatggagaagatgaagaagtggttgttgggacaattccatgtcctatggagcgagccgaaaaggtgaaacaaaaggatgtgctagtctaccaaaggaggcggtttgatagtcagggggagaaaagaaaagggttagtgcaaagttaagttgaagagttatcacatccagaatgcccagtccctgaatcctctcagaacctctctcctacagtctcattggctccccttgagataattggtaatactcctcccattcttgaacaagtagaattacctcttgcacagcgtagagagactagatccaatgctggtagacctcctatacgtcttggttttgagcatcttagttctatgcatgacattgcaaactatatcttatattctcatgtttcactggcatacaaaacattcattgcatcattatagacagtgcccata

SEQ ID NO: 43367 - DNA, 1501 bp, Oryza sativa
gagttggagacagagctcgacacgccagcggcggcgaggtttatctctggtttttgaagcggcggatgaagacgaggagacagagctcgacacgcctgcggcggcgaggtttatctctgtttttttttttttttttttttgaagctgtgcggatgaagaggaagaggagacagtgctcgacacgcctgcagcgacgaggtttatccctgtcttttgaaacatagcgaggatgaggagacatagctcgacacggtagcggcggcgaagtttatactgtttctcggatgagatcgtttgattcgaaaaagatcgtagacgacaagaccggatttggttgaggacgcggcgtcgtgggcactgcgaactcccggccggaggaggaagaacgagctgacagggtggtgagctgggctgggctttggcgcactcccgcgggccggattgctgggccaggccgggccggaagagagaaaagagaaacgggccatttttgcatctgtcctcgttcatcccccacactgccccacacatccatcgccggattcgcctccgcctctcccttcctctcgtcggcggcagcaagcggcggcggcggcggagctccggattcgaggggaccaagcatcgcctgcagaggaatccgcctgaagggtaagcacccctcagctcgacgcatcgcgctctgcctccctctcgatttcctcgtctgctctagccgacgtcgaatcgtgatccctagcatcgtgtgttgatgcggaatcgtggttgaacatccagattggacttcgattccgggaggatccccgcccggatccgaattttggccgaccgggatccccgtctcctccgccgagatggggagcacctcgtcgatgctgacgcagtacgacatcgaggaggtccaggaccactgcgaccacgcctgtgagtttgcgcgcttgtgtttctctctttcgattggattctgaactctcaacgaagattgatgctgtctgccgctgttcccctccgatctgacctgctgattcggggtgttttgggagctaagtctcgcagcaggagatcgtgtcgctgtaccaccggttctgccagctcgaccggaatgggggcggattcgtctccgccgaggaattcatgaccgtccccgagttcgccgtgaaccctctctctcaggttacaagacataactagcctgttcctcaataccttttcttattctgtattgagaacgagggattaggaaaggaatgaattgggtgattgggtagatgtttgaggaatgctatttgttaatcgatgcgatgtctctgtcagaggcttctgaggatgctcgatgggctgaactttaaggagttcgtggcgttcttatcggcgtttagtccccgcgcaagcctgcagcaaaaaattgaatgtgggttcccagttcgtacttaaattctccatttgctttctgtcccggatgtctagatgttctgagaaatatgctatgttttctctgtag

SEQ ID NO: 43368 - DNA, 1501 bp, Oryza sativa
gtttgagccctattataaaagtaaaggagatcttgaccaatttcttgaggaattctcgactgtcatggaggttgatagtcgagagggggagatagagagaggtgacacacataggaaaaatgttagtgacaagaatggggagacagtggtggttggatcaataccatgctctattgacaatgcaagtaaagaagcagtggaagttattggagatacacaagacaaggatagagaaatggttcttcatgaggaggatggagaagatggagaagatgaagaagtggttgttgggacaattccatgtcctatggagcgagccgaaaaggtgaaacaaaaggatgtgctagtctaccaaaggaggcggtttgatagtcagggggagaaaagaaaagggttagtgcaaagttaagttgaagagttatcacatccagaatgcccagtccctgaatcctctcagaacctctctcctacagtctcattggctccccttgagataattggtaatactcctcccattcttgaacaagtagaattacctcttgcacagcgtagagagactagatccaatgctggtagacctcctatacgtcttggttttgagcatcttagttctatgcatgacattgcaaactatatcttatattctcatgtttcactggcatacaaaacattcattgcatcattatagacagtgcccataccaaaggattggaagtgtgcaaaacaagatccaaggtggaaagatgcaatgagagaagagttgaatgcccttatgaagaataagacttgggagcttgtaaaacttccaccaggaaaaaaggcagtgggatgtaagtgggtttttacagtgaagcaaactcctgaagggaaggtggataggtataaagcaagattagtcgcaaaaggctacagtcaaacatatggaattgactatgatgagacatttgcaccggtggcaaaaatgggtacagtgagaactttagtatcttgtgcagtgaactttgggtggcccctccatcagcttgatgtgaaaaatgcatttcttcatggtgatttatatgaggaggtctacatggagattcctccaggatttgggaatagccagacagttggaaaaatatgtaaactcaagaaatccttgtatgggttgaagcagtttccacgtgcgtggtttgaaagattcaggtgcgcagtgtgtgatatggggtattctcagtgtaatggagatcacacggtattctacaaacatagggggacatacatcaccatcttggctgtgtatgttgatgatatagtgatcaccggtgatgatgtagaagaaatcaggtgcctgaaggaatggacacctaaatgtagaaggatattgtgatgctgattgggcgagtagtatggatgatagaaggtctacatcaggttattgtgtgtttgttggtggtaatcttgtttcttggcgaagcaagaagcaggcaatggtggctcggtctaccgccgaagcagaata

SEQ ID NO: 43369 - DNA, 1501 bp, Oryza sativa
tgtgacatttcgtgagtttgagccctattataaaagtaaaggagatcttgaccaatttcttgaggaattctcgactgtcatggaggttgatagtcgagagggggagatagagagaggtgacacacataggaaaaatgttagtgacaagaatggggagacagtggtggttggatcaataccatgctctattgacaatgcaagtaaagaagcagtggaagttattggagatacacaagacaaggatagagaaatggttcttcatgaggaggatggagaagatggagaagatgaagaagtggttgttgggacaattccatgtcctatggagcgagccgaaaaggtgaaacaaaaggatgtgctagtctaccaaaggaggcggtttgatagtcagggggagaaaagaaaagggttagtgcaaagttaagttgaagagttatcacatccagaatgcccagtccctgaatcctctcagaacctctctcctacagtctcattggctccccttgagataattggtaatactcctcccattcttgaacaagtagaattacctcttgcacagcgtagagagactagatccaatgctggtagacctcctatacgtcttggttttgagcatcttagttctatgcatgacattgcaaactatatcttatattctcatgtttcactggcatacaaaacattcattgcatcattatagacagtgcccataccaaaggattggaagtgtgcaaaacaagatccaaggtggaaagatgcaatgagagaagagttgaatgcccttatgaagaataagacttgggagcttgtaaaacttccaccaggaaaaaaggcagtgggatgtaagtgggtttttacagtgaagcaaactcctgaagggaaggtggataggtataaagcaagattagtcgcaaaaggctacagtcaaacatatggaattgactatgatgagacatttgcaccggtggcaaaaatgggtacagtgagaactttagtatcttgtgcagtgaactttgggtggcccctccatcagcttgatgtgaaaaatgcatttcttcatggtgatttatatgaggaggtctacatggagattcctccaggatttgggaatagccagacagttggaaaaatatgtaaactcaagaaatccttgtatgggttgaagcagtttccacgtgcgtggtttgaaagattcaggtgcgcagtgtgtgatatggggtattctcagtgtaatggagatcacacggtattctacaaacatagggggacatacatcaccatcttggctgtgtatgttgatgatatagtgatcaccggtgatgatgtagaagaaatcaggtgcctgaaggaatggacacctaaatgtagaaggatattgtgatgctgattgggcgagtagtatggatgatagaaggtctacatcaggttattgtgtgtttgttggtggtaatcttgtttcttggcgaagcaagaagcaggcaatggtggctcggtctac

SEQ ID NO: 43370 - DNA, 1501 bp, Oryza sativa; identical to SEQ ID NO: 43368

SEQ ID NO: 43371 - DNA, 1501 bp, Oryza sativa
cggcacgtatgaatgtttcagactttcagaggagacgcatgcatgcgtatatgtctcatgccctgcatgatgatggcatttgcaggggctcgcagttgtcttcggcaagaacaaaatttaagagatgtggagtgaaaacgctaacgcttgcagcaggtgctgggcctgggcgtgcttgcctgggaacctacacggcaagtggaattttttttccttttgttggaacattttcttttaatgctgctggagcactattgctgcctctcttttgcagtgagcgcagttaatcgctgggaccaaagttgttcttgctctcttttatttccaccatttttttaggtttgggaataagatattctgcaagcacgaaaatgtgccttgtttgcagcctgcaggtcgagtaaaagcaaaaccaaccagacgttccagactgactcgttttcagaagatcaaaagaggctatcattgtttagtgggggcccaagaagaaagaaggcccagttcatatgttcagcaaaattaactggctacgatgcgtccgtccccctgtatcctgtactcatgtgagcagcagaagtgaattgatccgtagtactgtacactgtaaaagtgtactcgtaaacgtgaagtttggtcttttgcttctgggagaatcagtttggtttttttttactgcacgcatcttagttacgataagtactattttgtgctcagtggttcctgcagtcatgtgctgcttcaggctttcagctgtttcctgaaatcttgccccagggaaaacactagcagcaagattaaccactgcacatctggcgccatgcatccatctcgattagctgtcaacgctgtttgggccggcgagctccattcactgattgacctatacgtttctgtgtctcatttacagatttttacctgttacctgtagttgccgtactcgcgaacaggaaccacctcaatcttcatggtccggttgaacgagatctattgacgcttgacttgtctcaattagaagagtgatccccaaacgataccggagctttcaggcacaggggataataagggttggatgaagtaaaagcttacacgtcttgcgggctttctctcccaaagccgtttaattaaactcgtgaaaacgatggttttatccgtcgccgtcaccccgtggccggtacggtgaagatttgctccacccactttttcttcagaaaacaattaatacatgatttgctccaccccccaaccatcatattactttctctacctctgggagactcggactcgcggcgtttgttttctttcagcttcaaggagggggcgcgcggatagcaccggtgcaccggcatggacgctgaccacgagcgccggcgtcccgagcagggcgctctgaggaggccgcttttagccgacgacgaggtacgtgtgcttctgcttccccgcgcgcccccgtagcagcagtagtatgtactaccaccgacagcttcgctgccggcgccgcgcg

SEQ ID NO: 43372 - DNA, 1501 bp, Oryza sativa
aaaatgggtaaaaaaagggaaaaaaagcgtaggcggaggcgcgcgcgccgagaattagcgatcgcgaaatttcgttctccgtatcgttgggctagaactgcccatcgtacctaagtacctatttcgttgatctattagaccgtaaaaatttgatctgacggtcaccagcaatcctcctccatagcagaagaagagcgcgcgggctcctacttttctcctcggccctcaccgccgctcgccggagctcccgtcgtgtttcccccacctaccctttttcagacatgcagttttacaggctggacgatctgaactacgtggagattcggcaaacctgcccatcaattttgacggggaggtgatgctgccgatctgatcaagcacgcagatcgggctattatctgttcaattctctcttcttcttttttaagggtatcagtacgagattgtgctatttcattaaaaatagagggaacaaagtataactcgtagggataaaaaaaaatgagaaatgtacaaaactgagaaggcctatacacaatttgatataaaatctcgtagcctccttgctcccgccatggtcctagttgttgcctcttcttttatttttttcataaggttaagggtcgcagtctccttgtgtttgaaaacccactgatttctttccttccagatctcctaaactattaaaataattagagtccgaaggcctttcttaagcacatactttatattggctagcatttcttaccaattttggacgctctggcatagagcctagtggcatgggtccagatgctcgtaagccaaacggcttagagcaggtacaattaacatattttaatgagataaacgacgagacagaagagcaacggactacagatctgtagcaagctacagcacggattataagacgtaatgtgtgtatgacatgtgggacaatatattaatagtatagtaagcaactattatatgaatagctattaaattggctgtagatgaattggagctaacagtgggctatactattaaactcttacccaatctcaaaaaacgaaggagaatcgagcagcggaacagtcttcacagagatttttccagagttacatgcgactagttctaaaaaagattaaaaagaatttgaacgcaacggtcggcggcaactacctcctagcaaagatcaaagaagatttcaggcttgcgggagttgcggcatcgtctggttggtgagggcgtgaggccacggcgcgcttttacgagtttcgtcaagcggaggttgttgagctcgatcgatcgctggtcaatctcgaccggcctaaactacttgaccgaggaaattcgccaccacctgctcttcccaagtttctttggagctctcgcgtcgtcctcccctgggggcggcacgggaggcggcgacccggccacccctctccctcccctcctccccctctgcttcgccgccgcccgagcggccgccggcaaagccggccggccgcaaggacgg

SEQ ID NO: 43373 - DNA, 1501 bp, Oryza sativa
tgaaaagagcaaattgaagcagtaaacagtgacagcgacttaggattgctcgtgcagttgcttggtttttccttgctgatagtgaatgtaggtgaagaacaaaaactctttccgaagaggtctcgctgtctcacctgtcttcttgtagtttgactgttattctgagcagctgatgtaatttcaagtagtagtggataagtgccctgcgtgcacattttaatcccgctggaccgttcatgcttgtacagaaattccctctctctttttttaacaaagggagggaattccgaccttgcaggtagccaccttaaagattgagcacatttcctgaccaaattacagtgtttgttctgaactctgaagttcagtggtggtacctaaacgtgatcgcaaagaacaagaaacctgaaacttacaagaaaaatggaaaagtacccaccacatgccgaattatctttgacggatcttccacagataaccttgatacggtttcttcagttttctccagcacgggtcaaagacactgaactgaatcttcttctgacagtgaagcagggaacaccacattaagccgagacgcatctttccgtagatagccgccgaggtaaattcggcacgtttcagaatccagctagaagattgggtgcagcaaattctcgatagatagttgttgccacggcggcacgccgtcctcaaaaaggcgcagatcgcactccggacaaaagtgcagtagtagtctccttcaggagccaagactaatcggagcagctgctagcctgccacagccagccttcgcagcccgcgaccagcacagctcggaaatttcccgcacgtctcgcgaccaaaaaccattacgaccaactgcttgcttctcgatctttaattaattctgcagtggactagtattttacgcatgtgcgcgctaaaatagagcaatgaaaccgtgcaaggaaagcataaatgcgtaatagtagtataatacaatttgcgttcacctaaaaacgcagagatttgaattgatctcgcgctgatattttttatttttctcactggggtgggtagatggtgactgcggccagggcgcttacctgttctctccatctctctcgcgggaagcgtatataagctgccctgcttgccgctcatttccatctctcgtgctcagctcgcagccaaaaaccccaaggcgctctcacgacggcaggagctagcttagctgcagaaaaagcaggtgacgttgaattctgatttctgaacgagttgcagcagcatagcgacaatggacgccggcgacgccatggagagaggccagcagcggctgccagaggtaagcatatgcacaacttcacaactatctcgttctcctcctctcaccggtttcgctcatcatgaattgatctttcttagtactccagtttgcaacttggaaacaagcgatggcagtgagaatgcacgcatatggatcataactatagcatagtaattttcaggcatgctgtta

SEQ ID NO: 43374 - DNA, 716 bp, Oryza sativa
ccttatattatgggacagagggagtaggatttaggacatctatatgtaataatgcttttttttttttggaaaaaggccaaagcccagcttttataacaaagcgtaacagagccatacaaccgctgggatcatgataccagctcaagatgtcaagcacagaaactaagtaggacaggacgctgctggcacaaccataacaagctagagatagatctgtccaatttgggtttatgttctaggtaaattcatctaggtccagtgacaaaatttgacatccgcccaatttagatggcccatttgtggcctgagagccgtggatacatgcacgtttaacaccacattgctagtttagttgggtggaaccaatttataagatattgtccattcaaccataccactcccggattaacttttttacacgaaacgagaacaaaaatgtaagtaggttgctatgtgtaagtgtggccgctcatttgatggattggcttgcacggtagtgttacactaaacaatattagcaccacatggaagcaaagcattccaagctagtagtactaatttttgcccaataaaatcctttctcaaagagaagttttaggaggatataaagttagttagagcttatgcaaccgtggacctgtttgtatctaccaatattatacaaaacggatattgttcttgcaaagttgtatttcctacctgtttatcctgccaga

SEQ ID NO: 43375 - DNA, 1501 bp, Oryza sativa
tctcctgataggagccatcaacattcagcttcatccatccactcggaggtttctctcattttgccaagacagattgcttcttgcacttgggcctgtcttctccaattacatgcatcccagatcccaagtttgcattagggatgtcatctctcgggttttctggcctttggatggtgaaataatcaaatcaataaggctctccagtcggcaggatgaggattttatcgcttggcatcctgataaaatgggccagttttcggttagaagtgcttatatgttagcggttcagctcgcaaatgctggggagagctctagctcctcaggaaatgatactaagaaagcgtggaaccatgtttggaagtgtaatatcccccaaaaggtcaaagtgttctcatggagagctatctcaaactgtcttcccactatggtgaataaaaagaaacgaaacctggaattgtcggacatctgcagtatctgcggcctagagcctgaagatgtggcccatgctttgtggcgttgcccgcatgccaggcgataccgggacctaatgagctccgagatgcaagtacagcgtatcctgcacgggtctggggaggggtctggttggatccttgatcttttggaatcaatttcagaggatgatcgccctgtctttcttatgtcattgtggcgaatctggtatacacgcaatgagattactcacgataaagcggcgccatatgtggaagtttctaaacgcttcgttctgagttatgtaaactctctgatggaaataaaaatttctatctattttaatcttagccactctcccactcttacatgtacaccattaatgaggagcaacatattttttttcttctcaaatcttaatatatgctaaacaatttagagttataattattacgagacggaggtagtggctgatattgaggtgtgtgtggggtgggggggattatatataattcttgttaatttcagtagggggtatggtttatgcatggtcaatttggagacacatgctttcctgcctcttagcggggagccctagctagcaaaggtaggtgctaatcgagatccaaagttacttctagaacagtatagcaactggctatggtactatgcttctataggacgcctttgggcatggatcaagtattcaaattagaggtgcctagcttgactgtaaccatccacacatgacacacagttacatgcatatggtggcagcacaaatatgggatccaatgtactttgaaattactggatcaaattcaactatcatgcaaatatatatttttgtaggagtgtagatgatggctggcctatagtagcatttgcatcaagctatagtcatacatgtagagggtgtttagatatagggtataaagttttagcgtatcacatcggatattatataaggtgtcacatagagtgctcgggcacaaataaaaaaactaattacagaatccgtcaataaaccacgagacaaatttattaagcc

SEQ ID NO: 43376 - DNA, 1501 bp, Oryza sativa
tgtaaactctctgatggaaataaaaatttctatctattttaatcttagccactctcccactcttacatgtacaccattaatgaggagcaacatattttttttcttctcaaatcttaatatatgctaaacaatttagagttataattattacgagacggaggtagtggctgatattgaggtgtgtgtggggtgggggggattatatataattcttgttaatttcagtagggggtatggtttatgcatggtcaatttggagacacatgctttcctgcctcttagcggggagccctagctagcaaaggtaggtgctaatcgagatccaaagttacttctagaacagtatagcaactggctatggtactatgcttctataggacgcctttgggcatggatcaagtattcaaattagaggtgcctagcttgactgtaaccatccacacatgacacacagttacatgcatatggtggcagcacaaatatgggatccaatgtactttgaaattactggatcaaattcaactatcatgcaaatatatatttttgtaggagtgtagatgatggctggcctatagtagcatttgcatcaagctatagtcatacatgtagagggtgtttagatatagggtataaagttttagcgtatcacatcggatattatataaggtgtcacatagagtgctcgggcacaaataaaaaaactaattacagaatccgtcaataaaccacgagacaaatttattaagcctaattaatccgtcattagcaaatgcttactgtagcaccacattattaaatcatggagcaattagacttaaaagtttcgtttcacaaaatactcataatctgtgcaattagttattttttagcccatatataatactacatgcaggtgtacaaacattcgatatgacagggtaaaaaattttatggtgtgatctaaacaagaccgtagatgtgtcactaattaagtttaatacacctagctataggccatagcagagtactagctagctagctcaacttaatttgaaacattttgaccacaaagttgcgagctaggttgatgatcaattatttcaatagtagacttccatacaaagatgacgtaacaagagtattccactatatattctgatctgatacctcgagtttaactattcccatttgcgtggagtggcaaaatatgcaacttactactccctccttccgtaaatgtttaatgccgttgacttttttaaacatgtttgaccgttcgtcttatttaaaaacttttgtgaaatgtgtaaaactatatatatacataaaagtatatttaacaataaatcaaatgataggaaaagaattaataattacttaaattttttgaataagacgaacggtcaaacatttttaaaaaaatcaacggcgtcaaacattttggatggagggagtcctttttaccatccgatcattctaccctaaaccaaatatttgcgaatacgcaaaaagattacacatc

SEQ ID NO: 43377 - DNA, 338 bp, Oryza sativa
ttgggccggtcggcccatctccctccccctctctctcctctccccgtggcccactcggcctctccccgcgcgcgcgccgctgacgggcgggcccgcccgccaccctcgctgatgggtggggcccacccgtcatccccttcctcccgccgcttccgccgtctcgcccgcgccctagcgccgccgccgccgcgaatccgccgcatcccaccgtccccgcgtgcaatcaatagggggaaatcactccccttgatcccctctccctttccccccacttttccctctctctctcgcgttcaaacgggcggatttgcccccgcaaatctcgccggcgccattga

SEQ ID NO: 43378 - DNA, 715 bp, Oryza sativa
ccatgcaccccgagcccagcttaaaaccattttgagggttttaaaaaagggggacgtgtgaatccatttccacaataatccaactattcaatagtgtccaggtggtgagaatattcccaaagtctagagttataaaaccacctaatgttgcctaacgactctagcggatccccctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacatgaccaacggaaaagaaaaggcttttactctgataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagc

SEQ ID NO: 43379 - DNA, 1501 bp, Oryza sativa
gttaccgatggagctggagatggtactggtgctggctttttccttccagcagatttcttttgctgcaaaaatcaagtattaataagagaaatcagcacatgaaaattttacttgcatcaagtttgaacagaagtgcttaccctggtttgccgagctagggcaattggtgttggaggcgttctttgaggagccgggatatcggctggtggtgtttgttctcgtgcctcgctcaactcagcagctgcttcatcgacagcttcttcaatctcttcctcagccaagacttcttccatgtctggatcaatagcaggcagattatcggctggctttatgtcacgactgagaaaaatacattttcccgaacgctagtgtattaatccccgtcccaggaaaagccggggtacaccacacacaaatatgatataaaagacacatctttattatatcgataatatttacattattacaaaggcacttaaggcctgacaatcaaaaataaacagcagcggactagcgggcctgcggctccatcttcacaggcgctctgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaacgcttctcttactggaggggggaaagattgagcaagaatgagtacaaccacagtactcagcaagccacaccggagatgcacaattaatgcaaaggagtacaaggggataataatataggggttaagttttgcagaaagcagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaatcacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctaga

SEQ ID NO: 43380 - DNA, 432 bp, Oryza sativa
ctcatcgagtattagattattatatacaatctcgtgctgcattggttaggttcgacctactagattgttgtttataatataagtcttgctaagccaataggttcatgctaatgttttatcggggtgctagccgatacgttatctggacattgcatcggcttataaggattacatacaagttgggtttagccgattgcaacaaaggtttcactgtttaaattaatcttttggattttatgacatcggacctccagccgatgtatgctttaaccttcggatcaatgcttattctatcatattgtattgctagccgattggtttatactagattatattgttattttattacatcatcatcagccgattgcctttctatcattatctatattggacatatagccgattgcttaaatcctatcgctatcggctagt

SEQ ID NO: 43381 - DNA, 495 bp, Oryza sativa
ctataatcacaatactgttctaaatagatttgtcatatccatcacattagacagatctatcggctcatcgagtattagattatcatatacaatctcgtgctgcattggttaggttcgacctactagattgttgtttataatataagtcttgctaagccaataggttcatgctaatgttttatcggggtgctagccgatacgttatctggacattgcatcggcttataaggattacatacaagttgggtttagccgattgcaacaaaggtttcactgtttaaattaatcttttggattttatgacatcggacctccagccgatgtatgctttaaccttcggatcaatgcttattctatcatattgtattgctagccgattggtttatactagattatattgttattttattacatcatcatcagccgattgcctttctatcattatctatattggacatatagccgattgcttaaatcctatcgctatcggctagt

SEQ ID NO: 43382 - DNA, 287 bp, Oryza sativa
ttttggatgatatgttgtggtaataggaatggtggcatgagcctaagtgtgggcatttatattgttgaagggaaacattttagtttgttcaagtcttatatgtagtcggagaatgtacttctttaaagtatatcgagggttctattttttttagcatatctcaaaaaccatttattgacttttgaataaaagatagattaagttcacacaactcttgtatcgagtaaatattatactaccgctagctaattatcctatataccatttgtacacatgccatataaata

SEQ ID NO: 43383 - DNA, 264 bp, Oryza sativa
ttcctgcagcccatctgaaaattttatttttgataggcatatttcaatccaacaacctatatcttaatgactttctcggatttaatgcatgactctctattctttcacacatgattggctacatgggcattgagaaatgtaaatattaatgaatcgcttgtttacgatgaataactaatacatgtttaaatggatgataagtagaattacttatccttggtctgtgtgccaagatgaaatatgactatcaaaagtagatggagg

SEQ ID NO: 43384 - DNA, 437 bp, Oryza sativa
tccatcattagcaaatgtttactgtaacgctacattgtcaaatcatgaagcaattaggcttaaaagattcgtctcgcaaattagtcgcaatctgtgcaattagttttttaagtctttatttaatatttatacatgtgttcaaacgttcgatgtgacaggtgtacaatttttatgtgggtcctaaacagggcctaggttcctgctccggcccttcgtttcgtagaatggagtaaaggtattttgttttttttccttaagtggcaacattttaacgtactcccttcccttggtcccgttccaagtaccgtcccattttaagtgtagtcatacgttttttttccaatatttgatcatccatcttatttaaaaaatttatgataaatttttaaaaattaagtcacgcataaagaactattcatattttatataataataat

SEQ ID NO: 43385 - DNA, 421 bp, Oryza sativa
cataacgggaagagagattcaagaaggtagaaaacacgtgcacctcatttagtactcgatcgtacaaccataacatttccactagtttttaactgtttcttcaaaacaaaataatatataccagcagaatttcaatccacttcatccattcgaaggcatagatcgatcagactaggaaagaaagaattatttgctttcaacaagtgtcattgccagaaaatagttaatctgttttgaacttgtgcatgcagtttaattagggaagagaagtacagattacacaaattctctgcatcatcctagctagtcaatcagtgcagccgtatcaacgcttaattgattcaagtttcaagagaatgaccccaaatatccatgagttcactattcttcaattgacaatgtgcttgattgaccatcaaaa

SEQ ID NO: 43386 - DNA, 1501 bp, Oryza sativa
tcaactcaagcgtgaggattatatctccaatttggacttgttccggatacattccacatggattcattgtcatgagtctattttctatgctcaaagactggaccaattattattccccgtaagggctatcaaccgaatacttgcgccagtcgggattcaattgttacatctattttggagtatcccataagggataatcactcagatcagaagctattcatatgagctacgcttggtctatattacccggaagatttattactcgggagcatgttatatgcgtcatcctttaaagggtgtcgagggcatatgttttggcctaggcctaatatgtctgcagcccatatttcaggtgtggcctgtcacgtttttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaactgattggatacaatatcgttgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagagacttaagcacatctgttaaagcagtgtgcgcatggcgtatgcccaatactttggaaatttctttattcacaatatacaagtttctttatagctattttgctatatcactcatcatattttacaaagcagttggtatatcactcggatcatgttatttggaggattcataccgcatatgctatatattgatatcaagtcacttggttgattacgattatcaaaaccactcggttggttggattatttattccttgactatatgcttggtttattcaattaaccatattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatgcggcatggttatccgactagtaataggggataacatatatatatggaatatgtaacagatcatgactcgggtattacgtttccttatatattacggaacagcctaaagttctggtttgataatattgtaaagtagatttaggaaaccgataccgtattggttaaggtttctatcttgtaatcctgccccccaccctatataaggtgggcaggaggccctctagggggca

SEQ ID NO: 43387 - DNA, 1501 bp, Oryza sativa
cctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatatggttaattgaataaaccaagcatatagtcaaggaataaataatccaaccaaccgagtggttttgataatcgtaatcaaccaagtgacttgatatcaatatatagcatatgcggtatgaatcctccaaataacatgatccgagtgatataccaactgctttgtaaaatatgatgagtgatatagcaaaatagctataaagaaacttgtatattgtgaataaagaaatttccaaagtattgggcatacgccatgcgcacactgctttaacagatgtgcttaagtctctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaacgatattgtatccaatcagttgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaaaaacgtgacaggccacacctgaaatatgggctgcagacatattaggcctaggccaaaacatatgccctcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcggttgatagcccttacggggaataataattggtccagtctttgagcatagaaaatagactcatgacaatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcagcgacagacagatcaactaacaatgaagattaaaagcgatgaccaaatccatccatca

SEQ ID NO: 43388 - DNA, 250 bp, Oryza sativa
tacctatccttccctgggagggggacccaccttaccttgaccgggccatgatccgtgccttcgctcagaagttaagcagcagcccgtcctaagtgggacccagcgccaccccccgcctgacacgggggacagccctgtcattcccttataaatgggtgaagacttgtggtggtccttctctcatggagggaaccccgaattatgccctgatgggacgggtcatacctacttccactccgcctgttacaga

SEQ ID NO: 43389 - DNA, 304 bp, Oryza sativa
ttactaatggtatcaatatcatatccaaaatacaatatgctcggtaatttatacgaaagtacatgtagtttagtggtttgtagtgatctaatcgaatagcacctcaaggtcatatgttgaaatcttcatgagagcgaatttcacattgagttgtttgaggggctaagttcccaatttaaatgacaccacacaccgccgtgacgtgtggtgtccctcatcgagcgcctcggtcgtcgtgcgcattggacggaggcggctcttgcggctgccatggaggcgggtcaccggcgcctgcccctatagc

SEQ ID NO: 43390 - DNA, 1120 bp, Oryza sativa
cggtcagaccacaggtgtattggcggtctgaccggctagtagggccggtctgaccgcaggtatgtgggcggttagaccgtcagggtccgagtccgagtctgttttcgtcgggtctcgggtttcttacctgggaaggcatgtttcgtgtttcctttggtttctatccctatttaagggacaaggccggttcactgtaaaacccccgaatacaatctacttgaatagttcttttactatgttttctattttaccctaatttagtccatctttgtcggtttgcgccgtaaaccgtccgtcgccgctgcgagactgcgacacccttttataggtttgtcctgaaaaccttccgtttgcccacgagacgggtagttatcctcatatcgatctaaatcggcctagaggctgattttgagctctaaatcggctccgctagtcggtttagctgtttttctacagtacccatgttgatctggccctttggctagattgaggtggttggcgactccatatcaccacaaggcgtttaggtgttgcgatcgtacttgtcgacttgtcataaaaagttgccaacgtgatttttgacgactccgctggggaacgatctaatcggccatatcacggccgaatttcgtttaatctagtaattactgttcatcaaatcaggagtttcggcggcgaagttaattatctagtcgtcactgaatccatctgaatacttgccgttcagcacgccgcgtataccgaggatcatcgtcaggaggcagaggccggctcgatggcctcgtttctttttgtttcataaggcaaacagagaaaatatcaggcttctagagccgatctacctggcagacaagcagcaggagctttgtttctttttattactgtgcacgtgctaaaacaaagatcaggctatccaagccgatctacttctgttcacataaaaaaaaagccgattcctgctatatcggttattcccgagaagcttcaaattctccaatttttttgctaagtacagtagcatacaaggaaaattacaagaccgtatattaatctattcggtcagcgatttcggctatgatctatatggccggaattaatcaaggaatttcttcatcaacca

SEQ ID NO: 43391 - DNA, 402 bp, Oryza sativa
tgtgccatgtttacttgatatctgtcctttgtcaaccgtgggtaataaatcgcctagcttgtattacttatgtgacctagctagaactttatgcttagccatgcttaattaccactagctcaattgatgggataattacagttttagacatctagtatcttgacaagctgcgtgctcgagacatctagccatgtttcatggtcgtaattatccaactaaaatgcaactgaatggtgggctgtgggtgcatggttttgttagttgtgcccatggcaattaaggaccggttcacgagaaaccctagaagaattacagtgcttaccacaagcgggagtgggtaactgcttgatctggagtatagctcgaccctttcctaggcaccggtggcgagggtgggcgtca

SEQ ID NO: 43392 - DNA, 528 bp, Oryza sativa
aaaaatcatcatgcaatatcccatcccacacaggttaagaatttagagtctagccaagtgtaatacatgtcccggtgctcagtaaccgcgagcacgactattcgaatagatttggtttactcacactgcagtggatgtacactttacccgcactccgcgactgcccaacacataagcctcgtctcaacacatgagacgcgtcacggcaaagcttttcgataaccttgcattggcagtacccgctccatgaactcaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccaatgtagggcacgcctctcggccctacctcaacggctgccccaccgtagcgcacctgtctcactcaggggtgaaccatctatgcagggatactgcctccgctcggctatctaatccgctagg

SEQ ID NO: 43393 - DNA, 156 bp, Oryza sativa
aaatatcacttctgcaggggtggactctatgggtgatttcttccatcgtgctacccttgacacagatggtgtgttccggcaatatgtttacccaaaaaacatacatgccaggcccttatggccagagcaatggactgcagtcgatgtacttccaga

SEQ ID NO: 43394 - DNA, 156 bp, Oryza sativa
aggcgaagaccgtgctgcgtgtcccatcattctaggtcatggaagcgtaggggctcacggcctcgtcgccttagtcggtgctctcctatagggccacaccatacacgtcgccgaccccctcccatcctgcccgcgctccttgccacgacgaagaga

SEQ ID NO: 43395 - DNA, 287 bp, Oryza sativa
aagatgaagctcacgaatttgttcccaaagttcgaatccttgagggattctactctccgttgaggagctcactaagagccgggtcttagctaaccctttcctcaagaggttgcactaagcactcctccttccactaagggtatctcttccctttcggaggtgagatccgaccttcacaaacttctcccggccaaccacatgtagatcggtgggtcgggagcgacacctagccgcctaggagtcctcaacctccaagagtaacaaatgaagcattgaactcccggaga

SEQ ID NO: 43396 - DNA, 302 bp, Oryza sativa
tatcattcatatctgctccagatttgtttctatcctgcactgatctatagaaatcgaagtcactaaaaataaagccaattttgctgatcaccaatgctaatgttcttggcaaaatttgctacagacatctaaaaaacgtgtaattagctaggggacaccgtaaaaacgcgtatttgctgtagggcatcgcaaaaaactggtaattagctgctggacacccgcgacattattttattattttcggaggaataggagagagaaacaatcattaaagacaaatttgcccttggctcaaatgaatc

SEQ ID NO: 43397 - DNA, 630 bp, Oryza sativa
aatgcagagccaaaattgctctctttgagacagaaaattgaggactgtgagtgccaggttttttttgcattcaggagacaaaaaaaggatcattttgatctctcagatatcaggaagtttgccccaaaacgttttgattcgtttgcttttgcaccctctagtggtgcctcaggggcattttggttgtttagtcttcaagggtttttgtcggagctgtggcggaaattaatctgttctctgtgtttgttgatttcaatttgaggcatactgctcaaacctggtccttgacttgtgtttatggcccttgtggtggcccagagagatctgattttgttacttggtttaagaacattggcaaaatttgctataggacatccaaaaaatgcgtaattagctatgggacaccgtaaaaacgtgtatttgctgtagggcattgcaaaaacctggtaattagctgttggacacccacgacattattttattatttttggaggaataggagagagaaacagttgtgtaaatacggttatacccttcgattttttttctttttctttattcttccttattttttttttctctctaattctctttctctgctcttcattcaagcgagccccagggagaggg

SEQ ID NO: 43398 - DNA, 402 bp, Oryza sativa
atgaaaagattacacctggcttgaccataaccatacaagctggccaaaactgttcttctgaaacgcggttggaaagaccaacctcaggaggaaagaaacacatagaaagacttctgaacacgtatttctttctctaaagacttctgaacacgtctttctttctctctccatacaggtggtcaatgcattcaaagccgacattttctatagttttgataaggaaatgtgaaccaatctccctcttatgtctatcatattgacagctttgtaattgcatttgacaggttcaaccggttgcctcgcagagaaacttttggttagtcaagtatggaagtgatcaagactaacaaatgccgctctccaagggctataagttttgttgtcatctagtacgagcaaaag

SEQ ID NO: 43399 - DNA, 293 bp, Oryza sativa
gtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctactccactttgagctgtcaccaaactaggtatgccgatgtaggcgaggctggtgatgtggagacttgttgccgcagccaccgtcccccacctcgtccatggctggcgccgcctccccatcctaagc

SEQ ID NO: 43400 - DNA, 276 bp, Oryza sativa
ttctgaaacgcggtaggaaagaccagcaaggatcatgtcaggagaacccagcatggttaatgcattcaaagccgacattttctaaagttctgataatgaaatgtgaactaatctccctctcatgtctatcatattgacagctttgtaattgcttttgacaggttcaaccgttgcctcacaggtctcaagactaacaaatgccgttctccaagggctataagttttgttgtcatcagtacgagcaaaaggttgatcaatagcaatggctcatctcct

SEQ ID NO: 43401 - DNA, 402 bp, Oryza sativa
tcaatgtatgcaaacatttcttctgccctgaagtgtagggtagaaaaacattttctcggcaatctatagctagttaacacctgtcaagcctgtctacttcagcaagaatgtcgacgacagcaaatcctccccgtggtgctactaatggccagaattgactagcttgatgccttggtctatttggtctcactagctgttacctgttgtttttgtctggacaagaatttctacggatttactgctatcgtgacacgaattccctattgctgctttctgcgtggcaaattccagtaagtgcttgattagtcaagtatatgtagaattccatggtgacgaagacctttccatgacaagtgttaggatagctctataactacacaagtttggcagctcaccagctgt

SEQ ID NO: 43402 - DNA, 1082 bp, Oryza sativa
aagaaaatcctgaaaatacttggacactcaaagtacttaacaaattacaattagaccatttaatgattaatttaatatgtgggtaattactgaaatgctctttgtatgattaaaattaggaattgagctccgaaaaatccgagaatattccagagagtataattaaccatggagaatttaataaaaattaaatccaaccatgctttatatttaggaaattttatttcccacatttaactttacttgtaaattaatgaacatttaatataaattctattattaatttattaaataatttataaatcctgaaacgaaaatcaggatgtgacaagttcttaccttgcccacaggagggggacagcaacccacaagttagcaaccgtggaacgaggtgtatcggtgctgtagcaacaagacctgtcaagttgtagtcgggtttgtggtggagctgtcggtgggctgaaagcaatgctcaagagaaaactagaaaccacgttaaccaaagcaagttgaataatcgctcaagggtatagtgtacagtgctggtcctagactagttgaagtagagacgcgagcctaaccacaaaggacgccacaaaacacaaacccaaacagcaacgaaaacaagaaacggtggtgaaaggtggtgacaaagagggaatggtggggtgtgctcgctggatcccttttttttttgctttctctctctagtgctgaggagagagacacgactttttatttttatttttattttatttttttgatatttttttcacaaccaggagcacactgcaaccaaccacagaaaatcttaccttaaacggacaaagtatgaagcttgtagaatttttcaaagttctatgcgactaggtcccaaagcttctcgccacaaaaacaaaattttgcaagaggaattcggcgattttaaatttgccgaacctggcaaagtggggcagaatcggatgtatctttttttgtagatgtccgtggatatattataagcctaattttgagtccgtatgaaaaggatatgactgttttaaggaaggtcactcgaatcagggttctatttcctttctagt

SEQ ID NO: 43403 - DNA, 1501 bp, Oryza sativa
tactcctccctcttctccctctcactcactttaaatttttcacctcccctccattttatttccactcatctctcactttctctcctctcctctctatctctttctcttctctcctctcctcttctactctcccgggaggggcgggaggcggcgtgcggctggcgacaaggtgatgaggcggcgactggcctcggggaggctggtgagtggtgacgaggcgggaggtggcgggctcgagcgtggtggcgagctgcccggcggacggcggtggttgacgtgctcgggtcggtgggtgcgcgaccgcggccgtgtgcggaaggcggcgaggggcgacggcgaccgtcccccacccagttccggcggcggcggtggcggcggccggcgggcggtggggaggaggcgcggcaacggcggatctggcgacagcgacgggagcaagcggatctggcgaggacgatgacgacgaggaggatgatggagactgcggcttctagggttagggttcggatttattgattttattttttttggtttttaatttttgcgtgagggcgacataagcacccgcacgcgaaaatcagatttctgcgtgcttctagacacttgggtgtgtgcgggtagcccatccgcacgcgaaaaccccttttggccacacggaaaaatcgttttcatagtagtgatttacccacatgaatacaaataaagaaccagattatatatccataactagtataaaactttaagtagaaaaccaaaccacatatccacgaccagcataatacttaaatattaaaccaaattaagaattcaatgcaacttgattcaaatcaccaactttgggtaatatatttcgacttccaaccttcgaatcatcttgaacgttggtggcggttgttaaaacccatttcgatcacaaaccttcggtaataaaacagggaaaacaatattgaatgcatcgatttgatttaaacaaaagtgaaaatatatgatatttttcacaaaagtgaattattttgcttgggtcaagcaaagaatgtcaagattaatattccaacatttttggttgcagactaaggggattccttttagatatcttgatatttctatgtattttagataacttagtaacaaaaatgaaaaataattgagtaaagaattgataaaaaaaacttagtaattggaaaggtaaacatatagctatttctaacaccacaaccaaacaacatctcatactagccaggctagactaatgcaaacaaccaaacgactgcatatgtatcacattaaattgaaaaaaaaaacaaccaggatgagctcaacctggatgagggagatgagccagcctagacagatacgagcaaccaaacacaccccatatgtctgtaggggagattggttttgataaattctgtgttatcttttttttgagatttctaaagtggttcttcacaaattgattattatatatcacgtttcttctggcaaggggatgagcatataa

SEQ ID NO: 43404 - DNA, 349 bp, Oryza sativa
gcttcaacaatggcgagctgatggtatccaagagctaactcttcacacacattaaaataaatgcactaaatgtatatgcatgagaaagagagaggagaagaaaaataaatacaaagttagagcccatctactatacatactaactctaatatgatcttatagctaatatttggctctactgttaaacttgctctaattgcttgggagggcatgtcatcacctattgcacgcaatggcttgtcgagacccctcatctattaataatgtgtgcacaatgcatgactagcgacaacataatagtggcccgctgttggtatttgctacagtcataaataaatccgcaagaaca

SEQ ID NO: 43405 - DNA, 1268 bp, Oryza sativa
attgaactcatgaagatactctgccacggtacgatccttgtgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagtcacacactcatcaatgaacttctctaatgatgggaatgcaaccatacctacacacaaagcaaacaacaaacgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaatgacaaaacgatttgcaaagaattctagataagaaagaaaggaaaattttcacaaattatgttttcggaaaattagtccttaaggtttgaccatttggcttatcctacagtcaagatggctctgataccaacttgtcacgcccggaaattcactagtaatttctgaactttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaagagaagtaaaatagtggagtaattaatcagaaattttaatcaacactgaacagcacacccatgctgcacaggcccaaccatcctgaacaaccatacccggctgtacagatctaactccaaaccaggagctaaacaaattattaccaagt

SEQ ID NO: 43406 - DNA, 726 bp, Oryza sativa
attgaactcatgaagatactctgccacggtacgatccttgtgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagtcacacactcatcaatgaacttctctaatgatgggaatgcaaccatacctacacacaaagcaaacaacaaacgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaatgacaaaacgatttgcaaagaattctagataagaaagaaaggaaaattttcacaaattatgttttcggaaaattagtccttaaggtttgaccatttggcttatcctacagtcaagatggctctgataccaactt

SEQ ID NO: 43407 - DNA, 1501 bp, Oryza sativa
actttctagcattgcccacattcatttagatgttaatgaatctagacatacgtatgtgtttaggttcatttacatctatatgtatgtaggcaatactagaaagtcttacattgcgaaacggatggagtatgttgtaaagtatacctcccaacatactggaaacacaggaattcttgaacattatggaaggttatatccttatgcttggcaaatacctgaaattggttgagaaatataacatgtaaagagaacgcatgcatgcaatcctccataacatgggaaaacaaatgcagggctcatttcataccgcaagcattatttccttgtaaactatctccggaaggtatgttaaggtcgtaccactatcaattatggtacccttcttttcgcctgtatcaaacatatgtgacggaagctttagtgcagtaccaccaacatcaattgacttgaggtttacattgtagtgtggcctgagtagtagaatcatggataggtattagaatggtgtaaatggaacaaaaggaaaccagttgcagacatgcaatacatatcacaggtacatatgtaccctatctgccaaaaaagtgtacattccctaaaaatcagtaactgccatggaaagaggttattagagattcataaatgagacaatagaattaagttgaactggccaggagaaaatatgaagaagagagtaggatactggcaaaaagacatctctgcaccacacattgatttattctgcacatgagatgtgcatgctacaaaggtaagccacctttccaccataaaaacatcaagtaacaaattctagctaaaatagttaggtgacaagcaattccaaaatagtatccttcaatctgcggcaaagataaataaatcaacgacaaatttcacatgattccatcccttcaacatctacagcataccatgtatcattttcttctcaacatttgtagcagtagatattataaaccagaatcacaacattttccacatcaagttttacagataaaaatgaaaatcatgctaacagcatatgagtacgagagattatacaaaatatgaacccaatacatctaaggtcgaagatatctatgtcaagatttacagttatttggtatgttcatcagttccaaaaggaaatggcaatttgagccagagtcaaaagaaagggatgacaataataaaagaaaagaatcaattttactcccccgaactatttcactggagcacttaacccccctaaactatttttcagctcattttacaccccgaactattgaaaacggttcaccttactccctaatagtatctcttttttgtttctcaaagttgtattttgcactgaaatttggtagtgttgttagatgcattacaacttactccctctattccatattaattatcaaataagtttttttcatcaagaccaaggaagtattaactttcttatatttcatttaatgtgactgtggtacgagaaaaaaatcaagaaaca

SEQ ID NO: 43408 - DNA, 775 bp, Oryza sativa
atggatctttaggatagttcttactaggtgtctatccctagtcggtttgcctgtgtggtaagggcaggcaggttttccgctgaacttctattgaccggtcaactgcatatagatgatttagaccaatgtttctagctattcttaagttactttaattcgtgccttcatgtttctgatatcttggctaagataacagtgtgaagctagcaacctcctgagactagccgatcacaagttagagttttgagcaattgagatggtcgtgaaatttagcgatatgagtcaagtcccctgatgtaatacatttggtcgtcaccttcgagtagtttgatgggcatattttaagttgaagttgactgtcgggctattccatcgaagatctcctgtgctcactactcggtgctttgggttttatgttgtgtttggtgtttcgcatgctagatcaacgatgaggttggatggttactactattattatttaggtttaatttaatatcccatccaactaaatatttcatgttgtcatacttagtagcctactcaatatctagcccaggtgtcctgacaagagttgaatccatggaagcctaatggcgatggtattttttagataaattaacttgtgatggcattttgtgggactaacattcgtcgatggcaaaacatggaataaggttaatggcaacacttagaatatctcatgtaacattgccccctgtaaagaagttacttgacactcgactggagaatgacacacacgaaatggacagtcatg

SEQ ID NO: 43409 - DNA, 1501 bp, Oryza sativa
cggttcgcgagctactgttgtgaaacatttatcgtgccaaccacaagtcagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgtttagctcctggtttggagttagatctgtacagccgggtatggttgttcaggatggttgggcctgtgcagcatgggtgtgctgttcagtgttgattaaaatttctgattaattactccactattttacttctcttaaatgttttgctaaatgctgattttgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataaagttcagaaattactagtgaatttccgggcgtgacaagttggtatcagagccatcttgactgtaggataagccaaatggtcaaaccttaaggactaattttccgaaaacataatttgtgaaaattttcctttctttcttatctagaattctttgcaaatcgttttgtcattcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgtttgttgtttgctttgtgtgtaggtatggttgcattcccatcattagagaagttcattgatgagtgtgtgactatactaggttgcttgcttaatcaacttgaacaatataatggtctacacacatcagatcagtgttaacctggttaaggtcttgtctttagtgtaacccctctccttctaccttttctaatc

SEQ ID NO: 43410 - DNA, 478 bp, Oryza sativa
tttcccggcacggtggggggatgcataaaaaaaattcggaatatcaaagtacctcttaaaattaggatctttgtgtggttactactgagaaacaacgtgttaactaaagataattttaagaaaagaggatagaaaaaagggactgaaactttccagttctgtgataaaaaagagacaatacaacatctgtttttttactgccccatgactttacttgaaatgtggtggcttgtgctttcgatttgaaacctgtgagaaatattcaacatacttttggtatatggacaacactgtgacaaagatacaaaacaactccgtcctgttagtgggggtagttgctgtgacgtggtcgatttggaaagcaaggaataaggcgtgctttgaacaaactagaagaacagttaggttaaaagaacaggtgaaaattagaaaagtcaaataagtatttagaaacaaaatctaagaaagcaggcataca

SEQ ID NO: 43411 - DNA, 1501 bp, Oryza sativa
tcctcccacatttggagattccgcccattgcagctgccttgctccacaacccctgtcttattcgcttgccaaggtttctttagtttgttatgaatgtccggtccccagcatctcatcctcatgaacgtcccttgaaactataatgccatctggcatgtgaaactttccatgccttccaagtaagaggaagttaggtggtaaaaataaatgagtggttagtttgtgtcatagtgtgtcttatactcattcaggctgctatgttcaactcattctgtatggtttatgaaaaatccaactcatagtacatcctaatgatatatgttcataaaaaaaataatctctacccctatacagttcaatctccaaaattgtgaatgctgtctgttcaacgaaacagcagatctctgattgttcaatgaaaaagcagcaacggcgatgaggtatccaccactccaccagacacagaagctcgacggcagtagagtgctctgaatcgaggacgccggttccacttccaggtcggcaacgacacagcggaactgatccctctctttccatctccctcacagcggacctgcttcttcgatttgctcatggagaatgtcgacggcgtgctcttggtctgtctgtggcaacaagctccgaatcggggtctacagctggcatggtacggatcgaactcgtcagcgatggtctgctcctggccgagctcgctgacggctgcgttggcggttgtgtgcgatgctctgctctccagtccaagtgcggatctaacatgcgggcccgactgtctgctgcttcacatgtggttgtgtttgcaaccccatgttcccaacccctctccctcattttccacgcgtatgcttttcaaactattaaacggcgtggtttttgcaaaaaaaaatttatacgaaagttgcttaaaaaatcaaattaatctattcttgaaaaataaatagctaatacttaattaatcatgtgttaaaaggctgctccgttttgcgtgcaggaggatgggttcaaatcctgcacttgcgaattaacacacccctacacagcacagtgtgtgaagtgtacccatcccccgacctaaactgcaaatggcactgtgttgctgatgctacggacgaacccaatagatagtagtccagtttacagttgctgaacttgtgatcagacctgagcggttgagcgatcctccccgcagggccacacaaaccacggatggtcgtggtgcatccatgacgctctatcttctccagcgccacatggcttcaccccgtcgcacgacttatctggtccagtcccagtgtcctcccaaatccgcgagcccgggcttggtgcaccccgcagcagctttgcctggcaacgtaaaaacgtactacggaaacttgtacactatcaagctcagcaactgcctgcccctctctttccctcgccattaagttttctcgtccggcggcgtcacccctgcgaattaactaactagctaggccggcca

SEQ ID NO: 43412 - DNA, 946 bp, Oryza sativa
gccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggtcctcgcacctctccccctcggctgacgcaataaaccatttttaaattaaaatttaaatgaagaaattcgtaaatattcatttaaagagcatataaacttcaaatggccatactttggccatttgaactcggaattggaccgttcaagtctctaatttttccttaagaagtcaagaacccatttttgtgctttgttcctgtttgttatatgaagtttattagagtaaaagcctttttcttttccgttggtcgtgtagacgctgcagcttcggaagatccgctcttcgtggaggttgaagccgacgtttgggaaagcgagcaaggcaagtcatatcatctttgaacatattggatcccactttatgaaattattttgatttaaattaatgcattatcgctttatttaaattctcgcgttatcactgttttatttagccatgcctatttacctttgttatgaccttatttttgttattgttattattactttgttcaccctagaataaacaaaaccccaactagtgggcgctctactcatggttcccctagtatgaatttagatagatgcttcgctgattaataagacaacattaggtggtttttataactttagactttgggaatattcatatctcttggactttatggaatggttggactattgtggaattggatgcacacctctccctctattcaaaactctcaaaatggttataggctgggcttggggtgcatggttttgatagtagcacctcggccacataaggaccggt

SEQ ID NO: 43413 - DNA, 706 bp, Oryza sativa
atgcataggtacgggtataatgtttgctattgcaattactctatgtcatgacgatgatattagagtagtatctggtagtttagtcctggtgtctagattactaggtatcattatttggggttatatgctacgaatgagaggtgggtcgttgatggtgacagctcagtatgggtattccttcacgcatatatatagtcctaagttaatttcttagggagggtactcctccgtatttagccccggttgtatggtcatgacgggctgtcgtaaggaactcgacagtcaggggtggcttcttgaagtaccatgagggcatcagaaagagggtattagctagttaattatataactaggatgaatgtataatatgtatactagaagtataggaatagattcttttctattttctttccacttagcttagatagtttaatatgagaatgagtagttctatgcttgtgtgtcatcctaccctttggattatattaatccctacttagactatgattattacaagcaacatataaattattagcacggttctctctactataatcttcctacgggattaaacaaatatgatactcttgcaatactctcgagtgaaatgctacaatggtatatccgtgcgcttacggataaactctgtaaccataatataccaggagtatttctgcgccattgctgggaattatatttctagtaa

SEQ ID NO: 43414 - DNA, 661 bp, Oryza sativa
ctactacctgataagaagaaatgtaagcctccaaatgtaactattaattgctccttttgtgccagcctgatactagatagaccggataacacctcttttttttttagtgagttcagtcagaactgttggacaaagattagttttcattggaacctaaaccaggagatccatgggatggttcaacagcgaaaaaaaaatctcttttggaggttcatattttatggatgtttttcggcttgctgcatggaatatttggaagcaacacaataagtatattttcaataatgtccaacactctataaagttgtagaagcgtgcactaaaggatgacctaagtctatatttaattatgcttagagtagttgatagatcttttattcaatcatggattgagaactttagggcatcagcaatttttaagaccctcttgtatcacaaggtggaaccaagtgggcccattctttatataatagcacttgttgtagtgtatgtgtgacaaaggtgatattgcacctaaataaaaaattcgttccactactcaactaccacatcccttcaatccccttatggtgcttttttattttgcctcaaatcccctctgatccccttccgtgtgagcgaatccaatcactgcaacgatgcttgtgagaggagcaggtga

SEQ ID NO: 43415 - DNA, 289 bp, Oryza sativa
tgagcactcgattaggttatggtcgagtacactccattatcgagaacattctcgacaaatgcgaagttatcgcacccaacctgccaacgaagaccgacgacctatctcatagcaccggccatcgctggactactcgagaaaaggttgttaacggataattcctcgcgaacgccgtcggcttgatcacccgacatgattgcgaacggacatccggatatgctgtaagttgggtatgtgagtcatgctggccacatgatatgcacatgtaataaaccaactttagcgcccc

SEQ ID NO: 43416 - DNA, 359 bp, Oryza sativa
ctggacgtgtgctaaggggggagtgtgttcctggacatttcccaatgtgcatgtgtggctatctgggtaagttgtgtcaacggggcatcaggtccttgggggggtgtatgtaacatcctggcccaattaggatgaggcatgtgtggcccatgagcattgtatacgtatgtttagtaccaccttgctagtttagcaagagtggaactaacttataagggcttgtcccttcaaccatatcactctcgagataacccttttacacgatgtgagaatgaaaagtgtaagtggagtggtatgtataagtgggataggctagctacgcggttttggaaggagggatgtttacacctagggagaga

SEQ ID NO: 43417 - DNA, 336 bp, Oryza sativa
catgcggtcctcctaaggagtcgcatgcgcccgtttaggaggaccgcatgcaaaaataagctccctcctctctagatcttttctgtctcaacactttgaaaattttcatccttatccccctctatctctatctctcaccttctcattcttatccacccacatcctctctctcattcatcatcctctctgcctttctcaactcctctcctctctctcactggtcgacagtgagaggtgagaggcgagtggtgggtggcctgggccctcggtgggcgagagcggtcgagagcggcggtagtgggctcagaagaggtatgtcgtgggcgggagcagcca

SEQ ID NO: 43418 - DNA, 1501 bp, Oryza sativa
ggagctggagctggcgccggagctgcgggaggtgctggaggtggaggtggtggcgggttcctgggcgcaagctgaatgcgcactggagctatggtcgacttccttggcatggtgcggatgcgggctcctcctggcggtgagcatccgtgcagcctggctacctccttcttgaggcgaccgttctcatcctgcaactcagcgatcctcacaagcttctggtcgttgagcctcttggttgccttgtggagcatggcgtgcagcttgtcgtagccctccatcacctcactcatgtggccgaaggtgacgtcgttctctccccaagctgacttgaaggtgctggtgttggagctggaaccgcggcgagggtggaagcggtaggcggtggtgttcagggtgccgtcatgccgctccctcaaatgggccatcatcttgagggaggcctcctcacaagcatgctcaaatgtgcccccacaagctgtcacctccatgttgtgcaggtaggagtgtatgccgtgaatctccaagcggacctgacgtgggaactcgccactaagagggtggatgctggtgtactgcagctcccttggaaaaccaatcacaaacgccatgcgggacaactctgcaacgaagcctcccatagtctgaccttggtgctttaggggacagtcggccatctatagaagacaaaggatggagaatcaatgtatgatcaaatccaattataaaataaacagtaaaggactgaaataaagtaagcgaataagagcagaattttgtgcatagatcatttttgcatgagagcgaataaataagactgacatacattacaataagataatgaggaattagatacgtaataataataacaatgataataagagcataaataacttgcaacccatgttccttagtgaagacctaatgcatacctcccattaaatcccgactgactgtcaaataattctcaaataattttactaaaaccctagactgacctcatttgaacaaatttcaattgaaggagcgatcaagatttttcccatggacccaaggaacaaacccaaatttttcccgaaacaaatacaatttggctcttagggtttctatttggcttgtcctacggccaaggtcggctctgataccaacttgtcacgcccagaaattctcgaatagaattccaagcagaatgtgcattataacccctgtccaggaccggccaaggtacacaaacaacaaagttgacatacagatccacgtcttacaaacataataaaagtcttacataaataaagcggaaaattaaagataactggagctaagccttgacttggattgcagcgggaacaccactccataggcatcctcgacggcacggacgaagcctactcctctgagaaaccaccactaacgcatactcgaactctgagggttgggagatagagcaagactgagtactacccactgtactcaacaagtcataccggaacggagggtatgatgc

SEQ ID NO: 43419 - DNA, 922 bp, Oryza sativa
catgcggtcctcctaaggagtcgcatgcgcccgtttaggaggaccgcatgcaaaaataagctccctcctctctagatcttttctgtctcaacactttgaaaattttcatccttatccccctctatctctatctctcaccttctcattcttatccacccacatcctctctctcattcatcatcctctctgcctttctcaactcctctcctctctctcactggtcgacagtgagaggtgagaggcgagtggtgggtggcctgggccctcggtgggcgagagcggtcgagagcggcggtagtgggctcagaagaggtatgtcgtgggcgggagcagccatgagagggctcgacggccggaggtcgcggatccagcccgggcggatccaccggaggcaggtgatggcgacggtgggatgggaccgagagcggcgggcgggagcggccagcgacgatggcatggatctagcgctgacggcccatccctacgcggatccggcatcaggggccctctctcacgaggatccggcactggcgacgttggagggtggtctgcgaggcggatctggcgcagaggacaaagtgacgtggggtggcaacgacgccgccccacgcggatctggctgacggcggcaggctagggttcggccggcggcggtctattgtccgcctgggtttttttcgaaaattagatttttgcatgtggttggctggccacatgaaaaatccgattttcgtagacttttttgtgcatgtggttgtgcatgtggtcgggatggctgcatgcaaatatcacttttgaccgcttgtaaaaatgatttttttagcagtgcacccttaaggccttaataatgacaaagaatcccggtgacacatcaacttcgattgtaaggctggaaacataagtatactaggtgatgtgacca

SEQ ID NO: 43420 - DNA, 421 bp, Oryza sativa
cacataatgttttaatgtatatctttattatgttttatgatatcatttatacttatatagttcatcctcacttagtagtgcttaaatgattaatttatggtccaaattatctttctcattgtttcctctaattaagtcatatcacatcaattgtttttatcctttagatgattaatctaaggtccaaactatctcccttcatttcttcttccatgaagtcataccaccttactttttacgtttgaatcaccattctacatactatttaaatttaaattattataaaccacattatttacttaatctgatgttatctagctattttacacattatttttttattattatcatactaaattcccacaacaatgcgcggggtttcacctagtgatgaaccctgagttcctctcgacactcaagg

SEQ ID NO: 43421 - DNA, 1501 bp, Oryza sativa
tgtcctggaaaaacttaccatacttaccacaaaccagcatgggcaacggctgggcttgtagtgtagctttcctctagctgacgcatccaggcaagggtgagcgtgatggagttcggatgggccctgcgatagcctgtgcggctttcagattcacctaggcacgaaaggggactgcccgatgccttgcgaggagtgggggtgaaacctgaggtgtggtgtgtttggttagaggaggttatgcgaagggtcctgtcacggcctctttccggtatgttgtggtggcatgccggcgcacggaaacatgtcgtggggctgtgtcttttgggtacagttgtccatctctgatcagagtaaaactattcgaatagccgtgcccgtggttatgggcggtcaaccagattcaccgtgattagtctcaccctagcttagtctaatggaattgattagttcaggtggttggttgggcctgttgcaatgcggtgtagcgttggacaatggatggttaatattgattaattattacaactgttttactattttcaactactgtttataaatgctagctttatgcaaatgatcccctttagccttcctttggttatatattgcatcataccctccgttccggtatgacttgttgagtacagtgggtagtactcagtcttgctctatctcccaaccctcagagttcgagtatgcgttagtggtggtttctcagaggagtaggcttcgtccgtgccgtcgaggatgcctatggagtggtgttcccgctgcaatccaagtcaaggcttagctccagttatctttaattttccgctttatttatgtaagacttttattatgtttgtaagacgtggatctgtatgtcaactttgttgtttgtgtaccttggccggtcctggacaggggttataatgcacattctgcttggaattctattcgagaatttctgggcgtgacaagttggtatcagagccgaccttggccgtaggacaagccaaatagaaaccctaagagccaaattgtatttgtttcgggaaaaatttgggtttgttccttgggtccatgggaaaaatcttgatcgctccttcaattgaaatttgttcaaatgaggtcagtctagggttttagtaaaattatttgagaattatttgacagtcagtcgggatttaatgggaggtatgcattaggtcttcactaaggaacatgggttgcaagttatttatgctcttattatcattgttattattattacgtatctaattcctcattatcttattgtaatgtatgtcagtcttatttattcgctctcatgcaaaaatgatctatgcacaaaattctgctcttattcgcttactttatttcagtcctttactgtttattttataattggatttgatcatacattgattctccatcctttgtcttctatagatggccgactgtcccctaaagcaccaaggtcagactatgggaggcttcgttgcagagttgtcccgca

SEQ ID NO: 43422 - DNA, 186 bp, Oryza sativa
acatcaatgctgtatttattgtgtttagtttcattttgtatgtcaagtaagtgcacaagagcctttaggatttattgttcatacagaacacatggcagtatggcactgggttttaatataatgttcactgtatttgtactagtactgtatgacaatgtcttgatgcacaatgatttttcagtgatt

SEQ ID NO: 43423 - DNA, 226 bp, Oryza sativa
tgcggctttttttttctttttttttgcacctttctgcctttttttttcactttttttttgattttttttaacaaaaactgactcaaggcccttaatgtaagattacagggactcaaacataaatataaaatttacagggactcaaatgtaaaagtctaaacccaaaattaaaattatacaaaaaatggaatgctgaatttatgccggttccgtttttccaaacaga

SEQ ID NO: 43424 - DNA, 1501 bp, Oryza sativa
ccagaagaggagttccttgaagatgaaggctttggtgtctagctcgtgcctgccgtcaagcgcctgtggttgtcaccctagtcttccgctgtttctcgtttgtctttgtgtgccgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagcccccttgaccctaggacgagccttagatcccaagccttagcagtattttcgaaataaaaatctcttgtatttgtgaaaatcctctagtctctctctgtcttgctgcttcatttatcgcccaaaatctgatctctaaaatgttgtttttctttttgttttgtttgtagatggccggcagcgtcacccgtcgtggtttggacatgactggcttcgtcttggagctgcgaggcatgtgcgtggtcttggggtatccacatggagtggattaccaggccaggccactcccggagcaggagggtgaggatgcagagccccacgctggttgggaggtcactgcagtgatcctctccggctctcccgagcggacctcgctggcagtcaccgcgggtggagattccttccccgccgcttgtcagaacgccgctctcctcgccatcggcactcttcaccagcactacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgatttccatcagatggtgcgccgcgggatggtcgagaacaacatgaagatcctggagctgcgtcaggagaacctgcagctcaagaaggacctagatgcggtggaggcgcagctgcatcagctcaagatcgctcagggagaggactgccgtcccaagcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaaacctccggcgttggtagcacggaggatgcgctgttgctcaccttccgccctggcccgtcgcagcggtagacgagcagttagtaggcttgcgtgtgtgttctttctcgtttgtcttcttgttggagtcgtgtggggcatggttatgccggttgtggtataactgtgtcggagcctgtctttattttatttgcctaagcaacttgaactttaatgaactcatttaatatcagtaataaattcaagaattatagtagtcgtgggtggttagttttaattgttagctctctctgtttgctggttctgtgtggggttttcagatgg

SEQ ID NO: 43425 - DNA, 1501 bp, Oryza sativa
aaaggacccacataccgaggtgcgagcttcccctttgtctgaaacctatgtacacctcgcaatggcgtgacccgaagatatacaaaatcacccactgcgaattccaggtcacggcgacggttatccgcataacttttctgccgggactgtgccacctttagattatcccgaatgattctgactttagcttcagcttctctcaggatatcagtcccgaacacttgactttccccaacttggtcccacaatagcggtgtccggcatttgcgcccgtacaacgcttcatagggtgccatttgtatgctggcttgatagctgttattgtaggagaactcggcataggggagactcttatcccaagtcttcccgaaatctaggacacatgcgcgaagcatatcttcgaggatctgatttagacgctcggtctgtccatctgtctgcgggtgatacgcggtgctgaaattcagccgggttcccaactccatgcctgcagtttgactctagaaatccccggtgaattggcttcccctgtcagacacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatcttcgtactgcccgggtgaatggaatagggactttcgtgagcttcctagagtatcagctgtttaagttctctgttatctgggacgcatacccgatttccgttccataaggttccgtgttcatcttctgtgaaaccagcagctttaccctgtttcatattcttgaggagtccatgcatgtccggatcattcttctgagcctcgcggatttgatcgagcaaggtgggcttggcttccaacgcagctaagaatccacgacccactatgcttaggttcagggcttccatctgttgattaagttcgggtggaatgcctcgggcgttaagagtgttgcaatggcttttccggcttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccaccgctgctaactccaaatcatgggtagggtagttgccttcatggggccgtagctggcgtgaggcat

SEQ ID NO: 43426 - DNA, 205 bp, Oryza sativa
ttaggaaatatacaaaaattctccaagccttatttgacttttaaatttgcacattttaattgttggaggctttcacatgaattttaattattctcggcataattttgaggatgtattttagagtcgttttgggacgcgacaatggccgaccacagtgcaagttataagagaggttgacgctagtggtaggcccacggcgcccagg

SEQ ID NO: 43427 - DNA, 1501 bp, Oryza sativa
tgaagttgtttcccctttctttgtcaaactttgcatctacatggtatagtttatttgctcctaattcaatttctacatggtcacaaatgaagcatgagtttcataattatttcaaagatgcaagcttgatggagcaaagaccgattgatgattcatcggtcacttgtgaaactattccggttacacctatgcctaagaccagaattgttagtaatcctctccctattagtcctattgattctgacaacaaagaagtgttgattcggcctagtcaagccgaatccacgaaagggaaaaatgttattattagggatcctcggcccgagacaattaggatcaatgatgctaaggccaaagattgtagagttacaaaagataaatcatctagttcccaaaagactaaaaagccgaagctcacttttgagatgcttatggctaagtacgagaaaggattagcgagtcaacgatttcataatcaaattagtgattcaaaaagaccaagatcatctcgcaggaagagatttggtcaatcaccaaagcaatcgaagccatcaattataccaactccatacaaacttccggttgtgatgccatcgtatccatatccaatctcactatatggttatccttttatgtattacatgccgtggatgcatcaaccacctatgcagtattatcaagagtggaaggaatcacctaggtcagtaccaactaattcatctaattcaagacaagaccgtttctcacaaaagaatcggtccggtggatcaaaggtgaaaaaagggaagaaggtatgggtgaggaaagaagccaaagctccggaggtcgtttctatcaaggaagagtttcaagatgttgaagtacgtactggagatgcggtggaaaccatacaagcaaaggagattgaagccaacaccgtgattgtcaaaagcggaggtctgaccgaggcgtctggccggtctgaccgccaacctatggtcagtctggccgaccctactggccggtctgaccgggcctagaggccggtctgactggggggcattggagaagagtgggaaaattgagagcaacacaggagctcccacttcgattaaaaatatcaagaatcatcatttgactcttggaagacaaccacagccgaagtggataccttccggattatctcgctctcaaaagaggaggctacagtgtcttcgagccatagttcaaaaagaaaaggaggccatagatgtagagaacaaaacatgtaacaatttagagcctcgaaagacacttaagtgagtatggagacctaaagaagtaaaagttaaaagaccggtgatttcccatagtagtgataaatccaatttcatgagagaagaatcatcgatcattagagataagtctccttcacatgatgctatgggtctaagtgcggtatccatcttgccttcgaaatcacgcaatctagaaagccgattttgcttggggggtaagacattaatatgctcatgaagaaatc

SEQ ID NO: 43428 - DNA, 1194 bp, Oryza sativa
tcacgtgaggcaacggcttccaaaactatagtaggaaccccctctttccctttatattggccttgccatgcagtcgggcagttcttccactgccaatgcatacaatctaaagaacccaacattcctgggaaccttctttcttccccctgagcaagtaatctagctatgtcgttttcgtttggtgttctcatatactcctctccaaaaacttcatcaacagccaccacaaaccttttaaaactctcaataacggtactacctccaatatgaacatactcatcaactgcatctgctgctattccataacataacatatgtgacactgctgttaccttttgcaaacatgacagtccaaggataccagccgctgatgttaccttttgcaaacatgacagtccaaggataccagccgcatttctcttctgcacaaaatattcatcatgtgcttcaatagcattcattatgcgtaaaaagagaggtcgcctcattctaaacctgcatagtaattaataataataattctcatatgtatcaattttgcaaacaaagattgacaaaacaaaaagcactgctacaaacctgcgtctaaactgaacatcgaggtacgtaggttcttcggaaaaataatcattatacaatcttgaccagccaatctttcccgattaattactgcatgacctaagacagatccaccacgctttggaacttcatcgtcatcgaactcaccgtgcatgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccacaggcagctcaactggggtataagccaaacgtcttctccttcgcaacttgtcttcaactgaggttgattgattattgcaagaatgagcatatgacatactcaacaagccacacagcaaatatgcaaatgcacaaggataccaaaggatggcacaatatagtctcatttgcgaaagcagcatttagcaaagagttaagagtagtaaaacagtagagtaattaatcagaaattttaatcaacactgaacagcacacccatgctgcacagg

SEQ ID NO: 43429 - DNA, 1079 bp, Oryza sativa
tggttggcctggttggctgggacgagctggcccagggtcgggttgccagttcggtctgaatcatcgtaggcctgggttaaggcaggttcgtgtgggttcatggccttgattaataatattgtatagctctaggaccgtgtttacaaaatagctttgagcaactaagtgacttttaatgctgtttactgcaaaccctaaccctttatattataactcccttgtactcccttgcatttattctgcacttgtgggtgtgtcttgttgagtacggtggttgtactcagtcttgctcaatttttcccaaactcagaagaggagttcctggaagatgaaggctttggtgtctagctcgtgcctgccgtcaagcgcctgtggtcgtcgccctagtcttccgctgtttcccgtttgtctttgtgtgtgctgggccttcgccgtccatgtaataaattagctatttacgcttccgcttgttaaactctgaactgtatcaacttttggtgtaccttgcctcctgggacaaggaataatgcacgcacgtaaggaacgcccgttaggttatttccggtcgtgacaatcatatatcttaacaccataacttttaaagccgatgcaatttgattcactcgatggttttggaggacggtttcactgacgtggcaattatatcacggtgacctggtcttcgttccacctagtattgatggagtgcttttgtagcattagaattaaaaaatatatttgggacaagcatgcctccgaaactccatccgcttgtgtacctacacgggtatgcaggtgattaagtttttgagagcgtcttccggtgcgactgctctgcgacacatctgcttcctctgcatcgacaacggttctgcactgctacatctgcttccactacaccatgttgacttgaggacgcgtcaacagaggacgtaccggcagcgggattagaagtgagaacgaccacaccaacggagacaacaacaccgaaaaagcctcatccagcactggagtgttctccgagtatggttcaaactataaaagatggaaagcacgtgcactactgtggttgacggcta

SEQ ID NO: 43430 - DNA, 680 bp, Oryza sativa
tcacgtgaggcaacggcttccaaaactatagtaggaaccccctctttccctttatattggccttgccatgcagtcgggcagttcttccactgccaatgcatacaatctaaagaacccaacattcctgggaaccttctttcttccccctgagcaagtaatctagctatgtcgttttcgtttggtgttctcatatactcctctccaaaaacttcatcaacagccaccacaaaccttttaaaactctcaataacggtactacctccaatatgaacatactcatcaactgcatctgctgctattccataacataacatatgtgacactgctgttaccttttgcaaacatgacagtccaaggataccagccgctgatgttaccttttgcaaacatgacagtccaaggataccagccgcatttctcttctgcacaaaatattcatcatgtgcttcaatagcattcattatgcgtaaaaagagaggtcgcctcattctaaacctgcatagtaattaataataataattctcatatgtatcaattttgcaaacaaagattgacaaaacaaaaagcactgctacaaacctgcgtctaaactgaacatcgaggtacgtaggttcttcggaaaaataatcattatacaatcttgaccagccaatctttcccgattaattactgcatgacct

SEQ ID NO: 43431 - DNA, 1501 bp, Oryza sativa
ctcgcgttcaaacgggcggatttgcccccgcaaatctcgccggcgccattgatggcggccggacctcccgcgccggtttcctcccttccccggccaccctctctcgacccggctctatttaaaccctccccgctcctcctccgtcagtttccgcctctcgccgccctctctccttgccggaatcgagctcgcgccgtcgctctctctccgccgtcgccgccgagctccggtccgccgccgttgtcgccccggaccacctcccacctcggcgccgcctgctttggcttcgccgcatcctcgccgacctcgtccacctctccgttttggtcgccgaccgccggagcgccgtcgaccccgtccacccgagccgcgccgccgccttcctccgctccggtcgccgttcccgtcgtcgccgtcgacccggggtgagccgtggaccgccgattcgtttcccccttccctcccctctctcggccgccgctccgccgtacctatggccgccgccggcgaccataggggcgtgggcgcgccgcctcccgtcggctgtccggcgtggccgccttcgggcgcgccccgcggctgccgtgtggggcccggctgtcagccgcccgcgcccttaggtgcggctgacgcgtgggactcacggcgccggccggtgcgagcccgggtgcgcccggtccaccgtggaccgtgaggctgccgcgtgggccccactcccgtggacccggtccgcgcgcccctcccctcggctgacgcaataaatccattttaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatcagctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatacttcgctggttaattaggcaacattaggtggttttacaactctagaccttggggatattctcatcacctggacactatggaattgttggattattgtggaattggattcacacctccccctctattcaaaatcctaaaaatggttttaggctggactcggggtgcatggttttgatagtagcacctcggccatataaggaccggt

SEQ ID NO: 43432 - DNA, 1260 bp, Oryza sativa
ctacccaagtatgaaaagagggagttccttcgtcaattccccatccccatccaccaaaattcccatgtctcccaaccaaacaaaacacttagagcatgcccaacagccacccaatatttgattcccaaaaaatatgaattaggaattccaaagtaaaaattgggcccaataatcaccctctcctccaagagaggcccaaaaattaattccctattatttgttagttttccacataagcaaggtgggcctagttcggtaccgatcgatcgtctccctccccgcaattgcgccgagtcttctccctccccgcaccagcgccgtgagtcttctccctcagcgtaccaacgccgccatctgagtcatcaccagccaaccactgactgctgcggtttctacaaaaacggaatactgaggatatgccgtagctattcgtgtaatcaaggaggtaatccctagcaaatcttattgatctcttgtgccctagtcaatctctatgtgtttattttgatatgtgaagatttactgtatggaaaatattaagtttgatctgataattaattttgtagattgattattgttctattcctgccatcggttcccctacatcgcacttcatccctacggtaataaacactccaaccccgtgccaaaaaaaggagatgagtcgtcgaagcaccctcctccaaatgctattggatgaggagtctttatcggatggcgaagaagaatttattttttcggcagttgatatagtgcactgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagcacaattcctaattttaatcatacaaagagcatttcagtaattaaccacatattaaattaatcattaaatggtctaattataattttgttaagtactttgagtgtccaagtattttcaggatttttcttgaaattatttgagcattggaagtatttttaacaattcaaagatcatttaagtgattattttaattgggaaagtaataaaattctcctcccttgtcttaggctgaatcggcccattcctttccttcctctctcttccgccggcccaacctgagccgcctcctctcctctca

SEQ ID NO: 43433 - DNA, 1501 bp, Oryza sativa
ttatccattaaaaatatatctgttaaaatttactcatttcgaaatattatagcgataaataacaccgttaaattaagttattcaaaatatatcccttcaaatacaaatgtaaagttagttggaagatattataaaatatagaagaatgtgatatggaggatgcaatttggatgatctgctggagtgagaagagatatggaagatgaatctttttggatgaccatccatataggaatatgcaggatcgaatttggatgagttgctggagacgctccgagttcctgagaatcccgacggcatcgacgcgcgcgatcacgccgaaccgccgctcacgtcctgacgcgaagtcgcgaacgcaagatcgcggccgctggcagtagcaccgtcgcaacacctcagccatctcgtccaaggccgccgtccgctggccgtttccgcgcacttccgcttccgccgcgcgacgcccatgcgaggcgccagagacgcagccgccgagccgcgcaggtttcttgccgttgccgtgttctacacttcttctcatgcctcattgatgtcttgctgttgctaatttgctgaggttgtgtttagtttgtgtgccaaaattttttttaagtatacggatacatatttgaagtatcaaacgtaaactaataacaaaacaaattacagattccacctgaaaattgtgagacgaatctattaagcctaattaatctatcattagcaaatgtctactgtagcaccacattgttaaatcatagcgtaattaggctcaaaagattcgtctcgcaatttacatacaaactgtgcaattgatttttttcgtccatatttagtgtttcatgtatgtgtccaaatatttaatgtgatgaaaaagttaaaagtttaaagaaaaaagtttaaatctaagcacggcctaaatcactgcgacgatcactgattcactttactggtctagtgagcagcaacaacaccattgccatatgaaaaattgtaactatgattccatgtgtaaattgtaatctgttatttgttgcctgttgctaattcaattggacgagtgttggatgaaccaacaatggcagtgtgtgtcccgacgcacttgcggactggtcgtgcgctgcgcactcggatacttgcaatcaactacttggtaagatatactaaatctagatttgtaattttctagcatactttatacgagttaaaacactgtagttatgttaattttttcaatcattaggccatattgtcgataaagtatgcatcggatagcgagaaaaggggaaaaacgaaaaagagtggatggtttaataaaagcctagaaaggagcattggacaaatttttaagaggtaacacgtgaacgtcaagcaaatataattttaaggtaatatgtacaatgttttctataaaaattctatttctgaatgcaatttaaacgtttatggcaataactcatatatatacgttaacaacctctacatttagtttcgcatcggg

SEQ ID NO: 43434 - DNA, 1501 bp, Oryza sativa
caagttgctaaattcatctaaaatcatgatctacatgttaaaaatatccatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacaaatcctatacacaatcctttgagcatgttgatcttatatttaaattctctatttatttcaactgtgcatttatttttgaatgtcactgggtggtgtgaatctattcttttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacagctttaccttttgtatagcatggttcattgcagagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttaaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttagagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattgtgccatcctttggtatccttgtgcatttgcatatttgctgtgtggcttgttgagtatgtcatatgctcattcttgcaataatcaatcaacctcagttgaagacaagttgcgaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgt

SEQ ID NO: 43435 - DNA, 1501 bp, Oryza sativa
tctaaactgacagcccgcccgggagcggcagattgaggacgagagcgcaaaacacggaggacgattaaacgccgttcgcagcacaagtcaacttacaagtggcatgtctatagccagaaggacccaaattatgtggatgcgtaatcagtacagggacgtgcacaaaccaagcgtgcaagtttgaggacctatagtttaatacacgcagataaaaaagaacaacttttttactacaactacctattaagaaaggtagagattcaaaagaacagcgaaacagtcaatctaattcttacaaacgcacagcctccacttaagccatctgcactgttagctagagaacgaagaatagttcatcggggatggtaaaaaattttgccacagaaatatcttgggggaatgttgctactcgtctgtttgctgcaatgacaagtcgctcaagtctgccactagatcatcgacggctatctggctcaatgtcttggctgttccactgggaggtcgaaattcagactcctgaggattgtccttgaggagtttcttcagatccttgatgagttcaagctcatcctcatcagaaaacggaacgtccagatcccacaccttaaagatagtctctcttgactctgtctgctcaagaacttcagacgaagacaactcatcgccatcttcaggtctggctgtgtatccatccatttgcttaccatgttcatttgtgcccctaattacattagcaacttccgaagcttcagtagtaccagtgtcataatcattattttctttttgctccatttgcatgtcatcatgctgagaaacaatttcagcagggagagagtgaggtttgacctctaaaattgcatgggaaccttcttcgtgcacaatttcagaagtattgttgggtatttctgttggcttttcaagagcattaagcagggcatgcttcattgctccccagtcactatccgaaagctcagatgtctgcacaaaacaagaatcagcccaagcagcctcctccggtgaaggtttgaatgccttctcacttgatttaattgattccaaaattgcagggacgacgtcatcgaattcagatgcctcaggctgctcttcaggaatacttggttcagagagcagagctgaaatgtctccgtcttcagaagtcatggttatgcatgtgactgattagcaccttggtaaagatgctgcctttaatacctgtagatatgaatggatgggaaaaactgtatcacccaaatagaggtaacatccaggtaatcagttacgaatataaagactatctttaagaactataagctacaagagatgctatcattttccctcaagagaaaacaagagatgctatcacatttactatctagtacagatacaaaagaggaaagtaatgagctaagtagtaatacaacaaatagcttttcagcaaagggcatccaacatagggatggaagtcttgccctggataaaaaccctaattgatggaggtggt

SEQ ID NO: 43436 - DNA, 1501 bp, Oryza sativa
ttacataaattgctttaaaaaataggataaatccatttttcaagtttaaaataattaaaactcaattaatcatgcactaacgacttgtcttattttgcgtacccgcacttaatcttgatttgtcttagctttaaacaaggccgaagttgtgctcattacttcacttgtgaaatttaacactttagcccttttataaaacttgtttcacaaatagaccataaaaacactaaagagaaatggaccttaacttcagccacgaatcttggcgttgaggtctaacgtcttagcgccaagggttgtggcgcctcatcgagctgacatctgatggcgcaatgatgacaaccattgccaccacatctagcccgatgcctagtggtattaggaggagaagagaaaagagtgtagagtggcagtactgctcaattaatcaacaagggggaagataacattcgctgagagggtgggctccaacaacaagggggcaaattaatcaattttaagagttgagacatgttcaatacccaattttagagttgagggttgtttctaaacacagtagttaggggtcaagtagatttatcccttttgtatattaagctatatgtggacttttaaaagccttaaactatatctgttatgaattcttatattttttaaacatgattacaaatgaaattcaataaggtactccatttggtcattaatatattaccttttaacactaattttagtgtaaaaatgtatatattaataactggagggaattctatataacaagagcaggtgcaatagatgcttcaagccggcgatagctgtcctccgtggcttaaaaaactaagttgaaagcaaaagttgaagagagagagagagattcagctagcgactaggtggtgtttggatatagggactaaatccctgtcacatcagatgtttggacactaattagaagtattaaacgtaaactaataataaaactaattgcataaatgagagctaaccacgagacaaattttttaagcctaattaatacataattagcacatgtttactgtagtatcacataaactaattatggattaattagacttaatagattcatctcgcgaattagtccaggtttgtgaaattggttttgtcattagtctatatttaatacttctaattagtgtcaaatatccgatgtgacagggactaaaattttagtccctgatccaaacagccctagctagcaaatagatgagcagttggccttgctatatgcaaatgaagaacatgcaatgcaataaataaaatggaaagtaatattcagaaatcactgcagctttttattgtatcatgtgtctagctatggctctaggtgacatgaaattttttggagccattaactggctatacagctatactattgacctactattgaccttgctctaatagattcatattattctattaacccacggattgtttgttaatgctcgacaggtatgcagtactgctggtt

SEQ ID NO: 43437 - DNA, 1277 bp, Oryza sativa
atctcataatgatattaatgtccttcaaaggtcaccatggtttgcaaagctagctgaagggcaggctcctaaagttaatttcagtatcaatgggcatgactacactatggggtactatcttgcatatggtatttatccttcatgggcaacacttgtgaagagcattaagctgccacaaggcaataagagaaaatattttaccaaagcacaagaagccaataggaaggacgttgaacaagtgtttggagtgcttcaagctcgctttgctattgtccgtggaccagctcgtttttggaaagcaattactctgaattagataatgagagcttgtataatcatgaataacatgattgtggaggatgagcacgatggtgattttgatttagtttatgatgagatgggagaacaggtgggtggttcccaagaacatacgcccaactttaatgattttattagtcagtacgaaaaaattcaagacaaggaagttcacaaccaactaagagaagacctcatcgaacatttgtggaatcatcatgcagatcaatattaagtttagattttatattattgaataatgtcagagattgtaataattagatattcaccgtgtgttttgtaattagtacaatacattgaggccatgaattttctgcatatttcttttgttttcaaatattcacaggcatatttcagaatcattacgcactgatgtttttgtttatttatttgcaaaagacagcagcatcaagcttaattatgtggaatgtgaatagcacttgttgtaattttttagcacctgtaatcaggagcagcatcagagaaagcagagacagacaaagaaggtcccatggtctgaaactctgaactttaatctgaaacactcattaagaggctacctagcatccattttattaaggaagtctgataatgtatatgttttttaaggttagaggagtttattagcacagtgatgttaacatcttattttaattgcagaaaatttattagtgagaataggtgtggagattatgggtaccccatacccacacggcatggttatccgactagtcaaaggggatagcttatatatatggaatatgtaacagattatgacttgggtattacgtttccttgtatattacggaacggcctaaagtcctggtttgataagattataaagtagagttagaaaaccgataccgtattggataaggtttctatcttgtaatcctgccccccatcctatataaggtgggcaggaggccctctagggggca

SEQ ID NO: 43438 - DNA, 184 bp, Oryza sativa
tgctgacgcagtctcctcctcctccgccgccgccgccgccgtcgtcaccgcggactccgccccaggctccgccgcagggtttggtcccctccgctccttggccctctcgcgcggggttttttttttttgagcgagaatgtgatttgatcagggtttgctccgtgggggtgtggatttcgcagga

SEQ ID NO: 43439 - DNA, 311 bp, Oryza sativa
tgtctgactgtattttagtatggcattaagaaagtgatttactttgcttgctgtttgtgctatctgcctgtgtgatactgtcatgctcaggtctgttagatccgaattttgtttggtgctgtataccatggtaggtgtggcttgtagactgacatgtgcactatgttatatctgtatgttcacatgtttgctactttcattcatcatttgcctctagtgacctttttagtcgcccatcaccattgaatttcatgactattttgttggcagttgtttcagatggtaacgagattggtgcaccttcagaaagt

SEQ ID NO: 43440 - DNA, 1501 bp, Oryza sativa
agcttttcatcaatcacatctgccaattatctctgctgcggtgattctcgcaacaattggcaaatcatcggatcctgcaacaacggcgatccacgtcatttaatcagatttcgcaacaacgacaaccctcatcgttagcccatgctcacaggattcgcgaaagtccttaagcccgcaggataaagccattaaaaaagaactaataagccagcctgtcccatttcaggtcatgtggtcgacacgatcgctaggacgcttgaatgctatataatagttattgtaaaaagtcacaccgtttattaagttaaaaacgtgcacgtcaaaaataaaataggtgaagttggaaaagtagccttttgttcagaggagggggttggaaatgttagattaatgggctaggcccaattaaatcctaataaattccattagcccacattaagtgctatgggtaataataccaccttggaaatcgggtgaagaggtctcaacttaaatacggagttagtggagagtctctgttgaccagttgagatggtgcgcggacagccaggcggggcgagacgaggcgagacagacagctgctgctgctgcgctctctcgttttgtaatggacagtaataaacacagagaattgatttcgtatcaatgaacgcgtcgttacggaattaaacaccatgaattgattccgtcggttacggaattaaatgccatgaattgattccgtattaacgagcgcgtcggtttcgaaattaaacaccgcggttgatgactccgagcgttactctcgcgctcgcatattatatactccgcagcgaccagaaggactggagaagttcttcccgatctctcttgcacttcgagttcctcctcctctgttcctgagctgcaaaatccttccccggttctgttcacctgcgcgcacaggtgtacgggatgagcaggtgcctctgaaactccgtccgcttgagaacctgcacgggtagacggacgatcaagattttgggtagcgcttcaagcgcgactgctcttgctcttcacggctactgcagctgcatcgtcaccttcaccaagatgtcgacggagattggagacaagatgatgaacgacatcaacggaggcagtgctgcctcaaaatccagcggtgggacgttctcggggtatactttcattctcccgattctattagatgtttctttgttaatactcttcgcaatggcatcattgtgttaatatgtaaatgttgatgcttattttatattaagcatactcaagttgtatacatctagcactgtcactagatctactcatattgcaaatgtcatgtttattgtcttactattttggattaaaatatgctgaattatgaccaaatttccaacaatccaaaaacttaataggtctttttcggtagttggctttgctgcatcactaaaaccacatgctttcgatggttcaaattataaaagatggaaagcacatgcacttttgtggttgacggcga

SEQ ID NO: 43441 - DNA, 1501 bp, Oryza sativa
cggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaaaatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataagaagaggggaagaacgaccatagggtcgtgctccaaccctaggacgcgcccctaatgggcccaacttggatacacagcccattgggccaaaagaggtgacgcagcaccattgacagaaaatagtcgggagtaaaatgacaattgcggccgctcgagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaacagtgcattcattggacaataggtaatgccttaaccttgtacatgaaaaatataagcacaagcacaacttctcaataggggaatatctagtttctgcatccaagagccaacgacttagataaaatacaactctttctttcccttcaagctcctgaatcaagactgagccgattgattgacttctcaccggccgacagatataaccgaaaaggtatccccttctgtggaggaatcaaaactggaggagagctaagatattccttaatattgtccaatgctttctgttgctctacccccccaagtaaactgctgatcggctttcaatcttagcaatggtgtaaaaggctctaaccggctagacaaattagaaataaacctcctaacaaaatttatcttgccgatcaactcttgcaattctgtcttgttctccggaggttgaatcttcttaatcgcattaacactcctttgaatcacatcgatccccctctcatgaacaagaaatcccaaaaactagccagccgatacgccaaaagcacattttgtcgggttcatctttaggccatatttcctggtactctcaaaaaccttcctcaaatcggctatgcggttctggtatttgcatagtatggggatcgtcggtgctaggatatacacgagactgaggtaaaagaga

SEQ ID NO: 43442 - DNA, 1501 bp, Oryza sativa
ctctccctcggattcgtttggaaactctcccgcaaacttcgccggcgcatcaatggcggccggatcttccgcggccgattccccctcatccggccgttctctccccctcccaacactatataaacgctccccgtgcctccctccaccgtttccgccactcgccgctctttctccccgtcggaatcgagctcgcgccgtcgttccctctctccgccgtcgccgccgagctccggtccgccgccgtcgtcgcctcggactttctcccgcctcggcgtcgcctccttcggctccgccgcgacctcgccgacctcgtccacccctccgtttcgcccgccgaccgccggaacgccgccgtccccgtcgacccgagccgcgccgccgcctctctccgcttcggtcgccgtttccgttgtcgccgtcgacccggggtgagccgtggaccgccgtttcgcttcccccttccctcccctctctcgggcgccgctccgccgcgccggtggtcgccggcggcgaccatcggggcgcgggcgcgtcgcctcccgtcggctgtgccggcgaggccgccttcgggcgcgccccgcggctgccatgtggggcccggccgtcagccgcccgcgcccgcgggtacggctgacacgtgggacccacggcgccgcccggcgtaagccgcgtgcacccggtccaccgtggaccgtgaggctgccgcgtgggccccactcccgtggacccggtccgcgcgcccctcccctcggctaacgcaataaatccgattttaaatcaaaatttaaatgaagaaattcgtaaatatccatttaaagagcatataagcttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaagttgaagccggcgtttgggaaagcgagaaaggcaagtcacatcatctttgaacatattgaatcccagtttgtaaaattatattgatttaacttattgcattatcgctttatttaaattcccgcgttatcactgttttatttagccatgcctatttacctttgttatgaccttattattgttattgttgttattaccttgttcaccctagaataaacaaaaccccaactagtggacactctactcatggtatcactagtatgattttaggtggatgcttcgcttttaattaggtaaccttaggcgattttacaactctagactttgggaatattcatatcacctggacactatggaatggtttggttattgtggaattggcttcacaccgctccttctattcaaaatccccaaaatggttttaggctgggctcggggtgcatggttttgatagtagcacctcggccatataaggaccggt

SEQ ID NO: 43443 - DNA, 1501 bp, Oryza sativa
ctagatatggttatggtgcatcaattaatttattcacataggtggtcaagggcatacttagagggtctcctctaagggttcatatgttaaatcaatgcctgtccaattcattggcctcccagtttagtttccatactccttggctgtattagtttcctgatctcgcacttcaccgtggtgcttactgaaaataagcaaactgtttgtcttgcagttgtctgttctgattgactgaaatttttcgtttttcagggctgaacctttttcttaagtaatagcaaactttatttgatctgaaatacatgtacatgctttttagccctagagatcctagaaaactttttattgttagcatggatccctgattttatttactgagagcattctaattactaaaacactgagaatcacctcactactctaaatactttatgcttagatgatatgttggtgttcttctcacacagccttgtagtgttacaatatacagtttctaaatcctggctccaccatttttttattattattaacttcgattgggaatgcttcactaaatgttgggctggaaacactgtttttgtgtgtgtgacatttgccagcaggattattccctctccctcatcctaattacatttgtgccgtccctgctgttgggttgttgggtcccccttggacctccaacagcagtatgaacacaggtacacaacatgtcaagcttaatttgcaggcaaagtggacatgagcgagggctttctgtcaatgtgttcacaaatgtgcctactccctccggttcccgtttagttgatgtttgaggcttggactattttggatggaaaatcttgacgttttagccatgtgatcaatttagactgatttgcccctgcttggctgcatgcatgcaaatcacatttaacttggtgcatctgagtccttcacagcaccataaaaatcatgaggataaaatcaatttgccgaatcatctcctacagcatagtaaaaatcgtgtggaaaagtagggtgccaagattcaaacttagcacatgaagctttgggactagcagtcataaccaccaggttaagaggatttgcttgttggatgtgctattctaatgtgaacttattaatcattccttggtatgtgagctcctgtccaaaacgtcaataactttgaaaccggagcgagtactgcctaggggcacaaagccaattattataaccacctccatcaattagggtttttatccagggcaagacttccatccctatgttggatgccctttgctgaaaagctatttgttgtattactacttagctcattactttcctcttttgtatctgtactagatagtaaatgtgatagcatctcttgttttctcttgagggaaaatgatagcatctcttgtagcttatagttcttaaagatagtctttatattcgtaactgattacctggatgttacctctatttgggtgatacagtttttcccatccattcatatcta

SEQ ID NO: 43444 - DNA, 1501 bp, Oryza sativa
taatcggtttaaagttccagacttttccaaattctcaggacaggatagcacatcaacttatgaacacattagccgatttttagcttagtgtggtgaagcatcggctgtggatgcctcgagggttaggttgttccggttgtctttgtctggatcagctttcacttggttttcttctttgccatatgggtcgattaacagttgggccgatttggagaagcattttcacagctctttctacagtggggtacatgagatgaaattgtctgatttaacaacaatcaagcaaagacatgatgagcctgtgcatgagtatattcagagattcagagagatgaggaataagtgctatagcttgagtttgactgatgctcagttagcgatttggcttttcagggtatgattgctccgatcagggagaaattctcatctgaagagtttgatagcttgtcgcatcttacgtagaaagtaaccctgcatgaacagaggtttgcaaaggctaggaagaactctagaaaggttaatcatgtttgtccttacatatatggatcggatgatgatgacgatgatgactccgaaatagcggcggccgaatgggtaagaagcaaaaaggttataccgtgccaatgggtgaagaattctggaaaagaggagaggtatgactttgatattaccaaggctgacaagattttggatttactactctgagagaagcagattcaacttcctgctggtcatacaattccatcggctgaagaattgggcaagaagaggtattgcaagtggcataattctaggtctcatactactaatgattgcaaaatcttcaggcagcagatccaagcagctattgatgggggcaaaatcaagtttgatgattctaagaggccgatgaaggttgatggtaatccttttcctgtcaatacggtgcatacagctggccgaacagccaatggaggacgtgcaaaaggttttcaggtgaattcagcttagattatcaataagtatcagaagaaatatgacaggcagcaggaaaagcgttacgaagaagatgatgatggctttgatcctcattggggttgtgagttctttagattttgttggaatgagggtatgaggctgctgtctattgaagactgtcctgggtgcagcaatgttgcagaaagttcaagccgatcgtataacagaggcaatcggctagggcaagcaagagttcctgttcatcaaaggttgggcccggtgaaccaaggttgtaaccaagaagacaatgaagataggaagactcaatggtgtccttctggtatatttacaaagaatcagaaaagaagggttcaaagattgaggaacagggagcgttttcaggaggtcgaacaagaaatcaatcatcggctaaagaaaacaaagccaaagcaggagtggcgcgttaagaaacaagctcctgtagccgatgagggcgcaaccgatgaagcaaagagattggccaaagggaaaagtattgtaaccg

SEQ ID NO: 43445 - DNA, 1501 bp, Oryza sativa
tcagcatgatgacatgcaaatggagcaaaaagaaaataatgattatgacactggtactactgaagcttcggaagttgctaatgtaattaggggcacaaatgaacatggtaagcaaatggatggatacacagccagacctgaagatggcgatgagttgtcttcgtctgaagttcttgagcagacagagtcaagagagactatctttaaggtgtgggatctggacgttccgttttctgatgaggatgagcttgaactcatcaaggatctgaagaaactcctcaaggacaatcctcaggagtctgaatttcgacctcccagtggaacagccaagacattgagccagatagccgtcgatgatctagtggcagacttgagcgacttgtcattgcagcaaacagacgagtagcaacattcccccaagatatttctgtggcaaaattttttaccatccccgatgaactattcttcgttctctagctaacagtgcagatggcttaagtggaggctgtgcgtttgtaagaattagattgactgtttcgctgttcttttgaatctctacctttcttaataggtagttgtagtaaaaaagttgttcttttttatctgcgtgtattaaactataggtcctcaaacttgcacgcttggtttgtgcacgtccctgtactgattacgcatccacataatttgggtccttctggctatagacatgccacttgtaagttgacttgtgctgcgaacggcgtttaatcgtcctccgtgttttgcgctctcgtcctcaatctgccgctcccgggcgggctgtcagtttagaggagcttatggcagttgccaaaacatcttcaaacagtctacatttctacttaaatattaaaaagatgtagttgtataatccaaaaaaataaactagaagccagaagttgtatttccctgcttctctatattcttaccaactaggttctcagaattaaacttctcaaatagggcctaagattctaaagcagatggtagcttttgagaatatgaaaaagttaggtttttcaacttctaaattttagtttattttctgaattttacaactacaacttctcataatctaaacgaaaaactgagttgtttaggtgagattctaattctggaagaagttatagcggccagaaacttccctaaataggtcctaggtgagtttctcttagacaagttttggcactgtcagagactatattgattttggtaaaaattggctatcatttgtactaagatttggcattaaaccaaatcagcctatcaattctatatttaggtcttacctacaagatcacatatttagacataatcaagatcttcgataagaatcctataaggccgactctctcacacattgagatgcttgatatgatcattgagttgaattataccgggcaactctcgcatatattaagacaccatctctaaataaaatcttacaagaccaactatctcacacattaaggtatgatcttac

SEQ ID NO: 43446 - DNA, 1501 bp, Oryza sativa
gcttcgagaatctgttcggtaccggatcgcagcgaagggtcgccgccgagcaggtccggcttgccgtcgtagtccccggcattccagaactgcctcgtcaccctcctcctcccgcgcggaggaggaggaggaggaggaggggcagaaggccgcggtagcggatcgaggaatcccggtggaacggcggcggccagaatcctagccctcttctccgcctcccggccactgccagccgttgccaccacacgccgcggcctcttcccggcgccgccgaagccggggtcggggtcggagtcggtttcgctgctgctgacgtcgatcaccgcatgcgcctcggtgtctccctccccgccgcccgcggctgcactgggctcaccggcggccggtgccatgcggcgaacggggaaagggaagcggcagttactactggagtagtactagctaagcttgagccgcgacggcgtgctcagtgctctgctttgtagtaggactaggagtagtagtatagctaggcggcctaggcgcgccgctcgtggtgtggggcccacgtggcagccgcagaggagggtatagaactagagacacgccatagagacgtggagtactacagggttggtcagatggacgagacgtggcgtgggaatcgggcaggcgtaagcattgatgggtcacatcggtggcgatgcactggcgtgtgctactcctctattgttagagcaagtgaaatagcaggttataaaccagctgtaaacatattttaaaaagataaatgaggagagagaagagcagcaggctatagatttgtagccagctctagcacggacttcaagacgtagtgtatgtatgacaggtgggatcaggtattaatagtatagtaaacaactattgtatgaattggctattatattggctatagacgatttagagctagtagtgggctacactatttaccttgctcttactgctactctgtccgtcctaaaatatactactcccttcgtcttgtaatataaaggattttaagtttttgtttgtagtgtttgaccactcatcttattaaaaaaaaattagaattattatttatttttttttacttactctattatccaaagtaccttaaacacaacttaccggtttttatatttgcataaattttttaaataagacaagtggtcaaacagtgcaagcaaaaactcaaaatcccttctattatgggatggagggagtataagtttagataatataaacatctagtacgacatatttattatcctagaatatgtcacatccatccaaaatcttttatattatatggcggagggagtaagagattttagatggatctggcttatacactgggacggagggagtacttcctcagtctatgacaagaatacaataatctaaaagtagatgggtattactctctttatttatatttatagctaaaatttattatattttaggatgaagataatccaatatctagatttatactctc

SEQ ID NO: 43447 - DNA, 1501 bp, Oryza sativa
tatcttattccattagggagttatgaattttagaagtcttatcggtttatagtagtatagtcttaggtagtgttatgaaatacttttgtaaagtgatttttactagattagacttcacaggggtgtagacgtgtgttttctaagactaatgcatttggtttcacaatttttggagttataatgattttcttatagattttacaagttacaacgtgttttaggcatatagtgttttatatgttcatgacttttgagttataggttcagaacatgctacttcctatttaagttgaataaaaggaataatttagttaactaaaacatttttagttcacatgtttatggtctttactactatagttcatattttataaactagagatgctctaaactaaactagcaatatattatattaacctagaaattgttatatgagctaagttcttctaagttttagtggatagggatggaactatggcctctctggtctaacaagttttattttggtttattcatagctagaatgcattttttttaactacctcacacatatattttgcttaaccattactaggtgattaactcctaggttatctatttaaagattagagctataatatgttcaaaaggtgcaatattttattttactatgttgaagctaactatttgctggttctatggaaactttgttcatttcatttggactaaaaatgaattttctacaagttttacaaattaaaggttgctctatgttagtaaatccttatatgaatatttagagacttttactacacagtaagtatataatcttatttcataacatggaaatacgtgttttggtgatcctacagaacttaagtttattcaaattgaagctaaattgggttctacatgaatttctaaagtttagcttatctaaaactaataattatagagataatagttttagaggcatttgatgcaaagtaagtaattacttttatttcacctaatcagagagtgcatgatgatgaatctgcagtttttgagtttgtttcaaaatgagttgagatgaattttctatgtattttataagtttgtacatgttttatgtatgatttatcttaaaccaattttagagacaaagtttgtacagtgaatgtctagttttatgcaataactctaaagttcatgatttggtgagttcacagaaatttgatttactctaaaatgagttgttttcaatttgttatggattttataagtttacatgctttcctgttgaaaatataaagcttttagtattatctttttacatttttcaaattttaaactcatggggttcatcaggcagtatcaggccaatatgcaaaaaggcccctaggatttcaggaaatcaacccgcagtcctaggtccatatgtcattgattgggaacattacgtaatgaaccttatagttatttaaattctcaaaatgaagtccctgacacctttttcacacgcacagaggcagagcagcca

SEQ ID NO: 43448 - DNA, 231 bp, Oryza sativa
ctcgtttgtcttcttgttggagtcgtgtggggcatggttatgctagtgtgtggtataactatgtcggagcctgtctttattttatttgcctaagcaacttgaactttaatgaaccaatttaatagcagtaataaattcaagaattatggtggtcgtgggtggttagctttaattgtcagctctctctgtttgctggttctgtgtggggttttcagatggtgacgaccagga

SEQ ID NO: 43449 - DNA, 1501 bp, Oryza sativa
agtatctggtagtttaggcgcggtgtctagattacgggatatcattatttgttatatattgcagatgagaggtgggccgctgatggtgacagctcagtacgggtattcctccgcgccggtatataatcctaagttaatttcctggggagggtattcctccgtatttagccctggttgtatggttatgacgggctgtcgtaaggaactcggcagtcaggggtggcttctcgaagtaccaggagggcatcggatagagggtattagctagtatagcagttaactagaatgtatgtatactatgcatattagaagtataggaatagattttctttctcttttctttccacctagctaagataatatattatgagaatgagtagtaatgcttgtgtgtcattctaccattggattatcttaacccctacttagaatatgattatcacaagtaatatataaattattagtcaagctctctctacatgattttcccacgggataaaataaatacgatatccttggaatactctcgggtgaaatgctacaatggtataaccgtgtgcttgcggatgaactctgtaaccataatataccaggagtatttctgcgccattgctgggaattatatttctagtaatgtcgttaaaaaataccaacacttactgttctcaataaacgtagtgggtgggcgctgggagtgtccgcccaaaccacacacgtgtggcggtgcgtggagggggttgaggcggcctgacccctttcgtgagggatagccagcataccagccccggtgcgacccccccccccaaaacccccgggtcgaaaagcgccatgtgggcttgaggcagacttttccctttgtatgtagtacctcaggcccatatcaccgataatattgatctgccgatttgtctcgtgcatatcaaagtaatatatgttggttgctaaaaggcctcgcacatgagaatgagaatgtaagttaaaaatcctcgcgcatgagaatataagtttaaggaataaagatcaagtgcagaaatagactgtgtcgcatcgcatggcggaagcaagatgaactggaaccgaacacgaagaggggagcgtgcacacggacagaccaacgacgtggggttggaagcagatgagcactgagtcgcacgcgtcgctttcggacgatggatgatcacgatgtgatggacggaaaattatcaattttttaagtagtttagattagattaaaaaaggaaaagaaattagagaaaaactctaatcaataatgcttaattcttcttaagttcttaaaaaaagagagaaactctttccagttttgaaaatagaaaaaaaatagggcaactgcaaattaaccactgttttaaatcattattgcaagactaccactagaaaattacaaaataacactagaactgtcattaagtggcatccttgcaaaattaaaaaaaccggtagtaaatttgcaaatgccaaaaaaaaaatacgatcaacgtat

SEQ ID NO: 43450 - DNA, 1243 bp, Oryza sativa
gctgttgatataaccttttgtttgcgggtttagacttagtctttgagtgatgcgggtcccgattgcttcttctaggatgagaacttaatggggtaaacccctagtcggtgtgcttgtgattgggtaatcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgctgccttcgagtggtttgacgggcacatctcaggctgaagttgactggcaggctaagggctcagcaatgtctctaatattcctctctcgaggcgtcggatgtttcattatgcttgtttgatgacttgaattattcacttcatctcccaaatataatggaagatccggagagcctacgacatagagtctctagctatttgccaaattattgatcatcattaattacaatcttactttggtttttctcataattctaagacaaacataaaattaaattccattaatatgtccatttgaaagaattttttttcagagttaaacttactcatgtaataatatattactctgcatgtttaatattactggtcattctcacatttcaaattattatttttagatcgcggtcttctatcttcaccttttaaatgccatgtataactgttaatcaaagttaatattgcttttgaaaatgattataatgtagttaataagcatagcagtgtaatttgccacatctccttgtttgatgtgaaattttgctagagttaaaaataatataaaatgagaggtaggcaaattttctatatatattacagatgagccatattacaggctaaattaggtggcacgccaacaggcgtgcagatcttctagtatctcctaaatcgaagatccgattccgatgaaacttggacctaaattcatctaaattcaaaatctacattttgataccaaatttgctattttaatattttatttggatttcctgaagttatttaaatgtcatttgcttttcaaatatctccttttatttcaaaatatcctttagccactaaaaagccgtcggttggaactttacgccttcca

SEQ ID NO: 43451 - DNA, 171 bp, Oryza sativa
atgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaa

SEQ ID NO: 43452 - DNA, 231 bp, Oryza sativa
ttttaaagattaaatcggattaaaacacttatatcggtttaaattgaattatgacgcaataatgaattatttttgaaaaggaaaagaaggattattgcgtcagcggctagggtttggtggaccgggcgcacgggcggcggttcacacgaacggacggccgagatcgaaccaatccaaaacggacggccgagatcaatcgggtccatggcggctcacggcggacgaccccaa

SEQ ID NO: 43453 - DNA, 282 bp, Oryza sativa
ccccccccccggcgtcacttgtgatacaatgatacgcaagccttgagcgtattctcgaaaaaaaaaaagttaacaaaacgacttgggtcacctcgcaagaaattttagattgtgcctagttttcactaaggcagaactcatatagtggcagaaaagcattacatcaaacaagagaacattacaacagagtactgtttggaaatctaacccagtaaaatcataggtacagctccaaaacaatctgacatcagtaaactgcattcaacccacattctgcttaga

SEQ ID NO: 43454 - DNA, 300 bp, Oryza sativa
cattcatcagagaaagagttctacaatgaggctgatggtgtgaaggattaggtgtagccttggtcaagctgcctgtgaagtgaagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacatg

SEQ ID NO: 43455 - DNA, 1501 bp, Oryza sativa
ttcttctctcgaggtgtcggatgtttcattatgtttgtttgatgacttgaattattcacttcatccctcaaatataatggaaggtccggaaagcctacgacaatatcacttgatattcatcgatacatgcgatgcatcagatgattctcgtgaggtatcaagtgatacttaccaggtaccacaagatacttacgatatcaggttctgatacctataggtacggtgtcggatgattcctgtgtggtgtcatgtgatacttgcgaggtatcacatgatacttaggttctaatagctgtaggtatcaaatgattcctgtgaactgttaggtgatacttatgaggtatcaaacgatactccctatgggcgacaatgtatttgacgagaggtaggtcctcctccactgtcaacgcaccatgccggagctcgtcgccagtggccacatccttcgcattgagcaggtcctcctctgcctaggcaccacgccgaagctcgtcaccggtggccgcatcctccgcgagtaggtcttccactgtccacaccccacgttggagctcgtcactggcggccacgtcctcctcgtttcgcgtctatccacttcaatgacagctccatcctaaccgccaccacaacccatgtccatcggctctgatgcccaagctcacatgttctcaggcgcgggacctctcctattggtttaacgacgatgaccaagccctgcgcggcgcgctggcgccactaccctcggccagcataggtagctgtgcagcgtgtcggcaaggcccatgacctgtggcaacggacccaccgcgccaccatgccgcaaccttgtgcgaaatctggttgtctctgcgccgcaacgaccgtcatgaaatatggtgttctccacgtcatttttatccatagtcgcatgagtgtgggagaggatcccatcttgaacgctaataaagatatcctggtatctagcatttccgattttaaaaatattactttaggttatttttcaacacaatgaattaaaatattgttggtcgacaaagagtacaaaatcacttatcacgtattattctcttatgggttcttgggctaggttctcttttttttccttttgagaaacggtgtaaggtttttacttcaccataacttttagaccgatttcttttcagcaacccaaaacgataactttctagttttccaatgacactctttctataccgcaaaacaattattttatgtaaaattgttttatatagaagtctttttaaaatgaaataaatctatttttttaatatttaacacgtaattgatcatgactcatgagctaatcatccatcacatttgcgtgtgtccattaaaccaagctgtccagttcaaataaacggctcaaacaaacactctttaactctgtatatgtgttatctgatggctgatcaggccgtttgtacatgtgttatctgaattttaaatatactatatttttatgctggtctaaaaagaaatataa

SEQ ID NO: 43456 - DNA, 1501 bp, Oryza sativa
cataattaagaggatttgctaagttaaatacaaaatttaaataattttgccaataaacacagtgagtaattagagtgtgttttaaatatgcaaaaggcatattattaagacaaccggtaaatttagtaaagcggggtattttaacaaacatatttgccaaataacatataacatcatgggtttgcaggaccattacatagagtttacaaaactaattaactgctttcatggcttccggcgaggcgggggcttacgaggcagcagtcggcgcggcatcaacgaccacatggcgccagggttggtggtggtggccatgggcccgtattgggctccgtagtgggcgaaatgggtggcgcggcgctaacacattgagtagcggggaatgtggtgtagaaggtgagttcggggccaacgagggaggccgagaacggcgtccaaattcaatcctaagataggcatcgtaccttcaagcgctggaggccgctgcttccttgatttctacttctcccttctcttcttctttcgcgagcagtgctgataacatgttaacaaaacacgaaacgagagaggattgatttctcattgatcgtagtgttcaatttatacatgcgcaatggatggggtccactgcgccccttgtcgaggagtgccgagaggagaaaaagggcgcgaccaacagccacggttcgttctctaccgattgttggcgaggagaggcatggcaactgctacctattcctccgggtggatgagatcgcccaagatttcttaacacaaacctggaaatcggctaccaacttcttgatgtcactaacaagaacacaggattagtctggctggattcgttggatgatagagagacaatttgatgccttggtagccctccgccgggacaaggcacaccgaatcaacttaggcttgaaccgttgaacatttctgtgattcagcttgttgtagacaaatagacacctaagtggtcccagatcacaaaaccaaaacccacttagctggagacttgaaaaattgcaccatccgaattgatgagcactgtcctgccgccggactccatctagtaactggaataatccatgattgccatgattttctagattgttgccatgattttctagattgcctgggtcggttgtgaggtacaccccctgtgtgttactatccattcgccttcttggcactacacaattgcgctatgttagttagctctactgctctaccgaaaaaaactaagcattgcatggctaatcctgtcatgatttcttgatataacaagaatctagttcatgggttggcatcaatccaagagtaaatcatattgcaatcccaatattttaagaaaacacaaataggaactgaaatccagatccacacaatgctgaagtaactgaactgccgtttaacaaagataaagacagacttccccacaggttcaagttccaaaacacaccaagtacatactacatcacttgcagtctcagatataaga

SEQ ID NO: 43457 - DNA, 1501 bp, Oryza sativa
gcttagccagccgccttcctctgctttcttgctgcttttaattttaccttcttcgacatagcaataggtctctgcttctgatctttctttttctctccttcccttggtgtgtgtagtgacaagtgatcacagatcagtactatataaaagagttctatggaagcttagcttatgttttctgaaactagctcttgttttacaactcccactgtttacaactataattttgaatctttggtcatctagttgttcattagtaccatttactctctgactactttttagctctgcttttgtcgccgaaatccatgggagctccgccgccaaggaacgtctcggcgacacgcgcgggcggtcagcggggggcttgggggtggggacgaggccggtgccaacggcatgctacacaaccacgccgtcgactacgcgctagcacctgtccaccatgggcaagccaatagagcttgctacatgtgagcatcggaactcggaacaaactgaaagaagggaaaaaaagataagggcaaaattgtcattttatgtgatttctctctcattgattgagtggatattatattttaatgcgttcagtatccagcagcaaattaccagaattttgaagtgttctcgagcaaattcacatctttataatgttccacagctaattacgtatttttttgagtgtccttagcaaattttgcctagaaacaattgagatgatatgccatatttatgggcgatgcgcaaagatgggcatgaagaagaggtggaaagctattcggtggataacacctaccataagaatgggatggtgatcgaatggtgtgacggggttatgtatttagataggctcttgaaccggtagcttcactttggtatgaatagtcacggtgccatcgccgccgccaccaccaccaccaccatacaacctactatgatggcgtacaggaatggtagtttcagtgatgtccccgcgtacaggaacagtgggttcggtgctgtgcccgcgtcgagcacggccatggccgagctgcaggaggcttgggcgagcgaggcaaaggagctcaattgcatgcgctgtttaactggaggtctttgaggtgggagagaagctaacgaggatgtcctgctctcattgcttccgtgggccctgtatctcggattggctaagggtaagccatttctacctgctctgccaacagaagaacaatatatgaaaataactctcttttctgtgagaatttaatttcgtttgttcgttaaattcaaagaaccagcatgttgtttatttttggattcttaacacactaaacctttcttttaaacctttatttgtgatgaaaaatacaagggaaaattgtgtaccagtgtaacctcggcccaagcctatataacccatagcagtgaaatgggccaagattaataaacatgggaaagtgctgagcttttactggccaaaatcgtgatggacttcgagccactcccctcagccgccggcgac

SEQ ID NO: 43458 - DNA, 1501 bp, Oryza sativa
ttggaaataggactccgagagctttccgtcaagtactcaagggccaaaaacagaggtcctatgcagctttggcggccctttgaagtcaacagtgcagcaggtggccgaatcggattccagcacttggaggacttgaccttgatgacttcttgttgatcaatgatgtgagcaatggttgtatcactggtaggcatggtcacatcatcttgccatctttcgtcacttctagccttgaatcacaatgaaacatcgttgtattgcatattcttcttcgtaatcttcattggttcttcatcagactaatcccttgcttatacattcaataagcgcattaatcccctaatcgtttgtcatcaattaaccaaaacccactaggggcatagattctctttcaaaggggaggggaggtgttgctgcccatttataggcaggggaggagtggaacggccgggggagctcactggccggccatcaatgccggtagttcgccggagatgaaaagtcatcgattcaaggtgagtttgtacacaattgagtgggaaattatggcaaaaataaagaggaggaaaggaaccgacttttctgatcaatttggtggagaatcgtgcgaggaggtggatcaactcggcggcggcgctagggttccgaacggaggagagagagagagagagagagagagagagagaggagcagtcagccgctagaggtaggggacgacctacagttgggctggctaggccgcgtcgaggacggacttaggtccgatggagagagaggagaggaagtgggttggcttggagaaaagaacgggctgggagagggagattgacccaaaagggagggagggagggagggagagaaaggccgagcgggccagcggggagggaaaacagactttgggccgtaaatggcccaaagaggagagatttatttttaggtttttcatttaaatttactccgaatttggtttttttgctttaaaattattttgtttgctttaaaaattcaagtaaaaatgaggaaccaattttagagcatggagaatttaacaaaaatactccaagccactttcggatttttctgggacgtattttagagcatctctaacagattagctattttggactctccaaatgtccatttagccaatggccaaaaaattagagagtcatatttgccttttactccaacaatctctctatcccactctccaatcttgatgggtcccacatgtcagtctctaatttctttttcccttccctctatcttccccttttccacgtgagcccacggcgtgcggacgaggtggctgacggaggtggtcgacggagggggctgccgtgcggggacgaggcgaccgacggcgctagagatgcggcggacacggcaacgtcggcggcggcggtgaggagacgacgaggttccgccatcgctggagatgcgagacagagaaagggggacgggagcacggaggcttctctccgccgccgatccgtcgcca

SEQ ID NO: 43459 - DNA, 1501 bp, Oryza sativa
cgaaggctgcccgacgaagtatgctggcacttgcgtggcttgtgggtagacttggggtgggacatagcctgccgaatactggaggattggggccgaagcggccttggcccgcctcgctgcctcgtacgcctgttgctgttcttgcatctgtcgaagcatgccttggagtcgtgtcatattctgtcgcatggcttccatgtcggcttcggcttgtgtttcggggtcagggtttacttgtgcggcgacgagcgcagtcgagaccattgccggttgtgatggagcggcttggggcgccagcagatggcttgtcgaaaggatctccgccctggtttggagtgcccttgctgctgcagccgccttcatcgtgtcaggcgtgttcggcacctgccccagcgaggcgataggagccgaagacggcagcagtggcgcgggtgctgaagctggtggcgctccgccatcctcggcgacgggcgccgaaggctctacaccctcttcggtggccatctctcccccagcttcgctttcctttcaccttgtaaccttctccttcacgaccctctttggtgggcattcgctctcagtagtttcgcttggaggtccccatggtcggcgccagctgttgtcgaaatgacaactgcatacgtcgaaggacgtggttactcaacgatggttggaaaacagtaaagtgtattagattgagaatttttcttaggatcccctttacatggccctaggggtctatttatatccttgttacaggcccccctattagggtttaggttttacaggggaatttatatggttgcccttgtgaaagggacatttacatgggtatacagtgtcattggcatacatgggcctctaatgggcctggttggcgaatgccggcccaaaggccggccaaagcggccaggatggcgaagtcaccctcctttggcgggcacccttcgcccaggatgtacagtcttcgccatggggctccatcttttgccgtcctcgctccattgtcttcgccatgtggcttcaccgccttcaccatggggctttgccccgatgaacttaacaccttgagcctgaatcctgactggtcgcacggtttcggcagatctggtcgaagggtctcatgagatactgccaacatagagtatggggatcattggagctatggtatacgcaagattgaagtaaaagagacgagagacaatgatttttatacagattcgggcacacatgtaatagccctactcctgttggccaaggcggtgttgcatttatatatgaaaaccacgtgattacgataaattgtatataaaatattgcgtacctatgtagatatatctcgcatatatctacgaaattagtagattgatttgagaaattaatctaccaattgtctgttttaatacatacttgtgtctgtttcctggttgatgtttgtgtacgcataacaagatcatgtataaatttctctcatatttcaacgaatactgtatacaaactt

SEQ ID NO: 43460 - DNA, 1501 bp, Oryza sativa
caccgaagagggtgtagagccttcggcgcccgtcgccgaggatggcggagcgccaccagcttcagcacccgcgccactgctgccgtcttcggctcctatcgcctcgctggggcaggtgccgaacacgcctgacacgatgaaggcggctgcagcagcaagggcactccaaaccagggcggagatcctttcgacaagccatctgctggcgccccaagccgctccatcacaaccggcaatggtctcgactgcgctcgtcgccgcacaagtaaaccctgaccccgaaacacaagccgaagccgacatggaagccatgcgacagaatatgacacgactccaaggcatgcttcgacagatgcaagaacagcaacaggcgtacgaggcagcgaggcgggccaaggccgcttcggccccaatcctccagtattcggcaggctatgtcccaccccaagtctacccacaagccacgcaagtgccagcatacttcgtcgggcagccttcgatcgcagcggtacatccggcccctcgcgggcagccgcaagctcagccggtcactgttcaagtacacccacaactgcccggccaagtgtcacaagcaatggcaaaaggggcttcgactcggcaggcacagcttcaagctttccttcagcaacttagccaacccagaacacaagtcagggtgcgcccagttggttgccgtcgaatcagccaggtctgggggcttcgccttggagtcagggaccgcagttcgacttcatcaatgctgctcaggcaccagctgttcggccgcaagcaccaacgccaggcttcggggcgaaccaagcaccaaaccaggccgccatggcgtggccccagccaacgttcgactcatccatggcggctcatcaagcaccaccaattggaaccgcgcagccgaacactgtggcccaaccttacgcgcaagccgttacctcgcctttcgccacgccatatccgcaacaaggtgccgtgaacagggcaggggcgaaaaggggctaccactgagtgggggaatcaagatccgtccaatcccaccccagttcaagttcctacccgtcccacgctattcaggcgaaactgacacaaaagagttcctatccatctacgagtccgcgatcgaagccgctcatggcgacgagaataccaaggcgaaggtaatacatctcgctcttgacagcattgcccgttcttggtacttcaatttactagctaacaacatttactcatgggagcaattgcgcgatgtctttgtccttaattttcgaggcacctatgaggagccgaagacacagcaacatctactcggcattcgccagagaccgggggagtcgataagggactacatgcgtcacttctcgcaagcatgatgccaagtgcaggacatcactgaggcatccgtcatcaacgctgcttcggccggactgctcgagggcgaactcacaagaaaaatcaccaacaaggagccacagacactcgagcacctgct

SEQ ID NO: 43461 - DNA, 1501 bp, Oryza sativa
cagatctaatctccaatccaggagctaagcaaattattaccagatataacatccataattattgtgagaagtgtgggactaatcacgaaaaacattgctcaacccgcccataaccgtgggcacggctattcgaatagttttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggcatggactccccagcgacccccgtgggcttatctccgccacttctcagtctggtgccccgcaatgaaccatgctatacgaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaacttgtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcacgaaccttcgcaacgacggaaacgacaagctaacacgcaaaacgaagaaaaagactaataaaaaccaaataaacagtacatataaagtaaacaaacatgtagatcataattttagatgaattatgagacttgaacggcctcattctgacttcataagaatttattatgaaatttacaagattaaatctaattaaagcccatttaaaaagaattaaataaatttaattctatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcggctagggtttcgcggtggaccgggtgcacggcaacggttcatgggaacgaacggccgagatcaaccctatccaaaacggacggtcgagatcgatcggtccacgaccggctcacggcggacggtcccgatgacgtcagcga

SEQ ID NO: 43462 - DNA, 1501 bp, Oryza sativa
aactttgacaaggagtttgcctccttgtctaacccttgcatctcttgttttggcagatgcttccaaggggtagtcgtggtggttaccgttatgcttctggtcgtggcatgccagacaatgcattccgtggtgttggaggtttagtgccatccccatatgagatgggaagaatgcctctcagtgatgctggtgcaccaccgcaggttccaattggagcattggcctctgcactggccaattcacccccagatcagcaaagactggttagcttatcctttttgcttttatgcacatatgcggatctaaggataaatttcaatctggaactgggatcataacttcctctcatggctgcagatgcttggtgaaagtttatacccgcttgttgatcagctggagcatgatcaggcagcgaaggtcactggcatgcttttggagatggaccagactgaagttctccatctcattgagtcacctgatgctcttaaggccaaggtcgctgaggctatggaagttctccgtaatgctcagcagcagcaggcaaataccccaactgatcagctagctgctctcaccctgagcgacggcgtcgtttcttaacttggttggcatcttatatctgagactgcaagtgatgtagtatgtacttggtgtgttttggaacttgaacctgtggggaagtctgtctttatctttgttaaacggcagttcagttacttcagcattgtgtggatctggatttcagttcctatttgtgttttcttaaaatattgggattgcaatatgatttactcttggattgatgccaacccatgaactagattcttgttatatcaagaaatcatgacaggattagccatgcaatgcttagtttttttcggtagagcagtagagctaactaacatagcgcaattgtgtagtgccaagaaggcgaatggatagtaacacacagggggtgtacctcacaaccgacccaggcaatctagaaaatcatggcaacaatctagaaaatcatggcaatcatggattattccagttactagatggagtccggcggcaggacagtgctcatcaattcggatggtgcaatttttcaagtctccagctaagtgggttttggttttgtgatctgggaccacttaggtgtctatttgtctacaacaagctgaatcacagaaatgttcaacggttcaagcctaagttgattcggtgtgccttgtcccggcggagggctaccaaggcatcaaattgtctctctatcatccaacgaatccagccagactaatcctgtgttcttgttagtgacatcaagaagttggtagccgatttccaggtttgtgttaagaaatcttgggcgatctcatccacccggaggaataggtagcagttgccatgcctctcctcgccaacaatcggtagagaacgaaccgtggctgttggtcgcgccctttttctcctctcggcactcctcgacaaggggcgcagtggaccccatccattg

SEQ ID NO: 43463 - DNA, 1501 bp, Oryza sativa
agaggaaatggcgaaagagatacaccaggggctgtgcggtgcacatcaagccgcaagaacggtcgcctccaaagtgtttcgccagggagtctattggcccactgtgctgaaagtttgtgtcgagcaagccaagaagtgcgaaagctgccagcggcatggccgaagccaaactgcacctcagtacgagctacaacctatcgcaccagtatggcctttcgccagatgggggctagacatcgttggcccattccctgtggcgagaaatgggtacaagttcgcaattgtagccatcgaatacttctcccgctggattgaggccgaaccactcggtccgatcacttcagcagctgtgcagaagttcgtatggaaaaacattgtctgccgtttcggagtgcctaaggagttcatcactgacaacggcaagcaattcgactgacaaattcagagaaatgtgcgaagggctaaacctggaaatcaggttcgctttggtcgcacacccacagtcaaatggggcggccgaacgcacaaatggcaaaatccttgaggcactcaagaaaaggcttcagggggtggcgaagggtaaatggccagacgaaatgctatctgttctctgtgcccttcgcacgacccccaccagaccaaccaatttcagcccgttcatgcttctctatggcgatgaaacaatgaccccaactgatctaggggctaattcgccaagagtgatgttctctagaggcgaagacgggcacgaggtgtcactcgaactccttgaaggggtaagagtcgaagcactggaaaacatgcgcaaatacgccacaagcacttcggcaacttataacaaaaaagttcgcccgatagagctgttgcctggccatctcgtcctaaggaaaaaggcgaaccctgtggcggtcgggaagcttgaatcgaagtgggaagagccataccttatcaagcacaggtccaggacaggctccttttgcctagcgacgctggaaggcgaatagttcgaccattcctggaacgctgcttcacttaagctcttctatgtctagaacgggtggcacccaaattgccaacttgtaaaaatgtataatactgttatgtaagcctttcggcactatgtaagcccttcggcacaaaaatgcaaaaaaagaggaaaataaaaaaagagaggaaaaaaaactggatgtagggttattatccgccgtggaggcacgaaccaatataaaatccttgtgtttttcgcctctttacctgtgtgaatgataattcgtggaaaaaccccaaggcaaatgtcacgcccagaaattcacgaaccataatttctaagctgaatgtgcattaaacccttgtccagcaccagccagggtacacaaacgacaattgttgacatacagatccacgtcttacaataatataaaagattacaaatgcaacggaaatggaaaaagcgagctaagcctgaagacttgactcttgcagcgggcgactccattccaca

SEQ ID NO: 43464 - DNA, 1501 bp, Oryza sativa
tcggattcgtccgattttgtgcccgcgatcctcgccggcgcaatcaatggcggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgtttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtcgcctcccgtcggccgtgccggcgaggctgccttcgggcgcgccctcgcggctgccaagtggggcccggccgtcagccgcccgcgcccgcgggtgcggctgacgcgtgggacccacggcgccggccggcgccagccgcgtgcacccggtccaccgtggaccgtgaggctgccgcgtgggccccactcccgtggacccggtccgcgcgcccctcccgtcggctgacgcaataaatccgattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggt

SEQ ID NO: 43465 - DNA, 1175 bp, Oryza sativa
ctaatcagtacatgtgcagaatgcgtagagttgagagagacgtctggatagaaaggaccggccgattttttttcgaccggcagcagccattcttcgaaagttacttcatccatctctaaataactataagtgttttagctaatctaaatatattttgaaaatgattaaaaactacttatcgtttattaatacgtaacgatgagaagagattatattcattcaggactagtagatcactctaccaccaagaatcttttagaacaaatttttactcttatttatggagtgagtaaacagagggagtcagaagcgggaaaaatatgaaaacattttttttactggttttacaaaagtatacacgtttataagaaatttgcagacgtataccattgtcgcaggacagtgccacgagatgcactcgccagagtctcacagagcgagggcgcgagacagatctacctcgcatgacgagtgcgcgagacgcgtcttcgcatctgaactagcgcgattaatagagtaattagcttcattagaaattaattaattattgttatttctttacttagcattattagtaattaatcgatataattaatcatttccaagcggtgtcgttgtttggtcctgccagaccgcccgcgccgtcatgttatcgtcattttcgtgtaacgcttcagcgatatcgtgttgatttcacactcccatacagcgacggcggtatatttgtaccaacaaaaattatatcccggatatttcttaaaaaataaataatatatattcaaatttaattcattagaagtgagcgaaacttattaattgattagtttttctgtggtaaattttgtccactgaaatttaaattctaaagttaacgctcgttctggtatttacggctatttttttaatataaaacatagtgtgaggtacttagaaataagatgggtatacgtgagatgctcatatcatcgtagtaatggtgtttaatacggtcaaactcatcaagcgccggtagaagcactccctctcaaaaagaataaagagaaaaaaaaaacgcgcgccgtaggagcaccgagcacgcgcgtctcgccacgcttcgctcaatcgcttcgctttgcgccgatatatacaccaagcaccggcaatccaccgcgcagccaccatgccggcctccgacc

SEQ ID NO: 43466 - DNA, 1501 bp, Oryza sativa
gctcctcggacctacggtggatgggcacacgacaacgacgacgaggagtggtgcggcagctcggctcctcggacctgcggtggacgggcgcaccacgacgacgaggaggagcgatggtggcggctcggctcctcgggcctgcggtggataggcacacgcggcggatccggcgtcgggagcggcgcgcgtcgcgaatccggcgccgggcaagcccgcacgcatggcgacggatcggcggcggagagaagcctccgtgctcccgtccccctttctctgtctcgcatctccagcgatggcggaacctcgtcgtctcctcaccgccgccgccgacgttgccgtgtccgccgcatctctagcgccgtcggtcgcctcgtccccgcacggcagccccctccgtcgaccacctccgtcagccacctcgtccgcacgccgtgggctcacgtggaaaaggggaagatagagggaagggaaaaagaaattagagactgacatgtgggacccatcaagattggagagtgggatagagagattgttggagtaaaaggcaaatatgactctctaattttttggccattggctaaatggacatttggagagtccaaaatagctaatctgttagagatgctctaaaatacgtcccagaaaaatccgaaagtggcttggagtatttttgttaaattctccatgctctaaaattggttcctcatttttacttgaatttttaaagcaaacaaaataattttaaagcaaaaaaaccaaattcggagtaaatttaaatgaaaaacctaaaaataaatctctcctctttgggccatttacggcccaaagtctgttttccctccccgctggcccgctcggcctttctctccctccctccctccctcccttttgggtcaatctccctctcccagcccgttcttttctccaagccaacccacttcctctcctctctctccatcggacctaagtccgtcctcgacgcggcctagccagcccaactgtaggtcgtcccctacctctagcggctgactgctcctctctctctctctctctctctctctctctctcctccgttcggaaccctagcgccgccgccgagttgatccacctcctcgcacgattctccaccaaattgatcagaaaagtcggttcctttcctcctctttatttttgccataatttcccactcaattgtgtacaaactcaccttgaatcgatgacttttcatctccggcgaactaccggcattgatggccggccagtgagctcccccggccgttccactcctcccctgcctataaatgggcagcaacacctcccctcccctttgaaagagaatctatgcccctagtgggttttggttaattgatgacaaacgattaggggattaatgcgcttattgaatgtataagcaagggattagtctgatgaagaaccaatgaagattacgaagaagaatatgcaatacaacgatgtttcattgtgattcaaggctagaagt

SEQ ID NO: 43467 - DNA, 1118 bp, Oryza sativa
agggagggttttgggccggctttcggcccaaagccaaaaaaaaaacctttttcaatttaaattattcatgaaatgcaattccatttattaaaaacacttccttagctcaaataaatcccagaaaaatctagtaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgaacaagactgagtacaaccaccgtactcaacaagacacacccacaagtgcagcataattgcaaaggagtacaatggagttataatataggggttaggttttgcaataaacagcatttaaaagacccttagttgctcaaagctaaatttaaaacacgatcctagaactatttaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaaccca

SEQ ID NO: 43468 - DNA, 1501 bp, Oryza sativa
acatacaataccttcatgaacacaatgaaatcaaccgtcaacttctgcttgaaattgttaaggtttttagtccatcagaggccaaacaaattggagacaaagcactaaccatcataaaaaagtagtaatgacaacaaggttgctgcaacctaaaaacttacaatataaatcacaagaactgggcagtgttggaaattaatcttgttgtttacatttttagttattttttgtatttgcattttgggacaaggcagaagtgtagtatgtgtagcatcattttagataatggaagctttatttagactcagttaattacatcaagatgataaaatcaaactgagtcacccacggcctctgcataaaatgcacacagccaaaaaagaagaaagaaacaaccagaacatttcccaagtacaaaagtttgatagaaacatatatcttagtggctatcaatccatagactagacagctacccatgctcctgggtaaaaaactcttgcgccacctggtccaactgtcgtgataccaccgcaatagtatcccacagtcccggttggtggaggatagcccaggtacggagccaccgagtaactaaagtgataacctgcaaaggagaagacaccatcttgttattaaaaattactccattcctgcttagccaaatagaccaacacagagttgttgcacccataaaaagcagattcctcatgtctttggggacacaagatagccaactcctaaacatatgacaaatattgcgaggaggttttaaattagaagccaaatgaactacagaccacaccaagcgagataagcaacactgaaagaacaaatgttggatggtttcatccttgtgacaaaaacaacatgtcttgctacctttacaatttctcttagcatggttgtccttggtgagaaatacgcctcgacgcaactaccaaatgaagattttaacttttaggggcactttctccttccaaatccgtctattgataatcggaaatgtgtaggatcatggcatagcaatttgattagcagaagcatgtgtagtgcggagtgggcagatcaacagctaggagttgagtgtctactcatacatgtgtaggtggactagattagccatgcatgtaggtgattagcagccatgcatggtgattagccaacaggggcggatctatcatggggggcgcagggtctcaatccttcactactggcgtaaggaccatgggtgccgccatgaagccccctctaaatttttgtgctataagtagatgggatgggggatgtagctttgtctagcttcttcagaccatcctgttatttcttcatagatccgccactgttagccaagtattaggatatgcacgtttggagcaagaagcggtccaggtagtacgcatgcatgcagagttagttagctttggattcatgtgtgtggttgcatgcattagcaatgtgctcctgcttatggcgtccacggctgtatcgtgtgagcgagagt

SEQ ID NO: 43469 - DNA, 629 bp, Oryza sativa
agacttgactccagcagcgagcgactccattccacaggcatccttgacggcagcgacggaaccaacttcctcgaaacagctccaactgagaagaacttcaactctggtgtgaaagagagcaagactgagtactacccactatacttagcaagacataccagaagggaaggtatgatgcaggatatatccaaaggaggctaaaggttcatttgcaataaagcagtcatttaaaagcagtagttgaaagcagtaaaatagttgtagtaattaatcaatataaaccgatcactgctccacgctacaccatgtggagacaggcccaaaccactacctgaactaaccagttccataagctaactaggggtgagactaatcacggtgaatctagtggaccgctcataaccgtgggcacggctattcgaatagttttactctgatcagaggtgtacaactgtacccacaagacacagccccacgacatgttcccgtgcgccgacatgccaccacgacataccggaaagaggccatgacaggacccttcgcataaccccctctaaccaatcgcaccacacctcaagtttcacccttactcctcgcaaggcagcgggcagtcccctctcgtgccatgg

SEQ ID NO: 43470 - DNA, 516 bp, Oryza sativa
taaaccaacatctaatcattttgatacccaagttatcaatggcataaggtaaacaatatatggctgagtagtaggacccatcccacatgatattgtaaaacaatgcaacatttaatagaaatgcgggacatttgtaaattgggtacaatatgatcaattgtgatgcatgacttgccttgctctcgcactgatgaaaccacagcaacgtcttcgagaaaccgcggatcgacgaaacggccgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattcactgtgtttttactataaacagataaatccttaattgatttattgcgcaatatctcatcccagggctgacgtcatcaacgagggggcggcaccgacatgccggacccacgg

SEQ ID NO: 43471 - DNA, 1501 bp, Oryza sativa
tatgtatcacgtgccatgctcttgcatgattattatttcgcatcatgtgggtcatgagcggcgtgtggatatttattgagtatagacttatgtttacacttctaaatgctgaaatttaccttcaaattatgtaattatgttgagatttgagaatgatctcattgctggcatggatgacaatgaggtgcatatttatacatgattaatgcctactttgatgcccatatgctaagtactagcttgctgaaattttatttgaaaacaaatctgattttaaagtgttttatgcaaaataaaacttgctttatgctaaaaagaaccatattatgccttccttgattatatgccttgcaagtagctagggtgttaggcttgtcttggtgcttgctagtatattatttggtgttaggcttgtcttggtgcttgctagtacattatttctaataatgtactgactcttgctattagattaactatttgcttgcaggttgtagacttagtcttttgagtgatgcgggtaattgactgcttcttctaggacttgaacttaatgggggtaaacccctagtcggtgtgcttgtggtttgggtagacaagcttccgcggttctattatctatattcggctggtcggcctatgtaactatgaagtagttgtaagttagatcatttttgtcttaagtgtattttgctatgtatttccatgcttaagatgaaagtgtgaatctagtgcacatcctgggaactagattcatatgtgtatgagttaagaatatttgagatgttgtagatctttagctatttttgtgtcacgccctgaagttctctccctagctaaaattcaattaataaattgttgcaagaaattatttgtttaaaggcaagagggaaaccctaaattaataaatgcaaataataatcggaatcggcatgtggaatttttcttgaattctacatgtcaaaatatgctaataggatttttagtggaattttcaaagcctcggagataattaaaatcaattaaaaatgagcacaagcattaaagaatccctagaaattctttttttccttttcctttcttttcccccttttgggccgccggcctgctcctcccttccctccccgaagtccttcctccctccctctctctcgggcgccgataggtgggccccacctgtcgggccttcctccttcctcccgcgccccactccgcgccccgtgcccaagtcgccacccacgtcctcgccttcccgcccgcgcacgcacgcccacaaggggcggattcaattttgaagccccctcccactctctctctctctctctctctctctccacctcacacgtcgccggtgaaatcgggagctttcccggccacgtccgcccctcccttgcccataaaaagcctccccgcgtcctcctctccatttttccactttccgcctccctctcccgtgctctctatcacgccggtgccatcacacccaccgccgccgccctttagc

SEQ ID NO: 43472 - DNA, 1501 bp, Oryza sativa
atttatcgttcttaccacaagccagtgtgggcaacggctgggcttgtagtgtagctttcctctagccgacgtacccaggcaagggtgggcgtgatggagttgggtcggccggggtgtccggttgatcggcttccggattcaccgtggcacgagaggggactgcccgctgccttgcgaggagtgagggtgaaacctgaggtgtggtgcgattggttagagggggttatgcgaaaggtcctgtcacggcctcttttcggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcacaatgggtagtactcagtcttgctctcttttcccctactccagagctaaagttcttctcagctggagctgtctcagaaaggttggtttcgtcgctactgtcagggatgcctgtggaatggagtcgcccgctgcaagagtcaagtcttcaggcttagctcgctttttccttttccattgcatttgtaatcttttatatttttgtaagacgtggatctatatgtcaacaattgtcatttgtgtactctggctggtcttggacaggggtttaatgcacatttagcttagaaattctggttcgtgaatttctgggcgtgagaagttggtatcagagccgaccttgaccgtaagacatgccaattggaaaccctaagagccctctgaaaccttttcatctgcacatgccctttgcacttggattagtttcgggaaaattttggggtttgttcttttgatttgtgggaaaaatcttgatcgctatttaatcggatttctcggctagaggcagtctagggtctagtaaaattttattcggaatttatttgacagtgagtcgggaatttattaggtgatatgcactaagtcgtgtctaggttcaatggggagattttatgcgtatcattatagctatgcatctatttcgtgcattaatttattgtttagtcggttgcattagtatcttttgtttgggttcatgaaaaatgttccatgcataaaaatcatcatgtttggctagttgcttgagtcattcgttgctttgtttaatttggatttgagcatgtattggttcctatccctctgtcctctttagatgtcagacctattcctcgatcgcaagcgccgctccgagcttcagagtcaccgcccttagctttatcgtcttcttagtctgttgcttgctagtttctgtgtttaggtttgctgcttgtgggttagccggcggtcgatatcatgtgttagtggtatggctgccttaattaggagttgtttgcttccttttaagtgttttaatcaagattaagataattgcacataaatatataagaaagattagtttctaagccgtctgttttcttcctttctcttatttctacctatcctcctccagatgg

SEQ ID NO: 43473 - DNA, 852 bp, Oryza sativa
accatttgcagccgagctggaagaaccaagattagaatcaagcctagcatgcagcaccaacttgtaagcactttgaatagagaagagacctgacttttcataatgccacgcaagaaaatcctgtctgatattgaggcagtttaattttgagaatttctatggcatcaaaaggattgcatattcgccagatcagatccgcatcccaggaacgatcatcttgctttattaactgggaaacccaacgaaggcgacaccttccagcaacaccagctaacataagcgaggattcactcggtatccaccgatcatgccagattcttacttttgtcccatctccaatacgccaaatcagacctttcttcagcaattgaagaccatattccaggctcttccaagtcaccgatgagtcacccaggaaaacagcatctattaactcactgttagggaaatatttagccttcaacaacctggcgcataagctatccggaaactgaatcaggcgccaagcttgcctggctaggagagcttggttgaaaagcctcatatcccgaaaacccaagcctcccatgaatttaggcagaattagctgttcccaagcgatccaatgcactttccgtttattggtctcatcaccccaccaaaaatccctgatcattttggtataatgtcggctcccaaaactaatgattcagaaaccgacatgtttagactgtatcaagccctggatcagtagattgatacaagttcaataatctggatcgtctttgcatacgtctaggcatagctttgaaggagatattattatatgaagtaatagggtatttacaagattgtgtctaactattacagcag

SEQ ID NO: 43474 - DNA, 1501 bp, Oryza sativa
cgttcgggaaaaggcaattttcccggtcgcgacaggcgtgttccacgtcgtccccgtctccgtgcagccactgctggctgtccctcgtcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccgcgtgatttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtattgttattgcttctttataggcttgtagctttgcttgtgtgcttcgcgtagctttcgtcgttccggaggttcccgaagcgtggttcgtggttgtcgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaa

SEQ ID NO: 43475 - DNA, 420 bp, Oryza sativa
actcactgttagggaaatatttagccttcaacaacctggcgcataagctatccggaaactgaatcaggcgccaagcttgcctggctaggagagcttggttgaaaagcctcatatcccgaaaacccaagcctcccatgaatttaggcagaattagctgttcccaagcgatccaatgcactttccgtttattggtctcatcaccccaccaaaaatccctgatcattttggtataatgtcggctcccaaaactaatgattcagaaaccgacatgtttagactgtatcaagccctggatcagtagattgatacaagttcaataatctggatcgtctttgcatacgtctaggcatagctttgaaggagatattattatatgaagtaatagggtatttacaagattgtgtctaactattacagcag

SEQ ID NO: 43476 - DNA, 204 bp, Oryza sativa
tgatcattttggtataatgtcggctcccaaaactaatgattcagaaaccgacatgtttagactgtatcaagccctggatcagtagattgatacaagttcaataatctggatcgtctttgcatacgtctaggcatagctttgaaggagatattattatatgaagtaatagggtatttacaagattgtgtctaactattacagcag

SEQ ID NO: 43477 - DNA, 1501 bp, Oryza sativa
gcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtctcacacctctcacaataattatggatgttatacctggtaataatttgcttagctcctggtttggagttagatctgtacagccgggtatggttgttcagaatggttgggcctgtgcagtatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctgtgtggcttgctgagtatgtcatatgctcaccttgcaataattaatcaacctcagttgaagacaagttgcgaaggagaagacgtttggcttataccccagttgagctgcctgtgggagtggagccggagcttcgttagattttattttccgctgcagtttacttcttggtgaggactaagtgcctcttaagtaagtatttatcgttctagttaatttgatgaatttgtatattaaattgtcagtttgtgtaccttggctgattcctggacgaggattttatgcacaaataagttcgaaaattactagtgaattttcgggcgtgaaaatagtctagtttgtgtttcgcccccttccccccttagggtagtgtatgacattagtagtgacgacgaaccatgttcgccgaaccatttctttgggagtggggattgctttgggggcgaagatgtaatttatttgtgaggtaggccgtgaagccattgctttctttgcttgtaccatgttgtatggcagtattcttcaatcatttttccgaagttaataaacgtgtgttttatttccttttcgctatttttcgcattggcacctttcgtgctttcgttaggtcgaaacatgtcggcccctttgcgtatattagcgaaataggtatgctgactttttagctttcaacttccgctttcaatccgtgacatttcgtgctgagagcagttacgttttcacatggattgagtataacggtgttcggttggtttttttcgaaacaagctgtcgcggtttcaacgttcggcgagcgatgcttcggccgattcgttttgcccccctagcgttttcgctgatcgggtgtttgctgtcacaccctgaagttcttctcccaagcctaaagtaattaataaatggtctcgagaaattacctgtgtaaaagagagagaaaccctaattgaattaatgcaaataataataaaaaatgacatgtggaaattttcttgagttctacatgtcaaaatatgctaacaagatttttagtggaatttttagagctctagaaataattttaaccaattaaaattgagcacaag

SEQ ID NO: 43478 - DNA, 1501 bp, Oryza sativa
ataactaattcattgtaactcagtttaatgtggttcaagttgcaaaaattgtgtaaaataaagatctacatattaaaattgtccataaattgaattaaatttatttaattctttttaaatgggctttaaatatatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttctgtcgttgcgaaggttcgcgagtgcgccggaagtattcaagaagattaattgaagaccgattattgcaaggcaagtcacacagatcctaaacacaatcctttgagcatattgatcctatatttaaattctctatttatttcaactgtgcatttattttcgaatgtcactgggtggtgtgaacctattcctttgttatggccaatttgcattgattactttattccttgataccttgggttattataacttgactagttgggctatatatattggttcagctagatattagatatgattgcttagccatgcttagaaacattagcacattattgggataacttatgattcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcagagcaccagactgagaagtggcggagataagcccacgggggtcgctggggagtccatgcctctggtttttgagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtctcacacctctcacaataattatggatgttatacctggtaataatttgcttagctcctggtttggagttagatctgtacagccgggtatggttgttcagaatggttgggcctgtgcagtatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctgtgtggcttgctgagtatgtcatatgctcaccttgcaataattaatcaacctcagt

SEQ ID NO: 43479 - DNA, 1501 bp, Oryza sativa
ctgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggctgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattattacactagcgttcgggaaaaggcaattttctcggtcgcgacaactcccttgcatagtgcccttgctcatcacacataaaacaaatgatacttgcttcttttgagtcaacatgtggcacgtcaccatgggtccttcgggatgctggcggc

SEQ ID NO: 43480 - DNA, 319 bp, Oryza sativa
aagaggcttaacaacacaaccgaggtacaagaataaacagtactagtattttctgtaccatagatgaacagacagacagtattaacaagaagtcaacaaagaaggattaacaacacaagcgagatccaagaataaacagtattttcggcatccatagacgatgattcacatacttaattacatcttcattcacatctgagattttcacagacgcagaacaaaaccttcacaccaccgtatgcagataagctatcgctagcctacacatctactagtactagtcttcatcaggtgttgggaccccagacggagaggaaca

SEQ ID NO: 43481 - DNA, 1501 bp, Oryza sativa
aaggttttgaaggttgccagctggatgcgggcgcacccgggcgaaccctggaagactacgatagtgtccataccgaacgtcgggaggatatggttcgcttttggcgaaaccatcagaaatccgatcgtcaggaagcaatcgcccagcgtcgttatagttgtcacatcctgattttcgttttaggatttataaattatttaataaattattattagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaaatccgtaaattataaattgttgtttaaaaggaattattagaaatgattttaaaagcctaaaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaaccctctctctctttccctcggcccagtccggcccagtccgccgccgcccgaaaccctagcgtaagccgccgccgtctccttccaaattcggccgcgtctttccttctccggtgaaatctttagaggggaaatgatcttctcgatctcctcttccttttctcttttggaatcatcgcctaatttcatttggaaatccgtggattcgagttcgattcggatcgactactctctccgagccctagctttccttcgtcgtcgccggtcaccgtgggcctttgccgccgcctccttgcccctttaaaaggacccctgagctctcctctacccgctgccaccctcgccttcgcctctcgtcgcttgtagcgccctagcgccgtgccgcctcgcgccgccgtcgtcgccgccgctccagccgtgcgccgccgtcgctcctgtcgtcgccgtcgttcggggagatcgccatcgtggtcgccaagtcgccgccgtcctcgtccgccccttcgccgccgccggagaccgccggagcatcgccgtcaccgtcgacccgaaggttgccgccgcttcttcctcatcgccggcgccgtccgttgcttttccgccgttgttttggtcaccggtgagttcgccgcgtcgccctctacccgttggtgccctctgtttgcgtcgtcgcgccgtcgttcgccagcgagcttgtgctcccgagccgccgccggtgctgacgtcatcgctgatgtcatcgctgacgtcatcgtcgctgttcccgtgag

SEQ ID NO: 43482 - DNA, 186 bp, Oryza sativa
gtcggctcccaaaactaatgattcagaaaccgacatgtttagactgtatcaagccctggatcagtagattgatacaagttcaataatctggatcgtctttgcatacgtctaggcatagctttgaaggagatattattatatgaagtaatagggtatttacaagattgtgtctaactattacagcag

SEQ ID NO: 43483 - DNA, 203 bp, Oryza sativa
cttgttgtaatgagtacctccgactattgttgtactagtagtattgcgaactattccgtgttgtatcgtaatgttatcgtgatgagtgttcggactaaacacttttgtttgtttgtactcttgtttaatatgtgttagtaattcgcttatgaacatttattacttatgttgaactaattatttatatgtttctgatcaaccta

SEQ ID NO: 43484 - DNA, 175 bp, Oryza sativa
ataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 43485 - DNA, 265 bp, Oryza sativa
ggatttttgatctaaaggaaaaggatttatttaaatcctttttgagaaaagaaaagaaaataaagagggaggggaattagacttccctcgggcggctagggcgcggcccgagagaaaggggcggctcggccgaacttaacgggtcggccggccagagaaggcggcccaaggcgcgcgcgcgggcggggaggagagagggagctggtgggccgggtccatctcgcgtggtcccgagtgggacctgcttttcggtggctcggctcac

SEQ ID NO: 43486 - DNA, 526 bp, Oryza sativa
ccgtaggcccgctagtccgctgctgtttatttttgattgtcaggccttaagtgcctttgtaataatgtaaatattatcgatataataaagatgtgccttttgtatcatgtttgttcggtgtaccccggcttttcctgggacggagattaatacactagcgttcgggaaaaggtaaatttctcggtcgcgacaatgtggataccccaagacaacgcacatgccccgcagctccaaaacgaagccagtcaagtccagtccacgacgggtgatgctgccggccatctacaaacaaaacaaaatagaaaagcaacattttaaagattagattttgacaataaatgaagcagcaggacagagaaagactagaggattttcacaaataagaaaggatttttatttcgaaaatatcgctaaggcttgggatctacggctcgtcctagggtcaagggggctctgataccaacttgtcacgaccggaaataacccaacgggcgttccttacgtgcgtgtattattccttgtccca

SEQ ID NO: 43487 - DNA, 395 bp, Oryza sativa
acacgaaaagcgcataatactgttataaaacatggcattgtgccatcttctttgagtctttactcgaattaaatttgaaaatatactgttcattcattttttttcgaaatattcaggatgcaaattgttttgcagaaatataccatcgatctcgcacaaccgttgcgcaaaagggcgagaccgcgcagtctcgcggaacggaagagcggtctcgctgattgaaacagcgacactgtctcactgatgcaatgatctccactttttaattagtgattaattacctaattaactattaactaataatatttagtgactaattatcctgattagtgattaataattaattaattaatcgctaatcatgataattaatcactaattgaatcggtggcagt

SEQ ID NO: 43488 - DNA, 173 bp, Oryza sativa
  unsure (1)..(173): unsure at all n locations
gccaaatcagaaataaagctaaaattgccaatttatatggtaaaacaataagaactacatatatcatacaatagtaaatacacataatattttactttgggtaggcatggtgcagaatgcataaagaaaacacattaggtgnnnnnnnnnnnnnnnnnnnnnnnnnnnnnnnn

SEQ ID NO: 43489 - DNA, 238 bp, Oryza sativa
tatatcaattaagttagagatatgattattagttcagttagagataagattagatcagcccatatcaattaagttagagataagattattagttcagttagatataagattagattgaatccttacttaggggtcaagctataccatctatataaggatgggattgtgtctattagcattaaacaacgaatatcaattagtctaatctctccctctcaacagtgttcttctccctagc

SEQ ID NO: 43490 - DNA, 1501 bp, Oryza sativa
tttttagataacgtgcttctagtacattcgccgactgtgaaggtgtgtacacccaaatcaaattttctaattaatgtagcatggaaggtgtagtgtcctgttagacccctcttgtctagctcattccatttgccaatgcattttaccagaaattgagaatatcatgggcatgttttgtgaaccaaacagtagttattattgatcagatcataactaaggagaaaaaatagctagccaatcaaatagccaatatatccagcatttgcatgtattataacaatttttaggtaaggtgtgtatagacagtctatttttgtatatacaatacgacatgaaccaaataaaaattagttgcaaaaaactgaccgacatcaatgtgttctcgtcagcaaacaagcgcacccctccttttcaatcaaatagtaccatttttgttaacttacattattattagtcctgatactaatatgtaattctttttccggggacatccttcgagatgggttacctttagagtcaagtccaacccattcgagtcgggccttataaaattctagtgcgggttcatttgcgcatagatgtaaatctacatatatctcacatagattgtatttagttagtagaacacattttttattcagcctaggtagctcgtataaaaaatccagcctagctaattaatagagcaaaacaaaacagatttggagaatcagaatttactcagctggcaataactagcaaggcagctcgagtttattcctaatattgactccacacgctctcacggtgtatcggaacaaaatccaaaataagccataggtacatagaaatgcaccttcaacaaaaaaaaaagaagaagcaactactcccatgctttagaagccaggaatcatttgagctttaattctagtgtgcatataaaatccagttttgcatatgtgaaaagcgacaaaaaataccatacaagtgtgcttttctttatgtgcctatttgtacctcagaacaaaacacattcccaaatatactgatcacctcccattttcttaaatccaatacaggaggtatacattttctccaagaaaagtccaaaaaaaatcacagtgagcttttcccattatacccctcccacccatggagtatcccctttctcacccctttgacatgctgcagagtcaagtggggggtgtgctgcccccacacccctataaaaccagcctccctccaagaagaaaaagaaaaaaaaacccaagaaaatagaccagtagccctcactcctttttagggcaggatccaatgccatcaccaccattcctcctctctctctctctctccttttaccctttcccatagtctccttctctcttccaaatcaatcaataaactagcaaaagtcagcgcctccctcttatctcctctctagagcccaagaaaccaccaccaccacctcctcctcttgaggattttcttgatttcttctcgacggccatggaggaggagctct

SEQ ID NO: 43491 - DNA, 219 bp, Oryza sativa
ccattgctacgttgtactagttcgagaaccagcgagcgagtagaattatctctcgaacaccaatggaagttgcggtgcgagagattgctacgtactggttcgaggaccagcgagcgagtagaattatctctcaaacaccagtggaagttgcggtgtgagagattgctacatactggttcgagaaccagtgagcgagtagaatcatctctcgaacaccaa

SEQ ID NO: 43492 - DNA, 1358 bp, Oryza sativa
actagagatcgttttttactcccggttatttcacccgggactaaagatagcgatctttagtcccggattcgtagtcccggttgaaaaaccgggactaaaggggggttacgaaccgggagtaaaaaccacttctcccccagtgatcatatttatatttccagaggagagagaggagatgagagaagaaactatgtgcagcacgagctctaataaactatgtgagagagatagatatgttaggtattagtaatgaagtatatatctacaacaaactatacaataccctgctatattagttatagatgatgttttaatttttggagttagtagttggctatatcattaaaattgctctaaagagctaaccgccaaagaaataagcatacaaaacgaaacttttcataggaagtgcaccaaaataaaataaactttcaactgtcaaatgagatattatcatgatattcacattgtcgggagattcgtacacatgttacatatacagcctcacgaaaggtcgaggcatactaacagccccatctcggcatatttacaaaaccaaaagcgatctgtgtataaaatttttatatacgtgttctcagcaatctaaaaataaatgatgaaaagtaaacttcgatgaaaaaaccttaaaatcagcttcaaatttaaggttgaaaatttaaattttaactgataagtataagcaaaaacgaaaaagataagatcctaagctaagaagttacaaaacatatcatgtatagcaaatgatactacctgtattaacaggatccaaacttacacacttcttccagaattgttttctgaaatttaatatttccttctcctcaattcataacggtatagcctttttttaccttacccaacagaatagtaatgtgctaagttgacaagtactgtttctctggataaagcaggactatcatccactactacacaaacaattttcctggacagagatctgtcagggttatagatacccatatacctaatagtagttgactaaatctcggcaggacccactacataccatgtcctatacggaagcaaccttcggatataggagttccggataaggaaagacaaccagagttctacatggagacgaaaaaggactactcgaattgtatccatattggtttccctagttctacttagacaaggtgacacctatgggtataaatacaaacccccctagaaggagaggggggaggatcaacacccaacataatcgacacagaagccataatatagaagcctacatacggcaagacacgccgccggatattgacttcagggataagcacggctagtaccctacggtgtctccggatactgtcagg

SEQ ID NO: 43493 - DNA, 1501 bp, Oryza sativa
cctgatcgaatttggagtgctaaagacgattcgaataattcaccttatcgcgcgatccgtccccacggtttgcacaaaaagggccgcacgagtcacgcacgcgcacagaaagacttgcctgactgaacttctgacctgatgaagaagaagaagcaaagtcgtggagcaactgtggcgcacagcggtgaaaatgcagatcagtgtggcaatactgtgtccggttcaaaaaatgtgattagaacagtagtagaaaggtctggtccacgtccatatcatcactgtgcccggtttcaaaaatgtggaacggtactgtagcattagaacggtaacaaacgatctggtccgacccatccatattagatccaacggatataaggatgttgttcattctctaccttcaaattttttattcattctttactatttcgtccttaaaaaaagataaacctaggtttgtaattaggattggtttttattttttatggagagaaaaattcgtactccagatgtaagtacttgcgtcctgtttggaacttaccgtacgaattctacagaaattactttgtctttcgcacgaactgaaaaaaaaatagcttttcaaacaacaggttggggaggagatttggaggtacatgatacaggaaaactcattagcatataattaattaagtattacctctttcattctaaaataaaataagtaacaagagggttacatttatttcgggacgagggaataattattataaaaaatagatttattatatatatatatatagacattttttaataagagacatcatttttttttagttcggtaagtttaaacagaaaacgagaaaattgttgtttggagttcgattataactcagcatagtaaatgttccctgttgttattctccgatcgacctaacctgcaaaacactgaagtccttggtcatgaacgccctagttcatacggattaagattcagattcacgaacggattagtgatatacttcttggcttcttgctgtatccacatggccacaggccacatgtagtagtatgaaacttgaggacgacctgatcatttcttgcaatctcgtctataaccaccaaagtcaatataattttcgcaataaaaaaagaacactcgctattcggttggtctagtcgctctacaagtccacacacgaccctactcctaacctgtcaagtctccaccactctgcagcaactctgcttgcgaatccgggaaaattttgcttggcaatcgccgtgatattccgtgcgaaacttcccagtagtacaatcggcaactgcaacacggagccactcggtcaccggcaataaaaccctcgccacttcatccatctctcgcaccgcgcacatcgaatcgcatcgcacacacggcggaagcaacgccactagcctgacgtacgtacggcagcaatggccatcgccaccgagtcgcagcaggcgcaggtgcaagccgccgccaccgacgccgtcgcggcgg

SEQ ID NO: 43494 - DNA, 1501 bp, Oryza sativa
ttcggtcgctcgaccaccaaaattgccctgcactgcactgtgcggtgcgcctgcctgttcatcacagctttacaatgattgtgtagtgcaccatcctctgttcccgttctagattcagatgcatatatagcaaaggagtgtgacaaggttagggagctgtttgaatgccaaggtttcaaaaatcgtttgccgatcgaataccgctcccaaggggtttcttctgttttcgcagtaaccgactgaatttatcgaataaaataatctttgtttgattttttaaaaaaaacttgaccagtttatcgagtggcttctcaatgtgggagcgattcaactaattaccattgttttcaattataattgttggttttgtgaaccatgttgaatatggtattcactttgacaaaactttgaaatgctaaagagaaattaatctcattatattttctcagcagagcacaagttctgcaaaattccaatatgaaagttgattctacaaacgcttaacttattttcctctctctgttagccttagccaacctcctttttcaatgactaaaatactctccacattttcctttttagaattcttgacgaatgatatgtggcgcatgtgtttgactattgacgaatgatatgtggcggcagcccatgtggtaacctggcccagtgtcttgtggctttgtgcatgctggccctgcaaatttgatgggcctgtacttagttagcttcagtgctctacagtagttttggcccttcggcgagtcatttcacggtaaccactacagtatattctttattgatactacagtagtagtaagaaatactcctactaagtgataccccgtgcttcacagtatgtatggataaatttgtattaaatattatagaaattatagataaatatatgttaaaatattataaaaattacgtgaggatgatgattggaaatatttatgtgtaccatgtttgagtaagatgagatttaaatcgctatagaataataattgctattgaacgatgatatgacatatttagatgatgatcggaaatatttatgtgtaccatgtttgagtaagagataatagttgtgagcgagtgtcaactataagggttatcgtcaattggatttcgcttacctttcgagaagagaaaagaaaatagaggaaaagaatgtagaagccattgttataagacgtttttacttaggtaaaagtcaaactactctaagtcaaactactctaagtttaactaattatataaaaaatagtaatatttacaacactagcatagtttcattaaatctaaaattaaacaattttttataatatatttgtcttggattaaaaatactagtactacctttttcctataaaattagtccaacatagagtagtttgactttgaccaaagttaaaatgtcttgtaacctaaaacggagggagtaaatatttttttcaaatacatataaaaaatcacatacacatacataactatgcgcata

SEQ ID NO: 43495 - DNA, 318 bp, Oryza sativa
gcacatcgcagtccgcccccgcgtgctcgccgcccgccaccggcgagcactagctcagccttctcccaggcgctcacattcctctctgtccatagcagaggtattctggtcttaaaactttttaaagtggcaaaatatcctaaaaataacctattaagtggcattttatcattgccattctaatgggtgatatttcgtcgaaaccacacgaaaagagtggcatagcatattgtcctttttctccctctcaaccaaccgtcagtgcgttcttcctaccgcttgaattctcgtctcgccgcggcgattccacgctcccct

SEQ ID NO: 43496 - DNA, 196 bp, Oryza sativa
aatattactatatcattcctcacacatcactagccagaagtttatgattttaccacggccatgcagaaacttgagagacttgttatgtgtgaatcacaaataatgttattagtgatgggtggaagttaggactactcatctgttatgggccatctcattacacccatcacagatgacctttatctttcatggggca

SEQ ID NO: 43497 - DNA, 193 bp, Oryza sativa
ttaaagatagcgatctttagttccggaatcttagtcccgctttgcaacccgggattaaagggggttgcaaaccggggttaaagagggtttccgcagcagtgacatgactagtatataggggtaaaaatggagcagattcggatggatagtggtcataccatatcctaaaccatattttctaaacggattcaga

SEQ ID NO: 43498 - DNA, 460 bp, Oryza sativa
gtaatcaatggttttatcctaattctcttatataatgtgcagtagaaaatttttgaaaaatacagtcttaaattttataacataaataccttgtaaatgtatgtaatttgtattgtaaaaagtttaactgtttttaataaaaaaaaatatgacaccacaaatatagctatttatttcaccttaatccaatcatggtacggctcttctcactcagcctcgttgcattgcccgctctcacaaagcaagttgcacatgtgtaggactggaactacctgacattgtcgaaaacaaaactgaaattttgacatctaaaaccacaagttgacttaaaatttgattacaaggtagatatgcacgcatgcacagcactacaacgcaacaccacactcacacaccggcgaatgcgatgtgtatagtggcgccacacacaacaatagaggccgtggatagccttacagca

SEQ ID NO: 43499 - DNA, 1501 bp, Oryza sativa
agataaaattacttctaatggttcacaacaaaaaattcttttggctcactgtaactgattacgtttccttcgtctatttttgtacaggttactaagaagaaagacttgagtgatttttactttggtcttagtaagaatgttgctttcggtgcacagacacatgacaatacaaaacatgctaaacctgaaaagttagacgagaaagttcaagatgctaaaactagcaaggttggtgctgaagtatccgatcgctctcctaagcacaaaagggactccggtgaaggagcagagacggccaatgaaagtagaagtgtggaagaacctgctacaactcaatcaagggattcagctgctgctagatctaccgagaaaaatgcagatgtttccttggatgctcctcagacccagacaccagaaaatacccaaccagctcctcagacccagaatccacagaatactcaaccagcacagatcacggatgaacactataagagaaatgctgatgcacttgctgctgccagagaaagagctctggcgcggaagaaagccaaagcgcagcagatatgaagtacgaggcagagatactcaccgagttttttcttataggctaaggtcatcatattcttgtttgaggtttcgggaagactgtaaaatgatggatggtttcacccttctagcatttccaggagataatccccttggtttgatctgcatgatgctctaccttgcttgatcaaaatatatgtgcaggcaacccttcaacgttagaatatctcgttcggcttttctgaacatttgttctgctgtaagatgggaaataacttagcacagtgaactgaaggttgtatgcatatgttctcattcatgtataccgttgtacttttgtaacttgagtgattgaacgcgatatgatttctgcaatggcacaaattactactactagttacactccattccatggtgaacgggattactttaattttctctcttctctcaaattcagaaccaaaacattgaactttgtcagttaataacaaggcataaaagttgtttattcgactttactggatttcccttttcattttttgaactggcccgaattgcattttgagatattcgaattttgaaacatcgcatcttaattagtagtagtattattttttttcatcagtggttaaatgttgctgtctgcaattagtgcctgaaatgagccgctgacagtctgaaactctgaatgtcccgatagcgatggatactagccccacgcagcggaaggcgatgactcccctccgtttcagcttcctatcactcaccgcaggggtaaaagggggaacgtagcctacacaacacgagcccgaggtctctcgtcgactcacgcgcgcacccacccacccaaaaccctagcgcgagtggggaggggcgagggggtggtagttgtagtagcagcagcagtagagctaagctagggttttccctccccccgcgcgcgcagcaggcggca

SEQ ID NO: 43500 - DNA, 640 bp, Oryza sativa
tgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaa

SEQ ID NO: 43501 - DNA, 1501 bp, Oryza sativa
gagacttgatttgggcccaaggttgctattctggagcaatggaaggatttaggttggcatcattaccctcgtgacagtggtcacatatttctgagacccctggagaatatacacgacctcaactaatcagagatgggtgtacatatctctagagaaagaagaggtctggttctgacttctgttcgcaggttagcggtgccatgtatctacaaaagagataaaaaaaagttatcagactgcctggtttgctaaataaaagtgaattagttgatagattatgagaatccactgtttaggcggctgcgaccgtggtcaccaacagaagttaccctagagtgcaaagtggcatctcattttggttttgtgcccctgccccccctgagtaacgggatgtggtattgttttgacatgtggatgttgatggtgtgcgtcttcctgttaatgtttcaccagataattatgggggtattgttaagaatgatgatatgatgtacagcatcaaaggtgcttgctgttttaatcttgagcaagttgtcgtgcttctatgaaatgtgattgttaacaattcgttgggtgccttaatctcttctttctgaatgtatttttctcctgctaggaaaagagcagttgttcttgtggagctatggcctgttcagtttttgctacttttaacactaccaaaatttggtactaccttcattgcacaatgtaagtcattctagcattttctacatttatatagatgttaaagaatctagatatatataacatctatatgaatataagaaatgctagaaatgctagaataacttatatcgtgaaacggagggagcagtgttcaaactacataccattgccaatgctaacctgttgaaaattattaattttgaaagcttctactcttaaaaacacaaccgaaatttgtttaagcttggaaaccaaatatattcaacactatcaagtgtttaaattgttactatctcgcagttcagtaaaattttcattgcattcgatatgacaatagctaggaaagaaagatctcaatattagtgtgctcattaagctatagttttcgggattttaatctcacgaaaacgtacggggccagtttgtatctcatgtattgggcctcgaaatctggtatcgcagcccaattcgcggaggtgggctgtatgggtcgcgctggattttagtatcagtggatccaacctaaaatacccatctggatttcgccgttaactcctctcggagtctcgggcccttcgctcctcttcctcgcgagtcgctggacgaggtcgccgccggcgaccctcaccgccgtcgccgtcggtcgccggctcgtcgcccctgcttccttcgctcgctgcccgcctcatcacgggtctcctcccccttgccgaatcctagggatttctccgcgtcaggaggcctcctccccttgcccgagactagggtttgctccgcgtcgaatccgcgcaccacctggacgccgccgccgcga

SEQ ID NO: 43502 - DNA, 502 bp, Oryza sativa
tcctgtccccagtgtgcatttctgtttgtgctactgtttgtgtattgtatgctcttatatgttttatactccctctgtttcatcttataagtcgttttgacttttttctagtcaaactttgttaagtttgaccaagtttatagaaaaatttaacatctaaaatatcaaattagattcattaaatctagcattgaatatattttgataatatgtttgttttgtgttaaaaatatcattatatttttctaaagaagtttgactaaggaaaaagttaaacaacttataatatgaaatgcagggagtatattttatttctgggctattgttgtgagttttcatctattctttttcaacctttgaacagtgcactgtgtctcagtttggttattttgggtttcatgctgcattgttataaaaagtacccagttcattccgcacaaaaactatgccatgaggttatgacaagctactgtttttgtctttttttcatgtgatcttcagc

SEQ ID NO: 43503 - DNA, 1173 bp, Oryza sativa
atatgcattttgagagtttagggacctatatgacacaattctacaagtttaaggaccgccaatgcactttactctttaaattattagactgtttctaaaaatatgctcttggatgaatatatgtctatgttttctaggcactttacaaaagaagacaaatactgctgcatttggtcataatatttgatatagttggtgccaggggggataaagctctctcaaattgtcaccttgccgctccttttcgaagacagggaatggcgagctccaatttagttctaaacaaattggccaaaattagaaactctaacataaacttagcctaagtgcccaggtttcaaagaatggactgcaacctacagctgaccacacacaaatctagttcaagctagaaatctaaatgcaagagagtgaagagagagaaggaatcaaacacaatcttcattgatcctcattggagcacacacaggagtgttgctccctttcaacggcgctctcttcttgatggttcaaccccaaacccttcacaatcacatcgggtcttccacaagcatcttgaggcgtcacagggttcgcctctgaggctagctaggcatacaaagatgtcaagaacaataagatgcacccttcacttgaaacactaagaacggaactctcggtgggcgcacactaagccactatgagcattaaacttacaaggatttgatcccaaataagctcaagggactctccattaggttgctctattgcactaactagccatttgctaccgttcgaacatgtttctagaaaatatattgggttggatagtctggtgtcgcaacggacagtcaggctctttacacctttcaaacggtaactaaccaaatagccattgggctataaagagccaaacaatctggtatcacttggactgtccattgcccattgtccggtaccgacactagaccatctggttagttcaataccattgcccagtgtgtaggatcaaggagaccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaataacacaaatgtaaa

SEQ ID NO: 43504 - DNA, 1501 bp, Oryza sativa
ggcgacgattgttaacattttaggtgagatgttaggaggtttggagtgatttgtctgtccatgatgggggtggtatcaatcagatcgttgtttggtggtgcgattggctgtattggattccatgatttggtgccaagttgtgcgtgctggattcgttcattttctgtttcttttttagctggcctgtgactggttggcatgtgctctctgacgtgcggtggttttgtccttgtgacaactattgcgcctgcttgcctgctctctgtgtgtgtgttggtgctcgtcagcactactgactcgatgacggtttcggtttctctgtgggccgatgcaaatggtcattgttgtttttattcccaccttgtcagtcaaaaaagtttcaaacgactttcttcctgtgaaatagtagaggtaggccttgtttagttctaaactttttctttaaacttccaacttttccatcacatcaaaacttttctacatatataaacttccaacttttccatcacatcattctaatttaatccaaacttttaattttggcgtgaaataaacactcccgtagtagtagtagtagtagtagtagagctgataagtatcccttccggtcataataataatcatttgatgacaagatttgagcgctttgtgtttttggtgacatctcggtttaaaagggagtaaatttaattgtggtagacctgatgaacctcaaattaagatgcatgccgcacggtatataatccggattgtgttaagacggacgtaatcctgtctgcaacataagggagagcaataaatgtgttgatggctcgagtttagtcatttttaacaagacttttgatgttgcatggatccaccgttgtttatatccgataattttagtgcctcgagtagtgagttaagttgatatgtgtaggtaacttgtgcacgaaagaggatgctttggatgatctgatctgaaatagtaagaaactacgaagatgcgtcaaaaaccacgcagcacctaaactgggttgggcctaattaggctgtactaagggtgtgttcggcaccccttttcccccttttgtcacgtgcatgtttttcaaactgctaaattgcgtgttttatttgcaaaaagtttctatatgaaaattgtttaaaaaaattaaattaatataggcaaaatatataaatagtagaattaatatttccttaatagagaacatatggaaaatgattttattatttccgtgctataaacacatctccatcatcacgcaacaaagtaagcctagcaatgctttagttttccttcaaggcactaaacgaacgtaagatcagggcatccaggaagtgcccatgcgtaaaaagttggtaaaagattattttaactcttatctggcataaaagtttagcattgacaccgctcaacaatttaaaccaagaacgccaacttagatcagatgcaatgcaatggtgacacagctcagcaggtcttgcacgctttaattctaga

SEQ ID NO: 43505 - DNA, 1501 bp, Oryza sativa
cgcctctacggagttgagattcagcacccgttggaccaatatcttgaagtcaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctccttgcttctcgcgcccactatttcgccccctcgtttctcgcgcccacgcttccactaatcccattcgcccgcttgcggcgcatgaggtggatatgcggttgtggcagtcgaaatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgtcctagctaaaaagccgggggctactgtcggtgacatgggatcaggagtatcatgactagaggtttgaggcagacacaatcgcacacgtggcctggtaccccc

SEQ ID NO: 43506 - DNA, 716 bp, Oryza sativa
gcaaatgtatatatcataaaccacacttaaagtactatgagtgataaaacaactcataacaaaataaattataattacgtaaattttttaaataagacgaatggtcaaacatgtgagaaaaagtcaacggcgtcatctattaaaaaacggaggtagtatataactacacattttcaccaggggaccacctagctgcttgcgatcatgggtcagtgacaatagatgatgatcatcgcagggagacctcacccgcttaccaaaatcagtttcactggtggctaggttatacggacgactagcaaaaatatttttggcaattttgtttttcattttcagaaccgaccaccagaaaaaatatttttttggtaaaatatatatatatttttagaaccaaccaaaccagattcacagtccagatcagtttgtctctagtcccacaatcataaatccaaatcgaacaccacatcccacaatcacagattctatgaatttgcatctaatcccacaataacaaatccacaaattaaacatcacatcctccaatcccacaaccacaaattcaagaaatcacaaataacaaaccataaaatgtatcacactaagataaaaaaatcgaccacctcaacgcactctttgacgccggcgtcgagctcctcttgccggtgcggaggggcgatgtcgatgtcgctgattagttgtccttgctgtggccgaca

SEQ ID NO: 43507 - DNA, 1501 bp, Oryza sativa
actaaagatcctcggccccctgacatcaatctgacaggggatgaaccgagactaaagaaccaactgggactaaaaatcatagaatgcctcttgggttttcaaccgggactaaagatcatttttagtcatgggattattatggttttgggtcgacccagcaaagatcatttctccaccagtgtaatatgatctttctgggagacatcaactttctagcaagaaaaggttacagagattagtcaactgtgactacgattcatgcaaagacaaaaaatactactccttccatttcgaaatgtttgataccgttgactttttagcatatttttgaccgttcgtcttatttaaaaacttttgtgaaatatgtaaaattatatgcctacataaaaatatatttaacaatgaattaaatgataagaaaagaattaataattacttaaattttttgaataaaacgaacggtaaaacatgtgctaaaaagtcaacggcgtaaacatttcgaaacggagggagtactaaaaatagatgtaccgaccagatcggtttcgatggcacctctaagtttttcatcctcaacaatcaacggttttccacatttacagtatctcaagatgcgctcagcaatctcctcaggaagaccatcacaatgccacactgtcgactcatcaatcttaatgaatttgatcaataagatgagctggtaacaacagtcacagcatgatattaggtatacaaaggttaaggcgcaaagtcacaaatgaaacataggagccctgcatctttccaacagattgctttttgtcattattattttctggtgtagggtggctacttccgcattattattttgcagtctaagattatttgattttagtcgtgatgtacttttagttgtagcaaactctttaaatgacagtgatagccaaggaaaccacataaaactaaattaagctagtttatctacggatatgagtaataatcctggatgaaagtaccaagcagaaaactctctctaatgaaagtaaatatggtagaatcaggaagacccaacttgtctaacaaaatcaaacttggcaaaacgcgaccacagatgctgcaaaataacaatacagagtgaaaaatcataagaataattacagacaataacctgcaattaatgatgacttgggatatatattgcgtatacatacctgttcagaacaaagtgtttgaaatgcaacgaagagagcgaatcccgacggcgtcttcagcaccactagattgtccacgtattcgagttccatatatacgctcaggccttctttaattgatccagttcacaagagcacaacaaattaatcctagttagttcagcgcacactcaactcgattagggcaactattacagtgacgctttgcatctggatatcacaaaaaacgtacattaaaatcagtgggactgtggggtacaccagtttacaacaatatatatatatatatatatatatatatatatatatat

SEQ ID NO: 43508 - DNA, 1501 bp, Oryza sativa
tagagtggccgacgcgttaacagccaacgaaagagtcatcagtcacggaccgcatccacgactgttttcacatgtacgttttgctagctacaacaacaatttcaccgtctcctagctcagatacgcctgctacaacaacagagttgaaagcatttgcctcatactcctccgtggtgttggaaacgcccatgagtcaattgggagcccaagggacaggaaactccgagtcaaccaaggcggctgttggtgaggtggtgtactccgacgaggtttcgacacagctagtgaagttggcaacgactaaggtactttctactgaggttgctgtgcagctagcaggaacagatgaggtggttacgaatggcaaagagcaacaacaagaacctgtcagcattgcacaagaattacagcatgtttcagctagcttgttgtctcccgtggagcatgtattggattgcaacgtgcagtctgaattgttccccgagaatagccggcttgcaggcgatggaagagtagcatcgactaagaacttgatggcagtactagcaaccaatgaagaccaacttagtgcctccagggctgccacatctaaagcccaggattcagcacaggcagttggagctcgatccccgacaagaaggcgacctcgtcgcccagtggaccctattccaactaggcaaagtgaaagatagaaggcgatagcaaatgcagatgcgccggtggcaaaccgggcagagctgctaaaaaaggttcataaccttgagacgctaacaggtaacaagtttaataccacaaattctgttgtttcaattccagataagactcttgctacaaatttttctaaattaggggtttctctaggaaagaatgatttacaaataaaggaatccattaaccagattaaaatttcagaagtggatagatttgctactctttatagtagtgctgtagcgtctactagtaatgtagataaaaacaacgatgaattgttaaaattgtcttctctccagcacttatgtagtgactggctagaagaggctgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatgattcaccccttcaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttctaagaaataaagaggatggtttcaaatgggtttttaatggcagtagc

SEQ ID NO: 43509 - DNA, 266 bp, Oryza sativa
cttgttgtaggcaaatagatctaggatttactttgctatttatgctgactccgaaaattttcggatatatccgaaaatttcggaaatatctgaaaattattgcttccgcttttaattgaattttttgaattagcctattcaccccccctataggccttattgacactttcaattggtatcagagcctaatctcctaattcggcttaaccgcttggagagatcatgtcgggccaagtgggggatgggaataatggtgataagggagc

SEQ ID NO: 43510 - DNA, 1501 bp, Oryza sativa
gatggagttggagtgcttgatttgcaggaacaatggtggtggcttgggaatgggaagacgacgacaacggtgactcagagactaggagtgatggccaagccttggatttgctggtagcggatctagctaaggagggagagcgatggcagatctggtagctttgtagtcgatgactatgttaggagctcacgaagactcgggaactcagggcagagattgcgccgaccgcctcgttgtgagcttatagaggttggatccttcggtggtggatctagattcagccgttccaaccctcatctccaccgcaagcttgaggcaccagacctcactgttgcacaagttagattgtcttatgttctcttttttgcttattgttattgtccctgtgcacaacttttaatttgtctgttccttttcttagcttgattgttctcaacatatggaggcactgttgatttttgaatgcgtatgatttgttaaatggtgaatttatcgtattggtatttatttacatttgttttcaaagtgagtatgacttgccattaatgccagttatgactgataataaagggccggtcagtgctgtgtgcaggtcgtttcttgatgaaatgctaatgtcatgccaatgatggataacccctagttgttttccaaaacaaatgtgttaccttctttctaggctgttttaatcatatagtagatagatggagtttcggagaaggggtgcagctgcacaaaaccccaaacatgctttctggctttttagttagagcaacaaaaaatacccgtgcgttgcaacgagtgaagtatattttaatcttattattgttatatggtttagttaagatgaaattcactgtgagagttcgcttatatatatatatatatatatatatatatatatatatatatatagaaaatcatgaactgcagttaagagtccgatcgtctcaagttagcatgcgattttttttaaacagatttcttatatgattcattctgtattaccaaaagtgaatgatattagaaactgactcaaatacagatatgtattttcaaaagcaaacgaacttaaaaactgactcttatatggataacataccaaaataccgacaaaaacatcttctatttttataatagagatagagatagagattgtctactagtcggcccaagcacacctctaagagcaattgttttgtttgacagaaggacttcaagggcaggaatctcggtgagcaacttctcttcgaccacgcgaacacctatccattctgtgaggctgtgatagtcatagtccctggacaaagcgagtctccatttcgcctacaaacttgtcgtcgtcaagcgcgccagcacaaccaaaattaacttgcgcgccactctgcctctcaacccttcaaacacctagtataaagctcatcgtcgccgcgagcgagcttgctacctccaagtcaaatcaccaagtgattcgaacccatggcgagcatgaatgatcaac

SEQ ID NO: 43511 - DNA, 767 bp, Oryza sativa
agccggatagtccgacatgcattgttggacagtctggctcaacgtttgtttggctgtcactgtgtaagttcaagtgccttaatttggttttggtgattaatgacaaatctagttatatgagattaacatttttatgagcttttgtttgactagtctcatttggatatgaaagtaaaaaatgattagaggtatgtattaaacttcacatattctaacttggtctctcttgtggatccaaaatatagtgtgagctccctcattgatcttgattgattatgtgcgtatgtgttcctttatatccatatgtatgcacatcttgagggggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttagtgatagatgataaaccgatgtttatgggattaacctctcttttacataagttttcaacaaagttatttcccgataatgagatgtggtagatatgcattctttggtgatggaccttaatcatgacaaggatgaaattcatggagataaagcaatatgtatcacttcttatctcctactttttgataggttcatatatatgatttccatgttattgttatataagtgtgagactaatgtttacttgagtcttatcttatttagtctcctttacattgagaaca

SEQ ID NO: 43512 - DNA, 949 bp, Oryza sativa
ctctttcaaccttgttcttggttcaaatttcaaaaataattcatccttccttctccaattcttccattttttttccttttttacatgccattgcatggtttactcctctatctgccatcacctgccagtaatctgtatcgcatcccgtttcttcatttgaacacatggtgacctgcgtgctttgtcgttgttgcttttgcttgttcttactgttctctggtgatactcctacatgggcgtttgcagataagatcggtccgaccatggctgtgctgaggctcgacgtccaacgaaacatcgaggtacaaaaagaaaaaaatcattccttctgtacctaatgacctactagtaatctgcatgatcttagagtttggctactgattacaaatatttagaactagtatttaattttattgtcattacatatttgtccctaaaaatattttcgccatgttacagtttttcatcattaccatttcttagcgtaaatcatgataaaaaaatacatatatctgcgagatcgtgaaaaattatgcgacgaataaggagcttgtacagattcaaaattctacgacgaataaggagcttgtacagattcgtgttacatgttatgtctaatttgctatattttaagacagagttagtagaagaaaggttttactagtcaagcattagttccctctctctcaaaaaaagcattagttccctgatcagatgaaaatcctagctaactaaaaatgccttcttgtatggttggtaggcacagagtctcaatcacacccctacctgctgctcgacttgagagcaagaaaccgaaacaaaaaaggttgcaagttgtgaatccaaataatcataccccaagaattcacatctactactaattttatagattagagctgttggcgcggtcccatgtagggaagcgtaatcctgtggctgcttcccctgt

SEQ ID NO: 43513 - DNA, 648 bp, Oryza sativa
gtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgttacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattactcaactgttttgttaaattctcaaatgtttgctaaatactgcttttgcaaatgcaaccctattatgccatcctttgttatcctgtgcacttacatatttgctgcgtggcttgctgagtatgtcatatactcaccttgcaatcattcatca

SEQ ID NO: 43514 - DNA, 260 bp, Oryza sativa
tatgaatctatttgatcttccatagacaaccaatttcggtagcaaaatggtactttcatgacagaagaaacacaccgggatataccgataacagaactgataaagacatacttaggtatcctacatactaggttctgttaagtccccaattcacaatttctatggagtatcaagaggaaaattgagacatgtactttgtaaagtatgcaaacataaggagcacaaatagcttcccctactacagtggctggtttcagttt

SEQ ID NO: 43515 - DNA, 1501 bp, Oryza sativa
aaaaggaacaaaacaacaagagagggacaccgaagtttgcgtctgaaaatgccccacggatgaacggacggatgtgaccagagcagttgaaggcctgtgtgaggcacacgcaaaagcaaatcttgaggagaaaatgatctgatcggatcagatatttacaacttttgcatcgagaggaaagccctaatcctatctcctttgttttatctcttgtcctgccttccaaattccaatcagtcgccgtctcctagtccaagaatcgagagcgccggaaagagaccgtaaataatactatgatgcaaagactttgcatgccgagataaggttcctggtgtttgtggtgctggaacttgcaagtgattcctctgcagttgaagctgcagttataagctcacgcaaggagggctcgtggtgtgctcgaatcaatatgtgtttggctgaagggacacgatgggtcaggatagagcgaacccatatttcagaatgtttggtttgatgaaagtcaggtcaagtcaacaccattggagtcatgacctgataattctatgctagtagtacacaccttgaacaactcggagcaggggcggatccagcatgggggcggcggggtctcgagtcctcacgaagaccccacattttaccatacgtagataggagtggggactataactttatctataactttatctagtttgcttagaccccaccgctatttaaccgccaccgacttggaggagtaagaagagattatcggctgtcgaatcgtgctttgagattagtgcgaatatccagaaggtggggggcctcaagaggcagctctcaactttggcaaagcaaagcagtgactgtgagcccagtgacagtgtcaaaaggaaaattaattagaggttagcctagctatctacgtggcttaattaaaacgaccggttgctttcggtggctactggctagccgtgtggccggcacgggacaggggaagcagccacaggattacgcttccctacatgggaccgcgccaacagctctaatctataaaattagtagtagatgtgaattcttggggtatgattatttggattcacaacttgcaaccttttttgtttcggtttcttgctctcaagtcgagcagcaggtaggggtgtgattgagactctgtgcctaccaaccatacaagaaggcatttttagttagctaggattttcatctgatcagggaactaatgctttttttgagagagagggaactaatgcttgactagtaaaacctttcttctactaactctgtcttaaaatatagcaaattagacataacatgtaacacgaatctgtacaagctccttattcgtcgtagaattttgaatctgtacaagctccttattcgtcgcataatttttcacgatctcgcagatatatgtatttttttatcatgatttacgctaagaaatggtaatgatgaaaaactgtaacatggcgaaaatatttttagggacaaatatgtaatg

SEQ ID NO: 43516 - DNA, 154 bp, Oryza sativa
  unsure (1)..(154): unsure at all n locations
gtatctccgaccacccgcgnttngccgcctcctcctcttcctcctctcgatctctcccgtcctcctcctcctccttcggctcgtctccttcgcccgcgtccttcgctcctacggccttcgccgccgcgtctcctcctccttcgctttcgccgca

SEQ ID NO: 43517 - DNA, 1501 bp, Oryza sativa
gcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgatcgaccatcgtgaactatcattaagccatcatgaaataatagtaaatcattagttatcccataagtgtactaatgtttctaagcagggctaagcaattatatctaatatctagttgaaccaatataattaaagctcaactagtcaaattaatataccccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcagaaaagagcaaaatcaccaaaacagcacatgaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttga

SEQ ID NO: 43518 - DNA, 1501 bp, Oryza sativa
gatcccatggccttgacatagcatattcttgaacttgggcctcatgaaaagcagtagcttgcatgaagtaaagtatggctactagcagtttgatagtctcaagatcccaaagctatgtcatcttcatctctgttattataatctgctgaattgtagatgatactttgaaatccaagtgacgtagatttaaggaataacctatggagaaagtgaactggaataggctctgatcttgacagcacttgcacaaatcatgaacttgatttagttcttgatctccccatcttccaagagcaggccaagagcgtagtttaattagctttgtcattgaagccatgatctgcagcaatggttccaggtcagccctcaaactaactgggaagacaatttgcagtggtcgtagttgtggttgctgcatgtccttcctaacatgtaaaccatccaagtgatgcggatgaaaaataaattgccagtgcttttcagtatgcatggtcaacataagctgctgcatgaaccaatactccataatgacaaataaatcaagaactgcatttgatttcctctgaacactaagtccttgcaaaccaaattctcctggatcccaaattattcccaccaacagaatatattgcagatgaagtgtttcagccaaataagattgcatgtgaagctcccgaagatttactgagcatcccctcacatcaaagttgctcttggcaatcaattttcccatataagtcaaccattgaacattttgcaaactatcccaaggtccaaacaaaaacagccattgaaccttactcgatgtcctaccgagtgagaaaaatgctccaacatcagttttatctcctgcttcaaaaagtgctgaccgaggattcttcttgccttgtttccgtagcaattgcccctgctcctgaacaatagtcacaccaatgcgaagagaaagatcaggtagtgaccatcgttgtaggagatacatcacgtctccgctactttcattcaattgtggattaggccatggttgtggctggtgctccactcgatcacctttgcaattggctttgagaaggtggccaattccatagaaacttcactaccacgccttcactgccttgacttagctgtggatcaggccatggtaagggccgagaaccgaaggtcatctcagcttggttccatggaattactgctctccaaggtggtactggtggtgagctagctgtgtattctgagctccggtcaaggcaactatagcaagtcaagtaaacgacagaaatagcttgatggccaaaccatggattgttgaaggatgtttgcagtaatgtgaacttggaattcacttcagtgagctcaactaaatcctcggtggctatgtcatcatcatcatcattgatcatttgttcattgcctttcgtcaaacacttggtaggtgtccccatacacgactcattagtatcaaccaagctaattgaattggcctcctttctgacctccatgtgtt

SEQ ID NO: 43519 - DNA, 159 bp, Oryza sativa
tggacaagaatacgtgattcagtcggtgacaggttcttggcggctcgttttgcgtgttggagatggagatttggagtggatgtccctttttacagacctagattagctatgataatgaggtagcagtcagcagtgaactcaacttgcctgctttgcagg

SEQ ID NO: 43520 - DNA, 1501 bp, Oryza sativa
ggaatcatcaagtcacttgctgttgcctgtacagaagttttgaccaaataccagttttcaccggttttgttagggcactaatcattctttatgacgaaatggactatgtttcaggctactaggatactaattgttaattcgtttggacgtgttggactacgttccaattaatagacgtcatacctctaaacctgtaaatggatttttcattagagatggatggaatgcttgtaagtctgtattctgtcagccgattggaattgctgtgttaggtttgttgtgtcctcatgagttatgaggattgaggagtgttgaaaggacaactgtttgttgtgccctcatgagttatgaggattgaggggtgttgaagcattcaaggattcaaggttctttgcttaactgagaagtccagttttttcttttcttttcttgattattgactattttcgacatcggctaccttacaagtacatgtgatgcttcatgcttgtgttcttttaaggcagtgcacttgagggtataactttcctgtgtcatgtgcttgtgcttggtgattcctacatcctcctggcatttatctgtcaagtctggatcatatctggtgccgaagcttctttggttaggtccatacttcgccttggccactcctttacctcagtttactgcttttgctttgttggtttgccggctctttgcacactgctgtctcatgctgcaaagattgttaatgttgagtacctgtgattacatggaagccttttcttcaatacgtactaagcattagctttattcagccatatgggtactagaaatatatatttagtacatctgtacataagcctcacgggaattctgcataatctggtatgctcttactggacgactttatcagtggtatcaacgttaaaaaccatatttaacttgaataatatggttgctttggctaatcatagtatcactcatgccccttttcagggcatttcactcccatgttggagaaaagaaaaaagaaaaaggcgagattctatgcttatggttccgtggtttgttctttcgaaatttggcatccataaaggaaaaaaaaaaagagaagacaaacgctaacagtgagggaataaaggattaaaaaagtgaataaatgattaaagatgttcacttcttactaatcatgctcgacaagacaacctcttttggctgggaaacaagaaggaaaaagagggcacagaaacgatctcagcgtcgccgattaatattttatcctccgttaaacactgatatggaggagatgttgttctttttcctgcaaaacatttgtagtagatgttgtaaatcaggtcttggttgctattccagtcaatttcatcatactttattcgttcctagttacatgccaatataatctttcggaacatgtgagaattgttgagagaaaaatacccgaatgccggctacatcttgggccacttctggctgccattgattgcatgctctagacatcgca

SEQ ID NO: 43521 - DNA, 1501 bp, Oryza sativa
tgaattcaaatattttatatatatgtatttccatacataaatttttctaactttattttcttatttttttaaaaaaatttatggtgtagtaggaagagaagaaggggaggaggaagggggagaggagcgtatcgggggatgggggcgatcgctgggcgattacccgcccattagccacacatcatctataattcattggattctacaaatcaacatccaatcatcttccttcacattatttttcataatatttttaacatatatatccattatttttataatacttaacatatattcatccatataatcaaagtgcgagatatcatatttcatctacaatctcatacagagtctaccaaatgtatttctctatgaacatagtttgacaaatcagttttatttgttgttaataactaatataattttaacttaggaatttccccagcacatcgtgggcaattcctagtgattatagaaacatcaaagcgtggggaattcctagtgactatagaaacatcaaccaaattaagctcctttaacttaattttctttgatgtgaggcaataacatttgagcctctctaccaagtggcaagtctcagtaagtccgggtgtgtacttacccacgataacactacgtagtccatccgtcttataaaaaactaatctactaccggatgtgatatatcctcgtactatgaatctggacatacatctgtccagattcatcgtactccctccgttttgagtttttgtttgcaacgtttgaccacttgtcttattcaaattttttaaattattatttattttatttatgacttactttattatctacagtactttaagcacaacttttcatttttcatatttgcaaaaaaaaattgaataagacgagtggtcgaacattgcaataagaactcaaaatctcttatattgtgggacggagggagtattagaatatgtcacatctagtgctcgattcgtattttatgggacggagggagtagggttgtgccaccaaaacaatttaagttaaattaatataaacccaaaacaatttgtttcgattatataccgtgtatatgcatggcaatgtatcttaagcgaatcaatttaggctgtgtttatttcacttcaaaattagaaatttggttgaaattggaacgatgcgatggaaaagttagaagtttctgtgtgtaggaaaattttgatgtgatggaaaagttgaaagtttgaagaaaaactctagaactaaacccggcgttaatgccaaaagtatgaataaattcgaattcaaaaccgtgttcagaaacttccggttccggacaaaattatttagcactgaccagctgtggaagaagattccacacaaacccacccctccctctccccttccctcctccttcctaccccgccgccggtgcttgtcgccgccgccgccgtcagagagggcgaggagggcggctcgaggaggagcagcagcagcagcagcaggaggagga

SEQ ID NO: 43522 - DNA, 279 bp, Oryza sativa
aaaattgaacttcacttgataggaattcatgacatgaaataaagattcattttatcacaaccaaacttcaaagaataattggaggataacatatcatagatcatttcatcaaacatcagcctgcattgcagaccaagtccacaaactaatataattttctgaaacactatactcatataatagataatatgtcattgttgtgtggttaatatgtcaagaaacactaatggaactaaggaatagaactgaccacaatggcagctgatgtttaatcaaaga

SEQ ID NO: 43523 - DNA, 479 bp, Oryza sativa
ggcagtggcacagctatgctcagagcggtcgcgagatggggagagatggagatttgcctcgtgggtggcggccggcgggggagcccgcgcgctgctcctccgccgccgcgtcgcccgtcgccaacgccttgcgggtgccatggaggtgggctgcttgcgcgcggcgtccggcaggaggagcaggagcacggcagcgaccaccaccacgcggcggcgacggcggaggtggggccaggaggtggctagcgcagcggcgatgggtgcggaggtggacaagccgacattattcccgatgacaaggcagacaagctatcgctgccgaggttagaatggagtttcgcctggcggccaccgtgccgtcgccggtgctcacgggcgcgtccgactccatcgacagcctcgacttcgaccccaccggccaccacatcgccatcggcggcatcgcccgaaagatccggatttacagggtcgccgagcca

SEQ ID NO: 43524 - DNA, 1501 bp, Oryza sativa
agccctttgaaacaagcacaaccggggtcatgagaactaacctttccaacacctttccccttaacaagaggggcagcagcctcattcttctcatccatcttttccttgtccactacctttttcatctgccaacaacactaatttgtgttagaaatgcagcaaaactaaccaaagaaaaaaaaaagagattggtgaagtggaacgatgtattaacctttcactgaaacacgcctctgtcaagcggattaggctccgaaataatcttggtagactcgtcgtcagaggaggaggagatcaccacaacgtccacctccttctccttctctttctccttctccatcaccggatcctcccctctactgccaccaccagcagaaacggcttcgtctcctccatacctgaccaccttgccctcgtactccagcacaaagtcctcgttctcgtagacaagcaagttctccaagaacaagcggtagtcatcttcgatgtcggcgctggcgtcgtacacggcgggcaccgtgttctcctcgcgctccttgcgtacggtgtccggggaggacgcggcggcggcggcagaggaagaggcggtgcgggggttcggcttcggcatcgctggagaagatggggatcttggggagcggggggatgcgtgccaaggaagcggttgtcgtgtgtgttggcggcgtgggcgggacgaagagacgcatatgatttcgactaatatatcctccacgagttgggccacaagatggttccttctttttgagacttgaacaaacgagttgaaattcaataggctggacggactctagtgggatcaggtcgaggaataagttcacttttgacccctcatccttgatgtctgggttttaaaaacggaatcagcgtgggtcccacctgtcaatctcaaacttcccttttttttcttcttcctcatctattcttaggttcgctcgctactactacaaaatcaattttttatggcatcacccattttttttctctgtcggttatacgtcgaaaccgccaacgaaaatataacgggggatcggtggctacggaccgccagcaaaaatggatcttcgctggtggccaggttaagtggaccgctagcaaaaatatagctattttcgctagcggcccatttaaacaaccaccagcgaaaatatctctatttttaatggcggggtataagaacagccgccgtaaaaaagatcgtgggggcgtggggactaagtccaagtgggaggccttttttaaaaaaactgttagtgggaggataaatatgccccggatccatctctccaccgcatctctccctcaacctctctcttagatccatttctcctctcccctccactcccacctctccctcaatcgtggttggcggcggcggcaagtggagctgcggcggcggatcaggcggcgaggaggctcacgcgtggcgatccggtggcgcgaaggcacgtgggtggcatggaggctcgcgacggtgggcggg

SEQ ID NO: 43525 - DNA, 278 bp, Oryza sativa
ctccctatccaaacctttgcaacagatggctgacaatgagaaaggcaataaggtcagaagtcaggacattggtacctcaagctctcgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccaga

SEQ ID NO: 43526 - DNA, 1501 bp, Oryza sativa
ttcaaaacaaactcacatggtaaaatattgggcttgtttttcaagcctggtaatggaaaagttgcctgatatatataggaataagttcactttgactcccttgaaagtgatccgaatctaatccgtgaccctcaaccgtaaaatcgtataggatgtctcccgaactattaaaatcgatgcaatttgactcccttggtggttttggaggacggttttgctgatgtggcgtctatgtggcggtgttgacctggtcttcatccaacatgatattgacgtggtacttatgtggtaatagaattaaaataatatgtgggacccatttatcatttaaaaataataattgtgggacccatgtggggcccacatgtcattatctatctcttttccttcttcgtcctccctctctctcttctctcggtctctctctgttctctttatctcccccttctcttcgtctaagcaccggcgaaggaggcggacttcgtctgagcaccggcgaaggaggcagacgaggggttgagggccgagctgttgcgggagattatcgaggactggggcatcatagcatgtaatttcatagaaagaataaaaaagatgcgaatattagggaatgacctaatatcaaataattagaaggaatgagacttcaaacccaggtcgtctagtccaccaccttatgaagctagccggaagacccctgtgtatttctcgtaatttcatagaaagaataattttccatatttcattgtcaagaaccgacgcaagaaattcagctcactccaaaaggggatataattcttcttgtgccgtaaatgtagatttctacagaatgaagggacaattacaggggatgaggaagagttagtccttacaggcatgcaagctagagtggtgctgatgagccccgtgatggggtcggtggcgagggcgagcacagcaggcaaggcgatggtgaggatgtccatgccaatctcatcaaccatgaaccacccgcgcccgagcacctcctttcctccgtccttcccctcgggcttgtcctcccgccgccaggtctccttctccttctcgtcgtctaccacgtcctccaccgccggcttcgcacggcaccgcgcaggcctccaccgaggaactacactatggcagtgatggtgggcgaaggggaaggagagatggttgagcgctggagaagtggttaggacaaacgcggcggcgacagacctcatcggccgcgaggtcgccgtcatgccacgcgagcgtgtgactgtggactgtggttgagcaccgccttctgcttggccgacgccgctccggccctcgcctgccaccgccgctgctgctccggccatcacccgccgccgccaccgctccgtctcccccctgctcgccgattgcgccacgagaaagaaggagagaagggagagagatggaggaagaagagagagagagggaggatgacatgtgggctccataatttattttatgtgtgaatcatagttttttt

SEQ ID NO: 43527 - DNA, 1187 bp, Oryza sativa
tcctgcacccccttgggcgagccgctgccctcgtacttctggattgccttgcacccggacagcagctccagcagcacgacgccgaagctgtacacgtcgctcttgtccgtcaggtgctgcagcctgtagtactccgggtccatgtaccccaccgtccccgccgtcacgcaccgctcctcgtcgtctccgtcgccggcattgcctccgtcgccggcggcggcattgtcaccgtccagggtgttgaggagggagaggccgaagtcggagaccttggcggtccagcaggagtcgaggaggatgttggaggacttgatgtcgcggtggatgatgggcgggacggcgtaggtgtgcatgtactcgatgccgcgggcggcgccgagcgcgaggcggaggcgggacggccaggaggcgagcggcggggagagcggcgccgccgccgacgccgcacgcctgtggaggtggtcgtggagggtgccgttgggcatgaactcgtagacgaggatgcgctcgccgccgtcggcgcagaagccgaggaggcggaccaggttcttgtggttgacgcgggagaggagcgcgagctcggagacgaatgccgcctcgtggtcgacgcgccgcgccgcggcggcggaggaggaggaagggccccccgtgtcgcggcgctcggcgcgcttgatggcgacctcgcggccgtcggggagggacgcgcggtacaccgcgccgaagctgccggagccgatgcgcttcgccggcgagaagcagtcggtggcggcgcggagcgccaccagcgggaactgctcgaccgtcgtgttcgggcccttggagagcagcgcgctgagccgccgctccacgcgcggcgccgtgcccgtcggctcggcgtggatgcgcccggagaccggcgagctgctgccacggtgccggcgcaggtagtaaaccgccgcgagcgcggcgaggagcgccacgagcgccgatccagctccggcgctgatcaacgctatcgccagattgctcgggcgacgcttccccttcgattgagagctcgacgacgacgacgagttggacgtcggggacagcgccatcggaggaggggtgtagccgcaggggtaacaaacggacacgtctccgccgcctcccccgccgctgccggcgcagagctgcgcggagcccgaccagacgccgcacgagcacga

SEQ ID NO: 43528 - DNA, 180 bp, Oryza sativa
aaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaaca

SEQ ID NO: 43529 - DNA, 303 bp, Oryza sativa
gtccgttagtgtgaaccgccgcccgtgcgcccggtccaccaaaccttagccgctgacgcaataatccttttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttaga

SEQ ID NO: 43530 - DNA, 551 bp, Oryza sativa
caatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgata

SEQ ID NO: 43531 - DNA, 1501 bp, Oryza sativa
ctatagccagaaccacgctggcagaccagtagggtcagtgcccaaagcagcagatagaaaattacctttaatttagcttagataactaaaacacattgaaagccctctctagcctagctagtctaccaattgttgttgtccttggatggacttagtcttcaggagattacacatgttccctgagttcgatatccttttgaggtcactcggaggtgaagtgctacggcggtattccgtgcacttgtggatttatctgtggtcgtaagaaataccaatagctgccggcagcggaggccagcgcgacgcggggagatgcggccggcgcagtggaaggtgtggtcggcataggccggcgaggtgcatgctggtgcatcacgttgaggcacgaccggtggcgacacggcgagaggtgtgtgtgtgtggggggggggcgccaatgcagtggtgcccacgcactggaagaggtttagatggtggtggagtaatgatgtgtcagcggtggataggcaggcggcggacggccagtgaaaacccagccaggccttggtcgggccggcaacggtggcgtttcgagcgtcactcccccttctgagggcgttgtcgtgccgtctcatccctctagcgggtcggccgggtgaaagcctagtctcggttctctttgagaccttgacgggcggcgatggcagtgcttccgtcgcttctctccttggaaatgttgtctaggcaaccttttgccaaaacctcccaaacaagtggcgcaagcttgctctagattaacgtcctcttatgtcggcgatctagcttatgcaagttggctaaatcggagggcctagggggagagcggttttattcttctctctcaccctctctccctcaatcccaaagatgtggatagagcgggatttcatgtcgcttctaagggttaggttttggacgatctcggctgtagttcctttgttggtctagtggcggtcggtcacgcttagcggcggccggtcggtactagcgcctcccccgggtttgtgtattagagttgtcggtgtgtgggtggtgatatatttttttaactggttatgacctctcaaggttgtaatcttgtaatttttttctactttatcaatacgaacttggcactgtcagtacgagacgttcaaaaaaaacgagcgtgtacactggtgtgcatatgcatagtggtatgtctgactacatcgatctgcggtttctgtaaaaaagaaaacaaaccttgtgatacaacacgtgcaacattaccctttacttgctaatcaaggctcccgacacccctgaaagagtgtacaccgcaaattggaccgtgcaggaagcaatcttggccgtcactccactgcactcctattaataatccttctgactcaaaacacacacagcagccgcgggccgccgcataccagtaccacaaaccaaacaagatcatggggagcatgagcacaccggcggcgagcgccaccacctcgaacatcgagga

SEQ ID NO: 43532 - DNA, 1501 bp, Oryza sativa
gggtgcccccatatcctttgtctatcgcacaagaagctaggcaatgcctttgcaacctgctactgtcgtgctcggatgacaatgcagcaaatgacagggagaggatatctctaccgtgccatgccggaatgccttatcgtcgccggatatgctagagccatgaccgacatggccttgtcacaaacacaccagagatgccagagccatggctaaagtcggagttgtcagtaatgccaaaaccatgattgatgataccttgccgcaccaatgtcaaagtcacaaccgtcctcctcgacactgcattggaactgtggctggcgccagagacttcggatccaaggatccctaagtcattgagagggaaggggtggaggagaaaaacgaagaagatagccatgctgccgtcttcttcaagcctgtcacaaacatacagtgtgcttgggtggctgcgaggatggagaacaaggtgtggtgacttagatttctttcgcagggtggcaaatagggtttttcgaactgacgagggactaaattgttttaagactagaatggctagggactaaaccgtcttgacctaacgtggacctgggggacttgaagacttctgcaacgcaagcttggaaaggactcaggaagtactgattccaattgaccagttaaatgttcaaaatatatgttgctaccatggtttcataagagtttcattctgattaaattaaatacagacagacatcattagtcaatgtgtcctagctccccttgaatggagcactgactttgcgtggtagaaatggctaaaacatatattaggccatttttagtgcaggtttcataagaggttttattctgattaaattaaatgccacatgggacattgtcaaaaaatttatgaatagaaggaaggaaacaaaatcatctatgtgaaactgtaatttggaggtctatatgtttaatcctatccgagcttatctagattaggtgacttttggaaacctcaaaatgaatctcacagtaggaatggccttacgatcagcaaagcaggttctgactgcgtcaaaaaacctgatcaattaatgttacagtgtactcctatattaccatgaaaagattacacctggcttgaccataaccatacaagctggccaaaactgttcttctgaaacgcggttggaaagaccaacctcaggaggaaagaaacacatagaaagacttctgaacacgtatttctttctctaaagacttctgaacacgtctttctttctctctccatacaggtggtcaatgcattcaaagccgacattttctatagttttgataaggaaatgtgaaccaatctccctcttatgtctatcatattgacagctttgtaattgcatttgacaggttcaaccggttgcctcgcagagaaacttttggttagtcaagtatggaagtgatcaagactaacaaatgccgctctccaagggctataagttttgttgtcatctagtacgagcaaaag

SEQ ID NO: 43533 - DNA, 1501 bp, Oryza sativa
gtgagccattccccactgtgttactggcccagtatggatcatggtagtatgcagaaggtacagcaactagatacagcacaagattaccgtcatcttgaacatttagttgaaaccggccattggaatagtctgtggcgaggagacggctgtggagtgctgtccctagtgggagcacttgtgtgggtaggatggtatcagaagggtcaccaaaggactcccactttgttgcgccatcagtgcctaaaagcctgaaattaccggtgtcgagcattctagcatagcccacatcagtgactcgtggattccatacctcgttgccagatggatcgcgaagagagagtgctccatcagcgagcttgaggatagagccagcttggacttgtatcggtattgtatcatcttgcctattggagctagtcttggcataccagatgacggtcttgtcagcgatcttgttgaaccagacagcgagcaggtatgaggaggagtttccatctaccgccagaaaaccgaatgcaaaatcagcagtgggcgagatccatgagttgtttatcccctggggtgtcaaagaggagcctatgctgatgtttagctgagcttgggcagatttggtgcagtatagtagcaagagttgcaggatgggcaagaacaggagaggtgccattgctattgatcaaccttttgctcgtactagatgacaacaaaacttatagcccttggagagcggcatttgttagtcttgatcacttccatacttgactaaccaaaagtttctctgcgaggcaaccggttgaacctgtcaaatgcaattacaaagctgtcaatatgatagacataagagggagattggttcacatttccttatcaaaactatagaaaatgtcggctttgaatgcattgaccacctgtatggagagagaaagaaagacgtgttcagaagtctttagagaaagaaatacgtgttcagaagtctttctatgtgtttctttcctcctgaggttggtctttccaaccgcgtttcagaagaacagttttggccagcttgtatggttatggtcaagccaggtgtaatcttttcatggtaatataggagtacactgtaacattaattgatcaggttttttgacgcagtcagaacctgctttgctgatcgtaaggccattcctactgtgagattcattttgaggtttccaaaagtcacctaatctagataagctcggataggattaaacatatagacctccaaattacagtttcacatagatgattttgtttccttccttctattcataaattttttgacaatgtcccatgtggcatttaatttaatcagaataaaacctcttatgaaacctgcactaaaaatggcctaatatatgttttagccatttctaccacgcaaagtcagtgctccattcaaggggagctaggacacattgactaatgatgtctgtctgtatttaatttaatcagaatgaaactcttatgaaaccatggtagc

SEQ ID NO: 43534 - DNA, 1190 bp, Oryza sativa
cgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggtcctcgcacctctccccctcggctgacgcaataaaccatttttaaattaaaatttaaatgaagaaattcgtaaatattcatttaaagagcatataaacttcaaatggccatactttggccatttgaactcggaattggaccgttcaagtctctaatttttccttaagaagtcaagaacccatttttgtgctttgttcctgtttgttatatgaagtttattagagtaaaagcctttttcttttccgttggtcgtgtagacgctgcagcttcggaagatccgctcttcgtggaggttgaagccgacgtttgggaaagcgagcaaggcaagtcatatcatctttgaacatattggatcccactttatgaaattattttgatttaaattaatgcattatcgctttatttaaattctcgcgttatcactgttttatttagccatgcctatttacctttgttatgaccttatttttgttattgttattattactttgttcaccctagaataaacaaaaccccaactagtgggcgctctactcatggttcccctagtatgaatttagatagatgcttcgctgattaataagacaacattaggtggtttttataactttagactttgggaatattcatatctcttggactttatggaatggttggactattgtggaattggatgcacacctctccctctattcaaaactctcaaaatggttataggctgggcttggggtgcatggttttgatagtagcacctcggccacataaggaccggt

SEQ ID NO: 43535 - DNA, 1501 bp, Oryza sativa
ataaggcttatccttgtttttctaagttatttaggtttagtaaataaaattgttctattgatttagaaaaaacactaaatccatactcatgtcacataatcccttggtaaaaatatttgatgtttaggaaaaattcagttatgtttttttaaaaaattttaaccatcaacagttcctcaaatgcttattttagaaataaaagaaatgatatacataaatttgtctcgaaaaatactatcacagtatcataaatttactagatttaataaacttattattgcaatataaattgaatattggaatttcaaaagttttactgaatcttatcctaaacatcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgttgagaagaattttgtgacatattattctcgccgtggagggggtgcaagtaagagtgagttggtacgagaagacttggagggtgaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtattcattggtcgtcgtacggagtcaaccctgaatacccgacagaagtagcaggccaatatgtgaatccagatgattacttttatgtcgaattgagtggtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactagtagatggcggcatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctg

SEQ ID NO: 43536 - DNA, 1345 bp, Oryza sativa
gctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgcaccaccggtggtgaaccgatggcaatcctggaacaggagtcatcatggcattcattataccagcatgtcgatctgagataatacaaacctctctatgcggcccaaccacaacccg

SEQ ID NO: 43537 - DNA, 1501 bp, Oryza sativa
ttggagcgaggaacgactccagacccgtcagcaaggcatgcacaccgtcaaagagacggaattacttgctgccaagctggacttcctcatgaagcgattggacgaccacaagaaacggccacaaggcaccgtcaaggccttagactctcacgtcacgtgtgaggtctgcggcggcacgggtcattctgggaatgactgcccggaaacctgtgaggaggcgatgtacatgggcaacaacaacgggtaccgtccacaaggaggtcagcggtggagccaaccacatccatattatcaaggaggtaacaacaacggtaacttttctaaccagccctcttcgagggatctagtttttacataggctaaaaccactgatgcgctaagcaaaaagcttgcagccaataacaagatcctagaaaacataaatgtcaaattagatggctttgcttctacttttttcgcgctgtgatgcaccccatctcccaaagtgttgaccctaccgagcactggggatctgggtggaggctataattcaatagtggtgtcattgcccttgcctactttatcttacgtgagcaaagaaagtttaggggacaaggcgaatatgaagttgtatgtaaaaaataaaatcattaaaataattgattcgatagtgtcaaattgatttaacagtccaatatgatttaggtgccattgaaactagtgacacttttagtactcccttcgtcccaaaataaacgcatatatgaggaaactgggtttcctgttcaactttaatcgttcgtcttatttaaaaaaatagattggaatttgtattgatattagattataaaatatgaatagtgttttatgcttgacttatgtttttatttttttaaaaaaataaataagataaacaattaaagctggacacgaaaactcatggctgcgcttattttgggacggatggagtaattaatctactcccttcaacccacaatatagtattctagttacctccaacccacaatatagtattttataactagatgagacatcatctgaaattacatatgtgatgtacccacttcgtcccataaaaaaacaacttagtaccggatatgacgcatcctatcacaatttgaattgatgcccgtgcatatacatagtattaggatgtgtcacatcttatcctaaatttattttttattggacatggaagtatgtgaataggctttaccattctactatggccttgtttagttcccacgtaaaaacatttcactatgtcacatcgaatgtttggacacatgtatgaagtattaaatatagacaaaaataaaaactaattatacagattgcgtgtaaattgcgagacgaatcttctaaacctaattgctccatgatttgacaatgtggtgctacagcaaacattttctaatgacatattaattaggcttaataaattcgtctcgcagtttacagcaaatttgtaatttgttttgttattagtatacgtttaata

SEQ ID NO: 43538 - DNA, 1501 bp, Oryza sativa
tcaaggagccgttgatttaatagagaagatggtctcaaatatgggttggagcgaggaacgactccagacccgtcagcaaggcatgcacaccgtcaaagagacggaattacttgctgccaagctggacttcctcatgaagcgattggacgaccacaagaaacggccacaaggcaccgtcaaggccttagactctcacgtcacgtgtgaggtctgcggcggcacgggtcattctgggaatgactgcccggaaacctgtgaggaggcgatgtacatgggcaacaacaacgggtaccgtccacaaggaggtcagcggtggagccaaccacatccatattatcaaggaggtaacaacaacggtaacttttctaaccagccctcttcgagggatctagtttttacataggctaaaaccactgatgcgctaagcaaaaagcttgcagccaataacaagatcctagaaaacataaatgtcaaattagatggctttgcttctacttttttcgcgctgtgatgcaccccatctcccaaagtgttgaccctaccgagcactggggatctgggtggaggctataattcaatagtggtgtcattgcccttgcctactttatcttacgtgagcaaagaaagtttaggggacaaggcgaatatgaagttgtatgtaaaaaataaaatcattaaaataattgattcgatagtgtcaaattgatttaacagtccaatatgatttaggtgccattgaaactagtgacacttttagtactcccttcgtcccaaaataaacgcatatatgaggaaactgggtttcctgttcaactttaatcgttcgtcttatttaaaaaaatagattggaatttgtattgatattagattataaaatatgaatagtgttttatgcttgacttatgtttttatttttttaaaaaaataaataagataaacaattaaagctggacacgaaaactcatggctgcgcttattttgggacggatggagtaattaatctactcccttcaacccacaatatagtattctagttacctccaacccacaatatagtattttataactagatgagacatcatctgaaattacatatgtgatgtacccacttcgtcccataaaaaaacaacttagtaccggatatgacgcatcctatcacaatttgaattgatgcccgtgcatatacatagtattaggatgtgtcacatcttatcctaaatttattttttattggacatggaagtatgtgaataggctttaccattctactatggccttgtttagttcccacgtaaaaacatttcactatgtcacatcgaatgtttggacacatgtatgaagtattaaatatagacaaaaataaaaactaattatacagattgcgtgtaaattgcgagacgaatcttctaaacctaattgctccatgatttgacaatgtggtgctacagcaaacattttctaatgacatattaattaggcttaataaattcgtctcgcagtt

SEQ ID NO: 43539 - DNA, 1501 bp, Oryza sativa
taaaggttattattggctctggtaacaccaagatgtatgaggtgggttggattggtcaggacaatgcagagactaacacttcagttcttcaagccgatgatctagtaattcgcaagaaggcacgcgctagtcgtagcatgctgaaaatatatattagggagtcaacatcacagaattccccatggattatacatgcaaatcttgcaaagaaatatggaatacccactgagcccccaaaagacttattggtaaccatcttccctcattttatttactgtgttccttattatcttaaacctaaaaaaccatggcttgtagaatggtcaagggttgccaaaactgaggagaggactcgagaatggaaccacagatgatgtcagaaaaaaattgaagaaaggtgacttaacagataaccatgtcatcctctcagttcatttgatgttccatacaactacatttttgcccagcttcttattgttcactttttgcatgactatgcaggtgagccaattgatgatcttttattaaggcctacagcagatgatcccagtctgtcaaaaagacgtccactgtctacagatttcagagtgcctgtagattctgttggggatctacttatggtttgggacttctgcatgacttacgggaggattttatgcttgtctccattttccctctcggacctggagaatgcaatctgccacaaagaaagcaaccttgttcttcttgtggaattacatgctgcactcttccatttgctcattaaagatggaggcgggtattttatgtttctccagaacaagagaaggaaattaaaggtgactttgccttatccatcatttaagcatgcatatttttttgtcctttcttgttaacttgcactatgcgtaggtaacattggtcacctgggctgagtatctatgtgatttcttggaaatgacaagtaaagaagaattctccagtagtttatcaactgtaagaagggggcattatggacttgttcacactgccgtgaagcttaaaattctgcgggaactggtagatgaagccataacaacttctgctgtaagacagaatatagatgaaaagattgaccagcaacaagctattgcagcatcaaaaagagagcttgctagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgaga

SEQ ID NO: 43540 - DNA, 1501 bp, Oryza sativa
acctgcttagggaaaagcttgagcatactataagccacttgctcctaaaattaaataaacacaacaaaattatcaaatcacacaaagcatacatataaaattgtcctatagaagccaatagtgataaggccgtgcctgtataaaaacacattgtggtggagcgctgggccttagaagtgggggagggagttggagggtaaggggagtgtgaagcgatcgggaggtcatgtgggagagtaggagatgccatttgcgctcgtcatggcagagtatgaggccggtggctcatgctgggtgtggagaaggagaggaaaatatggattgagatgggtccaattacaatagtaagcttgtgaatagagagacaaagtatttattaggggtatccagattcgatcgaacgggcaatgcatttcttgatgatgtggaagcacggaatatcaggaaatagctattaagtacactaagaggggatgaattatataggtttataggtttaatgaatgtaaatagagattgcaagatatatatgatgtgttatactgtagtgaagcagacatattggaaagtacgcaaagggttggagagtttttgcagattatgaagtaaacaaaccaactgtaaggttactctaaatatatttagaccaggaagtaatagaaatgctaaattaaataatagctaagaattctgtgtgtgtcaaatgcacaaattacccttctagatcaaaaaacaaagagaatgatcatcttcgttactaaagaaagtaaaaaaaaaagtaggtaagcaaatgcatcctatatctattaacgttatgggattcaaccgcttgcaggttgtctcaactttgaaatatgagtatgcgattgagaagctaaagagtactggctttggaattttagaaagatgcggtggtttacttgtagctatcaaagcgattgcagggcttttgaaccataaagagataaataaaattgagtggggaaagtaccaagtccttcatggtcagtagatggaatgcccgaaaagataaaccatgcaatatatttaagctatgatgacctagctagcccctcatttgaagcaatgcctcaataaccatttgattgttgaaatttggataagtgaaggttttgttaatggaaaatcaaatgaaccggaagagctaggaaaggagtattacaatgagttaattataaggaaccttatacaggcaatgcccaatagtgaatggagcatgcatgatgtcggtcgctcattttgtcaacatttggctaaagatgaagcactatcatctcaaatgggacaacttagagtcagtgacattttgaaatggagggagtatgaagtaaacaaccaactgtaaggttactctaattaaatttagaccgggaagtaatagaaatgctaacttaaataatagctaagaattctatgtttggcaaatgcacaaattacccttctcgatcaatcgcaaatctagcctatatgtattaacatc

SEQ ID NO: 43541 - DNA, 861 bp, Oryza sativa
atatgtgattaggaggcgtcagaggcctatagtatcaggtaacaattcgtaatactctgaaagtctgaattcctgataactattttgttcagtttactgggattttttttgccccttgagatgatgacccatcgtttctcccacgtcaactgaatagtcatgaaaaaaattgataagatagattaacatatgatatattgctccatgagacaaattaaacttctacaaattataaaaaaaaaacttctaatgtatgaatactttaatttgttgttttctacaatttgtagaggttaaaatttaactttacatgtactattttttatattttttcataactatttagtcgacgtgcacaaacgagaatttgactttatatgtaatatattttatagttcttttgtttttttaataactatttgacgatgtgctacaaacgggaggcgtctagagaggagaaaatcatccccatagttttctactccctccgtttcaggttataagtcgttctgactttggttaaagttaaattattttaagtttaactaagtttgtagttaaatatagtaatatttataacaccaaattagtttcatcaaatatataattgaacatattttcataatgtatttgttttgagttaaaaatgttactacttttttttctacaaacttaattaaacttgaaatagtttgacttttaccaaaaacaaaacgatttataatatgaaacgaagggagtgctttgatatacaagaaggtgtaaatcaatgcaattatattcaccagatgatgatgcgggcgttccagctgctactgctgctgttcatgctcgtcctaatcctgctttggctgccccttc

SEQ ID NO: 43542 - DNA, 1501 bp, Oryza sativa
ccacaaagaaagcaaccttgttcttcttgtggaattacatgctgcactcttccatttgctcattaaagatggaggcgggtattttatgtttctccagaacaagagaaggaaattaaaggtgactttgccttatccatcatttaagcatgcatatttttttgtcctttcttgttaacttgcactatgcgtaggtaacattggtcacctgggctgagtatctatgtgatttcttggaaatgacaagtaaagaagaattctccagtagtttatcaactgtaagaagggggcattatggacttgttcacactgccgtgaagcttaaaattctgcgggaactggtagatgaagccataacaacttctgctgtaagacagaatatagatgaaaagattgaccagcaacaagctattgcagcatcaaaaagagagcttgctagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctg

SEQ ID NO: 43543 - DNA, 1501 bp, Oryza sativa
cgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcacgcgcagcttgcggccgca

SEQ ID NO: 43544 - DNA, 1501 bp, Oryza sativa
tctccaagggagagcagcgaccccattagtttcttgatagatttatttgacataggtacattggaatttctgtgtcatgtacaaacttcacagcatgtatgataattttatggcgtagttgtggccgagattcatgggctagaagagcagaacactgattgcaatgttccaacaaactgtgaccaaaaatattgagaagtcccgagtcaacacattgtgataagctaatctaaaagtgaaggttgatgctgatgcagccacctgagattatttagtttttttaactatagatgttaccccctcccatttctattaaagaaacagatatgtttacagcagaacatctgagattattttgttggaagtggaaagtgacgcggcaacttcctagtgcagtgcagagatggtttatttcagtacaatttaacttgcgtcaacagttttgtttgaaatcagttttgtttagttgttaggagatggcatattcttagatatctccacaatatggatggagacaacaatcagttcgcttgaaatttgatccccttttcgttgttgactaagattcttgataatctaatacgtggctgctcgcgtgaggtgtcctgcatccacattgctgtcaggattaggaaagccattgagtagggttagaaaatagattgtattaattaaaaatggctcaatatgtgtatatattgagctctgtgccaccattccatttcatcaatctacttggttctgaacaggatcggagaagttgcatactaattaaagccaggtacacaatcctttagagcaccttttctgttttattgctatatatgtatgtaaaaactgacaagctggttaaatctgagatgcagaagcactactcgttcagccttgatggctgtggttctggaggccttggcatccaacctgagcaatgtgcttgccaagatggcgaggaaggaggtgggcatgctgcttggtatctctgacaagatcgacagcctccgcgtcaggcttgatgggctcaaggagttcctcgccgacgcggagcggaggcgcatcaccgatctgcacgtgcagggttgggtgaaggagctcaaggatgccatgtacgatgccacggacatcctggagctgtgtcagctcaaagccatggatcaggacagtaggcgcagcaacaacccgtcgctactctccctgcggaatcccttgaacgcccaccacattggaagccgcatcatggcgctgaaccagcggcttgatggcatcaagcagcgtgccgagcaattcagcttcatcaagctcgatcgctacggtgactgcagcaggacagctcaaggccatggcttacgccggacaacaccagagcttgatcggtcaggcgttgtcgggaataagatcgagcaagatacaaggagactggtggagttgctaacgagggaggaggaagaggcaagtgcggcgagtatcagcagcaacgtcagggtcgttgccatcgtcggtgttg

SEQ ID NO: 43545 - DNA, 1501 bp, Oryza sativa
tggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcctgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttatggttactctcattgagaagaggatggcactcgaga

SEQ ID NO: 43546 - DNA, 1501 bp, Oryza sativa
acttcacagcatgtatgataatttcatggcatagtttgtggccaagcttcatgggttagaagaacaaaaacactgattgcaatgttccaacaacccgtgatccaaaatattgagatgtcctgagtcaatacattgttgataagctattctaacagtgaagtttgctgatgcagccacctgagattatttttttgaccagagaggttgccgtcccgtacgtttctattaaggatacaaataagtttatagcagaacacctgatattatttagtcggaagtggaaattgatgtggcaacttcctagtacagtgcggagatggtttatttctatacaatttcacttgcgtcaacagttttgtttgaaatctgttttgtttagttgctaggagatggcatattgttagatatctctacaatatggacggagacaactgaaaatcagttctgcttgaaatttgatcctttttgtttgttgaccaagactcgtgataatataatacgtgcctggtcgcgcgatgtgtccttcatgcgcattgtatgaattgagaaagttctcatacgtctatatattttgctcgatgccaccaaaccattttgtcaatctacttggatcataacaggatattatatatccgtatccgggttcgtattcgccgaatttctacaagccccaccatatccttgtttcagacggattaggaacgaagcgaatgtccgatctgttttcacccgtatgaacaattgtctagtttgaactttgaaccaaagacatatgaagtactcctagaagaaatactataatatgtgattcctagaagaaatactatagtatgtgataccgtcacatattgtatgaatagaagtataagtttccattcccggagaacttgacagatctcccttgtacctctaaatacatagtaactaattagatacaacttttaaaacatttgatatcatttagctaggaaatgtataccatcttaaatgttcaaatgttcaagtctaaactcaactcgaacgtaacatctaaaaaatatgagagacaaatccgagatataagcaatacaaatattatatgcatccgaatttttcttctcattgctcaattgattatacaatagaaatttggtgagatgatatatgtcactacgctatatggtcttcttttttttttcttcatgatttttcatgacatatattgcatttgaggggaaatttaactatttgcaactcaagtggccaatctccaaatgccattataagatttgtccctaataatttttttagagcaattttacggtccttgaggaggtaccaatttttctattgtaaatttggtacctcatggtacctcataatttacactaatttttttggtacctcatggtacctcctcaaggaccgtagaattgctcatttttttaaggaaattgtcgctagagagacaagactcttttaattttgttccacctacgtataagacgcatcaacgtggaac

SEQ ID NO: 43547 - DNA, 508 bp, Oryza sativa
tccttagctcaaataaatcccagaaaaatctaggaattatagaattaagcaaagtatttaatgaaattttatctagcccaattttatattgagattttaccaaattaaaattagatcttctcttataagcttttaaaatcatttctaataattccttttaaacaacaatttataatttaaggatttttaaacaagaaaagctctttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacgaaaatcaggatgtgacacaaagtgtgtttcctggttttgtggatagg

SEQ ID NO: 43548 - DNA, 1501 bp, Oryza sativa
gtcgcgccctccgccttgacgacacggagccggtggtagcagcgccagaggtcttggtggcggaggaccaaccaccagcacctaggcgccgctgtgccgtcatgaccaagttggccacgtcgtccagtcatcgttgggctggagactccaggtcagggacgacaggcgggtgacgcaagagcgcgcccgcagcttggagcgcgccctggggcgcgctgccgtcgccgtagacgaggaggcgacgctccccatctgggcgcccttctccatcacccgtggatgtcgaagtcgcggatccttcgaccctctcgagcacctcctccctcctaggactttggcgtggagggggcggtggagtacgagctcgacggcgtgggtttggctccccatcgtcaccgctaacgctcggagagaggttgtgcgcctttgcttgttcggccattgggctgaacaggaaaagctgggcgcacacgaaagagtgcgagagctcagaagatcactcgcagagccccctacctggcgcgccagatgacggagcgtggggctcctcaccgggagaccgcgcaggcccccctttgccagttcggccgggggccctgggtaagattctaagctcctagtctgtggaaagttcgcgagagtggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctctccagatcatcccccctccagcccccgatcgttctgggatcgtcttctctttttttttttctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaaggctggtatatatctgaccgggtccaacgtgccacctccaggagctaacacgccgaccccggctagggatgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgcggttaggtgagccccgctgcgctcacctaacccatacacgcggcgcaaaacctacaagg

SEQ ID NO: 43549 - DNA, 1501 bp, Oryza sativa
aggataacaggataagtcaatatttagaagtattttctaaaaatttaagctaatattgcattgaaagtaattcttgctatgttaatttcatagttgtcaatgagagattcaaaactcaacattaaaataacgtgtaaaaacctaatgcaccttatattttatgaaccggtaaatacatcatctccgatctaaagcatgaggccagataagctggttttataattgcgtcaaacattgaatttagtaattataagcattaattaactaaatatgtcgatcatgcatagcaagagatcaagtcgtctttgcgcatcgcataataatatttccacgaactctttatacaactcgtaccacatttctaatttcaaaagtaaaattaaggcacagagttcaaagctgttttctcattctctagtcaatttcgtacggagcagcagttaaacatggtaattaagggctttttttttctcggaagggcgtatttgccatcgagctaatcttgtgggctaatctgcaaaaataccagaagagaatcgcactcgctctatttatatcgaccttcctcctctccaagccaagcggcttcatatcatccggcatccagagaaaaatatagcaacgaaaaaaaaggagaaaaaaaaaacagtctctcttccggtaatcttctcgatctcacctcgctttgaactctccgctcgattttttttctatgatttctccaatctggttaacttggattgttccctacccccagaaatctgttgtagtgtagatctggtaaatttgtttccctcacatttttgcgctctattttgccttttttattttttggcttgtttaaccaaatcggtgcctatgcgtgcgcgatagtctgattccaatgcagatgcatttttgtgcggtttagagatggagattaagattggagaatggtttgattttgttcgagtcgaacgattctggagaatgtgtgatgctaagccctatttgggaataccccttttgatctctatagatcgcttcgagtaggataggagatcagctgcagattaaccaactacttctgtaattgttactagcaatacaatacactgttacttagtgagatgagctcgcgaggagagaggtgagaaggcacggacgaggcggcggaggcgcgcggctgcgcgccgcacgcgttgcggcgtcgagtagacgagaggattggggggggggggggaattagggtttgggaagagaaagaaatccaacggctgtgattaacggtagtataatggcccatgaatagcccatgaagagcccataagaagagtacctagggttcgctcttgatagccaccttgttgagatgtgatggttagaacgggattgctgcgacattgttgttctttttttttttgtgtgtgtgtgtgtggcaggtatgtgttctgagatggttaatttcatgttctaactttgatttctttatatctgtgattttggtaggtttagttggtga

SEQ ID NO: 43550 - DNA, 384 bp, Oryza sativa
ctctcaaaaccatgtgctcacaacccgccattatcaagttttagttggcaagtaattaattaaccaatcacgattgaccatcgtgaagctaccattaaatataaccataagtgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttagg

SEQ ID NO: 43551 - DNA, 344 bp, Oryza sativa
tacttcttgcacaggtagctcaaaccggtgcatgatgacgatgttatctcagtataacaaattaagaagctgagtgttgaaactaacttgtagcatccaccaaggattctgaatttctgactagatctcctcagaagagaattgaagcaactgaaagaaagctgcagaaacaattcctcctcattgaaaatccactttatatatgcagcatggtgcactaatgcaatccaacccataccagaaactaaaatacttgaagatgttatgataggtccagcattgcaagtacattgtactaactggattactggacaatcaacaactgcaaatatgtgaacttcaga

SEQ ID NO: 43552 - DNA, 372 bp, Oryza sativa
ttgaagtcagaatgaggccgttcaagtctcataattcatctaaaaatatgatctacatgtgggattactttttatgtattgtttatttggtttttattagtctttttcctcgttttgcgtgatagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttg

SEQ ID NO: 43553 - DNA, 1501 bp, Oryza sativa
gccttatccatcatttaagcatgcatatttttttgtcctttcttgttaacttgcactatgcgtaggtaacattggtcacctgggctgagtatctatgtgatttcttggaaatgacaagtaaagaagaattctccagtagtttatcaactgtaagaagggggcattatggacttgttcacactgccgtgaagcttaaaattctgcgggaactggtagatgaagccataacaacttctgctgtaagacagaatatagatgaaaagattgaccagcaacaagctattgcagcatcaaaaagagagcttgctagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgtcgaggaaaaagagaatcccgctcgtgctcttgctggtgtcgatgtcgccggcgtggtcgctgtcgctgtacccgacgaagtgtgccttgcc

SEQ ID NO: 43554 - DNA, 1501 bp, Oryza sativa
cttcccaaaccctaattccccccccccccccaatcctctcgtctactcgacgccgcaacgcgtgcggcgcgcagccgcgcgcctccgccgcctcgtccgtgccttctcacctctctcctcgcgagctcatctcactaagtaacagtgtattgtattgctagtaacaattacagaagtagttggttaatctgcagctgatctcctatcctactcgaagcgatctatagagatcaaaaggggtattcccaaatagggcttagcatcacacattctccagaatcgttcgactcgaacaaaatcaaaccattctccaatcttaatctccatctctaaaccgcacaaaaatgcatctgcattggaatcagactatcgcgcacgcataggcaccgatttggttaaacaagccaaaaaataaaaaaggcaaaatagagcgcaaaaatgtgagggaaacaaatttaccagatctacactacaacagatttctgggggtagggaacaatccaagttaaccagattggagaaatcatagaaaaaaaatcgagcggagagttcaaagcgaggtgagatcgagaagattaccggaagagagactgttttttttttctccttttttttcgttgctatatttttctctggatgccggatgatatgaagccgcttggcttggagaggaggaaggtcgatataaatagagcgagtgcgattctcttctggtatttttgcagattagcccacaagattagctcgatggcaaatacgcccttccgagaaaaaaaaagcccttaattaccatgtttaactgctgctccgtacgaaattgactagagaatgagaaaacagctttgaactctgtgccttaattttacttttgaaattagaaatgtggtacgagttgtataaagagttcgtggaaatattattatgcgatgcgcaaagacgacttgatctcttgctatgcatgatcgacatatttagttaattaatgcttataattactaaattcaatgtttgacgcaattataaaaccagcttatctggcctcatgctttagatcggagatgatgtatttaccggttcataaaatataaggtgcattaggtttttacacgttattttaatgttgagttttgaatctctcattgacaactatgaaattaacatagcaagaattactttcaatgcaatattagcttaaatttttagaaaatacttctaaatattgacttatcctgttatccttaaattcgtgtctcgtacgcattgcctccttggcggcagcaccgctacagacctacagttaccgagtcccctgtgtcagttgaacccgacgaaattcctaaatacgctacgtaaaatgaaataatggataagcacatgattaattaagattatatttgacatagcttcgaatcgaaaatactttagagctggatatttttaactccatgaatctatggatctgaatttacgattacattgataatacatgtatgaatctatt

SEQ ID NO: 43555 - DNA, 554 bp, Oryza sativa
ccggttggcacatgccaatgtggattttgatttgtttgagtttttcttgattttttttaatgatttgtggatgttgttgatttgtgaatgtatatgtgaatgtgtttgtgaatgtttatgtgaataaatttccgatgatgtgctgtgaatgaatttgtggtgttgtgaatgaatttgtgatgatatgtgtgaatgaatttgtgatatctgtgctgtgaatctaagatcatgaaaggaggaaaaaaaagaaaaaaaaccgaaggaggaaaaaaaagaaaaaaaccatagtcccgggactaaagatggttgttcccaaccgggactaaagatgcatctttactcccgggtatttcaaccgggattaaagatagcgatctttagttccggaatcttagtcccgctttgcaacccgggattaaagggggttgcaaaccggggttaaagagggtttccgcagcagtgacatgactagtatataggggtaaaaatggagcagattcggatggatagtggtcataccatatcctaaaccatattttctaaacggattcaga

SEQ ID NO: 43556 - DNA, 1501 bp, Oryza sativa
tagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgtcgaggaaaaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcg

SEQ ID NO: 43557 - DNA, 1501 bp, Oryza sativa
aggagaaggggcgaggcgcgtgggcggagatggagaagcgcgcgtaggtggggagcggactgaggataagggagaaagaaatgattttttttatttgtgtggctactctttgaggctatgtagcactgtgagacttgtggcaagtattattcttcttgtgtcttcgtcctatgtgacagccccaggctgagaaaaataggtggcgcactgctaatccccttaaggcatccacaatgtaagacacttctagagtgtcctcgttaactgaggacacttgtagaaaaactcagctagcactgaaaatttatttgtttgatgcaggtcggtaaaggagtcaattttttgggcagtgcaagccacctttttggagtcacaatgtttttttggtcacatggataggtgtcagacacatccatgtgagggagttacttgtagatgccatgtgtttacttatagatgaagtagttgtgatatgacatagcgtatagtgtgagggttacttgtctattgggatagatgtcaggaatactactccattgagtagtgcttcgatccatgacagggatacatgttacttggctttcatatcagtaccgctttgatccattgagacacatatcaatgctacgtgtgatttactacctccatcctattataattacatttctaccatttaaattttgtcctaaaaatattgtatttctgataagatgggacgcaacaaatggaatgtgtacccaaacctttcttttaattaagtttacatatggaatgtgttcctcaaccttcctattaatcaagtatacatatggaatatacgtatgcagcatagttattaaatagggttattgtggtaaattgtgtttgttgttaatttgtctctaattttctagaaatgtaattattatgggatggaggtagtagcttttattgttgcagatactacatgaactactttaatttatgtcttagtagagagatcaaggccactgtactttggtgctacttgacatttatgtagtaatagatattggaagactatactaccttctgctccctccattctacaatataagttattttcagtttttgcttgcaacgtttgaccactcgtcttatttaattttttttaaatatagaaaacgaaaaggtgtgcttaaagtactgtaaataataaagtaagttacaaataaaataaataataatttcaaaaaattttgaataagacgagtggttaaacgttgtaagaaaaactcaaaatctcttatattatgggacagaaggagtattgatcatgtgaggtcgaaatgctgggattcatattagcgtatcggttggttctgttaggcctctcacagtgctcttagctggaccggtgctacatggtgccagctgggcttttcgcgtgagtggcagatggatgcgcaccctaagctcctcgctaggacgaggaggaggcgaggagacccgcaaaagcacgaggctgttttatggccccacg

SEQ ID NO: 43558 - DNA, 1501 bp, Oryza sativa
tgcaagaacgagtattttctgtagggcatcacaaaaaactgataattagctaccagacactcacgacattattttattatttccaaagaaaatggagagagaaatatatgtaaaagtacggttcaaccctttttcttgttctctctccttctccactccttcctttcttcttcctctgcatggacatggtggaacatggtggagcatggcatcgagcccgacagctacatgttcccgttcatcttcataaaggcgtgcgcccagctagggaccttgcaagaagggagacatgtgagaattgtccacgcgttcttgtcgtccatcacgtcgaacaccaccgtcaccttctcgatgccatgggcacctaggtacgcacgccaaccatggagctctcgtcaggcctccatctcttgcataccatggcatcaaatgactcgacgcactctgcccagagttcgacccacgtgtactccacgaggagcgtgctctaggaagtcgtcgtcctctcatcgtcccccatctgctcgaacgcgcgaagagaggattccgggcagcggcaagccagggctaaaggggaatttgagagaggagctctggggcatgctatttaaaggtggacgaggaagaatccgactcggatgcggcgaaaaagaattaggaaaattagggttcttcgtaggtaaaggaaagctcgaactttactcaaatctgagcgatttagattgggatatcaaaggattcttgagggaaatcgaagaggaaagtgaggacatcaaatcccctcaacttattttggaaacgggcgagggaatggatcggattttggaagggatgcagtggcgtcgggcgttggagagaggaggacgacagcattgtgcgcgggcccacatgtcagctgcatcgagaagaaaggaaggagtagaggggggcattcccgtcatttcaaaatttctctcccctctttcagcctagaaattagaaaatagtgcctccggtgtcctacatccaattacacaattttgtagtgtccatcgatagtgtcacgtttttcagtgtccctcagctaattacacgattttttagtatcctgtagcaaattttgccttttctttacaaatttaaccatatatagggggtgactggtgactggtctgcatcagatattcagaggactgatttttgcacagtgtatgaaacaacgacagccatttattttttctgatcaagagagaaacccctatatttccactaatggaaatcaagtactctctccgtatcatattacaaagcgttttgaatatttttctagttaaactttcttaagtttagaaaaatgtatagagaaacttagcaacatctagaccaccaaactagtttcattaaatctaacattgaatattttgatagtatgtttgtttttttgttagaatcgtttctatgtttttctataaagtttgtcaaactgacaaaaagaattaactaagaaaaaagtcaaagtgtc

SEQ ID NO: 43559 - DNA, 1501 bp, Oryza sativa
gcactgtttgatcacttgtcttattaaaaaatttgtacaaatacaaaaaaaaagaaaaattatgcttaaagtattttggataataaagtaagtcataaaaaaataaataataatttcaaaaatttttgaataagacgagtggtcaaacaatacaagcaaaaactcaaaattctttatattatgggacggagggagtagatgatatgaggcttattcccccgtttagattcacaatgctcttctaaactttcttttagctaagctgaacaaggctttcaaagcgagaagacgaaacgcctgcaaaaagggaggaatttcaaagtaattttggaggtattgggctaaatcctataaaagaatgctgtaaaatttatgtgatccaaatgagtcctcaacaattcagatttgatatgatactgtagacttgtggatcattctggtcgcctgcactgaagcaactcagctgcggcttactccctccgtcccataatataattaacctagtacgatagtccaaattcgtagtattaggatgtgccaatatgaaatactaagtttgttacttagaagtataaaagattatcctcaaattatcttttgaaagttacacggacgttaacttgtatgttatttgtcattagctaaaaatgtcttccaaccaagatgagttaacaatgcagcgaacagagcataactctgttagtttttttatggtgaagtcagtctatttaagttttaactcatagatttgagagcggggcctagcttgactagcagggagctgctaggagcagcacgcctatttagttcgaatccctttgagcgtatattttctcaccatttttttctttatcaataacggaagtccttactccttagtatctctatcaataagggatgataagttcctcagttctcctcagatttacgtgggtgtttatatttacggctaactaattctttagttataagtagagtactcgttgacacgtggttgatcatgggatatgttggcccatattgtcaaatgtgctagtagaaatagcgtgtctgtgtgtttaccgcagtatttttttctcaacaattagtacttgcgttttaaatcgatcgtcattctttgttataagtcgaaatttctatcttttgactagcaattttagaaatttatatagtttaataacatgtggattatatactattaaaatacttcgcgtggagaatataaaaaccataaatattgtgatattaaactgtacaaatttataaaaactgatagtaaaaaagctcccttttttggggaaaccctatattccaaactgctttgagtgaaaataccacatatacttacttacgccaaattacgccgtcgtaggagaggtagatgctgtcgaacgaatatctaggagagatcccgttgttgacggctgttaaataccaaattaacgccgtcaatacctgcataaaaccataaaagtaaagcatccaacgtagtggtaggatt

SEQ ID NO: 43560 - DNA, 295 bp, Oryza sativa
atgctgtcctcttaaatgccccgcacgcgaaaatgagtcgattttcccatgcgtacctattaagagagccgcacgggaaaatagtttccctcctacccactttaaaaattttcctttttctctcctctcccctatccgcgcggctaagtcccctcactcacgtgcgctctctctcacgcctcagtcctctctctcatgcttcctctcctctcctcactcctcactcctcccttctctcctcctcactcctctctcctctctcctcggcggcccacggcgatggcggtgggtgaca

SEQ ID NO: 43561 - DNA, 1501 bp, Oryza sativa
aatacataagaaatcctgccaaaattttggtaatattgtcaacttgccaaaattttggtaaggtttattttgataataatctaaacaacccctatatgttttctaagtaataagttagtaaaacaacaccgccacgtctcgactatagcgtaatgctaactctagtgacaaggaattagtataagttagtaaaacaacaccgccacttctcgactatagcgcgatgctaacactagtgacaagggatcagcgtatatctccaaacgtacaactgaagacaacacatatgcattgtcatatattgctagctagctatcatcaactcttatgcacttgagatcgtcacatcacagctatcgagcgtgacacatatggttattgtccgcattcataacatcaaatgtataccaattttcttttgtgcaatgagaatttacgtagcgctcttttatttatatatatatatccaaataatggcgaatagtactatacaataaatatcgactatatctagcatggcacaaatatgtcatttcaaggaaaaaaacatactaacctcaatctataatacacacattttttctggaaaaagataaaagcccctctattttgtaaaagaaaaagaatacacactccatctttacaaaaacactccacatatttttccttttagttacgtaattcttaacttttaagatcaaactattttaactttgattatcaataattctaaaatatttaatttaaatcctacaatacgatatatagattagcaaaaaaatactttaataaaattaaatgtttacttatttagttttgcatactataatatataaaatcaaaaaaaatataataaaacccatgccgttgtctaaaaataatacttctaaggttgtgtttagttccacgtcaaaattgaaagtttgaaaaaattgaaacgacataatggaaaagttgaaaggttgtgtgtgtatgaaagttcgatgtgacataaaagttaaaaatttaatgaaaaaagttaaaatctaaacagacctaggaattacgaaaccgaagataggtaacctgaaaatggcaactggcaaagtactcgcaggccagatacgccgccgccgcgtcgtacgagcatatctcatcgctctcgcgcggtctcgccgactcacgacggggctctcgttttatagtaaaccctaccggcgaagcaggtgacggcggcggcgcgggcgcgcgcgcgcgagacgacgacgacgtcgtgcgcactgcgcagcgcagagggggggttttgccgagattttcctaaaaaggggacctcgccaccgtaccgagaaaagaaaaagaatacgaggcgaaaaccaacacctctctctcgtctctccccctccccgactcgactcgactcgactccacccccgtcctccccctcgtcccgtcccttctttggtttcctcctccccaatccgaggggtggctggggccgccgccgccgccgccgccatcgcca

SEQ ID NO: 43562 - DNA, 1501 bp, Oryza sativa
ttaaacatgcatgatactactttgcaaaatgaacaaatgaatgttgaaagacaaggaaagagagttaccatctccccactgtgcttgctgatccattgcttgcagtctggtttttagctcattgttcagagatacaagtccattgttgttcctctgcaaacaatataaaaaattactaagattgtgaaaactccgaatcaaaatgaccacaccttctaataacatacctgcatcattgccacttgtgctcataatgtagcagtctccaactgcaacacctagaatttgtgttgaagctcccctatatacttcatctttttctcctttgactttgcggcagatgatcgattgttcaggatcctgaaaaaattacaataagatggtgattttcactaacaaagaacattgtgtcaaactatcaatccgcatgcacggactagtacacaagaattgaagttcacacacctcttgaccctcctaggatcagtcaagacaatctctgagaggaatttatccgccacaaccttcttcttatcatcctcagtgaatttcacatttggcaatggactcgccttcaccaccatttgcctctatagttagcagaggggggctggacatctgctgtccaacagctccaaaattgaggttccccatcatgaagctgtcaaccgacgagctgtggcaatggtgggttgtactgccagcaccagagctcttagcttcattctctctgcttccagaagggctccatgcctgtatgcccatgtccttaaggacagcagccaccatgccccccgattgatgcccctcggtcgttgtgacctttgtcttaactgatgctataggtagcatttgcgggttttgatgtgaataccctaagaggatgtaactatgcgaccgcctatgccccaccataagcggtagcctgctaggcggcccctggttagatctcgtcgaatgcagtgcaagagaggtcatcggtggcacatctatggcatcatatggaggtggaacgatggattccactgagaaaaaagtattaggaaagaacaagtaaaagtcttcgggtgcaaagccactgccaacttcgtaccatagaagccgatagtggtggttccgagcagggggacaaggcagataccgtcgaagaggtgaagtgggcaggagcagggtggatcaacggtaggaatttcgattggtcgaggcacttgtgggaggcgaggttgaggatggaggggactcgcggtggaaccaccggattctcgctcccatcaccgcaccggtccaacaaagagaggcggcacgagggttcgccctccatgttcggcacaaagcaagggggacgaagtggcgcggccgctagggttttggggatgctaccaacaagcacgaggatttgttgattggtaatgcgagagagggaagcaatgagaaaattgtgaaggttgtatttgtgttgtatgggtggcatgcaaaaatggaaaggcgcgtgggataaaac

SEQ ID NO: 43563 - DNA, 176 bp, Oryza sativa
accgggtccacgggagtggggcccacgcggcagcctcacggtccacggtggaccgggtgcacccgggctcacaccggccggcgccgtgggccccacgcgtcagccgtacccgagggcgcgggcggctgacggccgggccccacgcggcagccgctcggcgcgcccgaaggcggcca

SEQ ID NO: 43564 - DNA, 1501 bp, Oryza sativa
ttgttcatgccgatcaagaagctcagcatcaggaagaggaagagcttcacatggtggatgatgcaacaatgaccctcgagcctatggatgaggaggataatggtttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagctcaggcgctgttggagaattgtgaagtagcagaggcagtcaatgaaaatgtcgatccagccacccaagttactggctcatctaccccagaacagggcacggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaacaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggca

SEQ ID NO: 43565 - DNA, 1501 bp, Oryza sativa
ccgtgcggcttcctcgccagacaaaggcgatgtcgagaagccgctgcaggaagacgagtgatcagatgacggtgagttcatcgagctggaatccttttgattatagagagagatgcgttctgttttgtttttttggaggagatcatcaacagaaaaaaggagcgaacccgaggatccctcgtgccgaaacagaatcagcatgaaccctaatgatcgtccattatatgacccacctgatgctaaactacattgtcgtcaacaattaattggcggccattatttcatcatactgcctctaattgtcaccgctctaaaccccaaaaagaaaaaaaaagagaagaaaacatatgcttccaatggattctagaaaaaagagaacaaaaatctcatagtggactaaccgtgcatatgcatggatcttgcatacagatgctggtggaattaacgggtggatcatggctggccgacctcgttctcgcgtgacatctcctcgagcgacttgcccttgggctcgggcaccaggaaggtgaggaggaagccgagcaagctgcagccggcgagcgtgaacagcgagttgcggacgccgatgcctggcaggtagccgtgcgccgccgccttggccgggtcagggctctgcgccaggtacaggaacccgaacgacccgatgatcgcgcccaccttccccgacgccgccgatatcccgtggctcgtcgcacgcagcctcgctgggtagatctccgccggcacaatgaacgtcgcgagcttcgcaccacgtcgtcgttgtcgttgtcatcatcgaggtcgagaagccgctgcaggaagaggagtggtcggacgacggtgagttcatcgagctggaaggagggttaggcatcgtcgccgtgacgaggaagacgacagcggggtgtctggcatggagctagagaggaggccacacgaggtcacaggaagcgggtggcaaagctgcggcgagcggagcggaggctgatggagaaggagatggaggcgctgctgtggagctcgcggtgcagcggccgccggagaaaaaaaatgaagaagggagaaaaaaaagaaaagaagggagaaaaaaaataaaaaattcaacgtcatcgtccacgtggcgtgtcacgtaggcaagactacggtcaaacgagactttggaccgaaatgatacaataaaccaagtttagagatctcaatgtgcgttttacaagtttgtggacctaagtgaaacctcacgataattttaaggaccgctgatgtattttacttgaaagtaaatttattttgaaacagagatagcactcaacaagttgaggcgtcgtaaaccattatccgttaccacctcccagaccgacggaagcaaaaacgggcggattattgatgcgtgcaagggcaatatgggcataacacacaaggaatgaaggagacagtgatctactagtagtccagtacccatggccgtgcgtgcggtgcgggctttgcttgctaattaaccccg

SEQ ID NO: 43566 - DNA, 636 bp, Oryza sativa
acaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatca

SEQ ID NO: 43567 - DNA, 1501 bp, Oryza sativa
attgttcatgccgatcaagaagctcagcatcaggaagaggaagagcttcacatggtggatgatgcaacaatgaccctcgagcctatggatgaggaggataatgggttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagttcaggcgctgttggagaattgtgaagtagcagagcagtcaatgaaaatgtcgatccagccacccaagttactggctcatctaccccagaacagggcccggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaccaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggca

SEQ ID NO: 43568 - DNA, 408 bp, Oryza sativa
catattatttttgtagctaacatatgggccccatcatttttagattttttttgtgtggttgatatgtgggcccatgatttttattatttttctgagatataattgccacggtcatcgccacatcaatgtcacgtgggacggagacctagtcaaatggcgccatatcagctaaaaccgccttcaaaaccgccaagggcaccggttttgacagattggggaccggttgtatctggttttggggtttaaggacgaaaatcggatttgttgtaaaattaagggacctcggatgaacttattccttcggcctatgattctatggaagcccgtcatgaccaagcccacaaaaccagagccttcccattcccacaaaacctacgcacagttcggatccgaccactccacgtctcc

SEQ ID NO: 43569 - DNA, 1501 bp, Oryza sativa
cctccatgcttacagctggcatcattgcatcaagacctgcgtgttgaataacaataatgttccacttaggatcatttccccatttatgcacaacattaattgttggtgatgaagaagaagattccaaataggcaagaggacgcttagcttcagatgagccattcagttgtggaattgggtgaaacagaggatgaagagatgtctctctaagtatgactcatattgaagtccttctcctcggtagaacgtgtgcctagtatggttgtgttagtttgcctgttcgtgtgtgtgagttagcatgtggacaatatcagggttgtgatatagctatatgtattaagttgttaatttgagtgcgagagttaaattagagtttgagtgtgtctgaatagttaaatagtaaattactccctttaaaacaactagggaggtagcctgcgcattcgcgcgggcatgtattataaattgtgtttgaaaaacttatatacgtggaatatcaattgaatgacacctgccatatttcaaaagtattgtttctccataatttttttcatcgacattgcttagataattttttcaatctatctgttagcttctaaaatatataatatttaatacatccatataaacaattatctatctcttcattatggagttagatttggtttgttggaaaaacgtgtctaacaaattaagtgtaaattaaaagtaaggtgttttgtcttgtttaattgaaagtttagtggctttttcaactaatcctaaataactattattgttaataaatatgtcctaattgcaccatcaagttagtccttctggttggaaccaaatagttcaatttattgacattttatttttcttgttttattttatatcatttcgaaatataggtattatggatcttcaaattgttggttcaattatgaatacaaaaatagctagattagaaagcagtatgtatattttaatttttttattatttctcgctataaagaacattcaaggggagagctcaagctgagagaaaaggggaccggtagtattgtgttgtgtgcatgtgcgggggagggtgaagtgtagtggtggtttatttcttttctaaatgatttaagtgaaaaacaataatccaatacttctctcagaatttctatttttttttctaatttttaagacgtaacacatggcgcggtttcagattttttttaaagtatatctattagttaaaaataatggatccacctatttaagtaaaaactgatggtttaatctttttcttacaatttctaagattttatttttatttaagacgtaacacgtgatgtcttaagtgcgctacagaggatgtacttgtgatattatacatttgtcatttttttataatgttatcttgtttttgctatttggttaccacacaaaggattggtgtctatgatcaaatgacaaatttttatttttatacagtaaaatatggctaatatggatcttatatatttattta

SEQ ID NO: 43570 - DNA, 199 bp, Oryza sativa
cgtccattaatgaagagaaatcaagttgaagggaagagagaatgagtccccacacaaaagaaagagagggagagatggtgcatgtggtatccccttgagatataaaaagaggaccttgtctacttaaagaaaaaaaaagagaagacgatcccagaacgatcgggggctggaaggggggatgatctggagagggttttta

SEQ ID NO: 43571 - DNA, 1501 bp, Oryza sativa
cgccaaaacggcttattagggaataaaaatgaatttgtaaataaaatttttatatatgtgttcttggtgacttaaaagccaatgctgaaaaaaaaaactacgttgaaaatatctcaaaatcgttctcaaaattaagtttgaaaatttaaaatttggttttttttggtttatctaggccatccgatgggagcctaagtgaaaaggcatcatgaccggatggcggatgctcatgccggaacagttcagctatttgctcttttggcttgtgttcccaaaagtgaaaaaaaaacacacttgttttcttcatttgcttcaggactgcatatttgaagatacttctgaaccttctttttgatatgcatgatttctgaacttggtgaatgtgatacctaagaagcaaagatgataaactgaattttcagtacaataaaaccaaacaattccatggtactgaaagcagtactataaaatcttcagcacttcacaagcaaatactagcaatattacaagataagcacattcgaattgttataagtgtactgccttttcttgtaagggaagatatgaaaattgtgccatctttaattatattctaaacatccttcatgtgctcaactgcatgaacaattacacaagtttcaagagaacatatggaaacacatggagtaaggccgaatgacagccaagagaatgagtcgcactgctgcctagcgcaccaccgtcgctcgcgagcacaggaatgacgccggggacgaatcacaccgccgcctagcgtgccgtcgtctttcgcgagcgcacgaactgaatcttatttattggattggattaattctaaacgtagaaagctcttttccactttctgtcaaattcctaacatacccttctatataatgtaagtatatactcatagtataatatactgtaaaagttatatttctgtaagaagttaatcacacctatacgatcttaagaacaaaaaaggaggatttctggtgaatgccaaccaaatttcaatcaccccactgcacaaccgatcgaaatatttacatcacaatatttaaattaaaatattcacattatttcagttccaagagcaaatagattacatcagatttaacttacacccaggtgcaattcagcacatctaaccactggctaaattctggggtgagggtcatccatattagccctgcacccagaattaatttttgacactgaaatcagcctaccaattaacacctatataaatttatgtacaatgcccaatatttcctacctcaccccggtaggacaagaatttacagtccgtaatccgtaatgtatattcacaaaacaacacaaaccctattctgctcttcacaaggcaagcgccttgtaccattgtccatggaccttctctgatatgactgccatctttatcagcacctccccggccttgacaaccctgtcggcgagcttcgccgcgccgaggcgtcgcagcggcgcttcggctagcttcttg

SEQ ID NO: 43572 - DNA, 1501 bp, Oryza sativa
ccatggtcgacggatcgatatctgccgcctcccggtcacccccactccttcaccggctgctccgctcttgcgccctgcactcactgccgtcgctcccaccgttgtctgagccggccgtcgccaccaccaacccaagtccgccgtcagggtccaggaggaagtgggagaggagggttggagtggaagagaaaaataagtaggcagagaggacttgaaatgagtggggagagaggccgtggaaaaacgagaggagctcatctggtcaaaataccttatattttgggacagatagagtatgtgtgtgcggaggatatacgatgaagggtattgtagactaatttaaataaagcattttcttaatatttgagaattgtaaaataattgaatatataagcaatagtaaaccaatacttaacaacctaacgcggttgcacaagcccaccgtacaaccagagaaaatatgtattgcaaatgtagtatatagacatgtgagatttgtccatattactacaagtaaaagttttactctaatatttaatcatgagtaaaaattttatggaactaaagttttaatctggtgatgtggacaaatcttaaacaaagtgtccatttttagatcattcgttagtttctgggtttgcgatatatttttcagcacaaccttacctgattgcacaaacccaaaccactccacacccggagtctactccatacccagagatatcacaaaaaataatgtttagctctctcataacactcaccttattaattcgaatagttttactctaaaatcagatatgtgcaaatttacacacaagatacaacttcacgacctgttaccatatgccttacaatatacctccgaaatgaattgtcacaaacctgttagcattacacaacctaacatgagcacacctacgtcagcttatcttgccacttcttagtctagggcctcacatttgatcatgttatatataccacaaagtcaatttccttttctacgtacgctaactcgtgattagtttggtaaatgttttacaacagtagctcgtgaatcggtctttaatttttatgagctagatcatcgaaaccgtcaaaaccgtgtgctcataacccaataattaagcatagatgaagcattaattatctttatgtgaatctagtgtttttaagcatgactaattaagtaaagttaaaataatctagccaaaacattataaagttctaagctagtccaattataataccggttagaaagaataggtgatcaacaatcaaaggggtacgtcacacgcgtgaacttagatatcgtgagtattggtagaagatatcgttagttccaaactaaatcttgtaaactttatgtacacactgttgtctggaacttcaggattgttaacaatggaaaagaattgcacttttgtcaccattattattaggagaggacacacgagaaagagacagggatcgctcccattaccatctactactaggcatcaaa

SEQ ID NO: 43573 - DNA, 1501 bp, Oryza sativa
accaaactcaatcaatacatggatggaagttagggtattgtcctctattcagggcccttttaaatcgtaggaatgaaaaaaaatagatgaatagaaaaacacaatattcgagcagaaatgtgaagtgtaaaatagaggattgtaaaacacatgaatgatcgtttaattgggccacaggaaaaacgcaagaatcggatgaaagaaaaagactcaaaagaatttttccaagaggttggacctcttgttaaattttctccaaaacctacatgcaatgagtcattccatagaaattatataggatttcgaaaactccaatcatttgaatcaaaggcccaaataggatattttcctataggatttcaatcctatgaaatttcttaataaatcctttgatagttacattctggtaggaacctggatatacccatcctaaattactgcattctggtacgaacctgaacggagagagtgaatgttttggttttggggtggacatctgggattccctgttgtcatcttgaccattcctaccaggctaccatttgtgttgggcctcatgtagtcaagggcccctgaaatatgaagctgaacctgaatttctatttctgaagaaaacgaagctgaatctatgactatgaccattgtcttgttcgcatggaggaagcaatctgagcaatgtcagagctttcgtgttgtcgaacggatgggaatgctcaatatacagcttgagcaacagacagattatcaaactgcttttcgtttgaaggttggaacttggaaatcatgctgtcgatgaaggagtcgattggcgagggtattaggcgtaagaagggatttccatgctgttaggtgctacttgttcttaactgtgaagttcaacgattcattgctgaactctccaagggttcatttggatggaagggattaagttgcagacttgccgtaattctgtttgagaaggatttcagttcagttttactgccaatatatggaggttagctctaaattcgccctttatggaaacaatgtactctgtcagatattcagattgtcaggctgttgttttttatgtcacaaagaacagtgggtctgtagcaaagtctgaaattatgttatcttctctaaaactagtctgaatatatcctctgaaagacagaaactagtctgaaattctgatctctgaaactagtctgaaattctattatctgaaactagcctgagattctactctgaaactgcactacaagaatacaggcacagcaactacagaagttctttcaaataatatatcaattacagtagtcaggacattctattatcttaaactagtctgaaattctattatctgaaactagcctgatattctactctggaactgatcgatgattcaatactacaggcagcacaacttaaagaagaagttctttcaagggacatatcaattacactagtcacagacatgttgtacaatttgagatcaacatcaaagacgaacagaaat

SEQ ID NO: 43574 - DNA, 256 bp, Oryza sativa
cctattaatgtttagactgttggttctaatggtactgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 43575 - DNA, 297 bp, Oryza sativa
tcaaaagattaccatagggtgagcctaatcacggtatatctggttgaccgcatatacccgcgggcacgactacccgaatagttttactctgataaaaggtgtacacctgtacccacaagacacagccccacgacacgtttccgtgcgccgacatgccaccacgacataccggaaagagcccgtaacaggacccttcgcataaccccctctaaccaagcacaccacacctcaggtttcacccccactcctcgcaaggcagcggccagtcccctctcgtgcctacgtgaatccggaagc

SEQ ID NO: 43576 - DNA, 660 bp, Oryza sativa
tacgtgctcatcctcctcctctacaagtccaatgaggctcacgctaccaggaagaagtgcatcagccaagtcgagggtgacagcgataaggcagcgaccggtgttggagtcaagaggatcaaccgggagtgccaacggtgctggaagatcactgaggacgtgatccaggaagcaatgtggaaggttggagggtgtcgcagtaggatgctggtgctaccggaggatagccaccagtgcatgaccgcctgctgcggcgtggagtagggatggggaggctatgtagtcttttgcagtgatgattgtaggatcaagcatgaatactccaagttcttcatagaggtgatgaactacttgccatagtccccagatagacaggacatcaaagtataccagttttggtgaacctgtgatgtaaatcgttcaaccaacaatgagtatgcagtaatagagaaaaattgcagcaaattttttaatgtgtttgagcaaatgttttaaggtgttgaacattagcagccgatgattagttgaaaaattagaacttttacagtacaacatactgccggtatatagataggaaaatttggagtcctatcgaaaattggagaaaattttctagtaatttcgttgttgagagtcaattcggtccaattaggactcgtt

SEQ ID NO: 43577 - DNA, 1501 bp, Oryza sativa
cggcgtcggggttgggggtctcggcggacgccatggtggtagggtaggagagagagagagagaggggagggaggaggtgggctctgcggcgggggggttgtccgtgacaagacagggatctaggttttgagggtgatttagcggaggattttgtttataaacgtccactactagtctatactcccaaaatacaaaaattttcacaatttgaatctttgcaaaaactattttcacaaatgaaccgccgctaaagcttatttcaaaaataacccttttgttcaggcactgaacttagacacctcagcgccaaagcgtggcgctgaatatgcgttggcacgctgacttagtctcccatccgcggtgccattgcattcagcgtcagttgatatggcgctgagttgtctaagttcagcgtcaggtgatttaaataagttttggcaacaatttatttgtaaaaatagtttttgcaaagggtcaaattgtaaaaaattcagcccaaaataagttaatataggctttgtttagatccaaaaattttggtaaaaaacgttacatcaaatgtttgatacatgtatggaacattaaatgtgaaaaaaaacaattgtacagtttccatgtaaattacgatacgaatcttttgagcataattacgtcatgtttttgacaatgtgatgctacagtaaacatttgctaatgatggattaattaggcttaataaattcgtctcgcagtttacaggtggaatctataatttattttgttattagtttacgtttaatacttcaaatgtgtttatgtatacttcaaaaactttacacaaaaagaactatacacacccatagtcctctctacatctcaaaataagtagtagtacaactagttgaaggaaactgctccctatagtatcaaaatgtaaaaactgaaaaggtcaattaggtctagagggggggtgaataggccaatttaaaaacttaagaaaagcggaagcagtaatttttggaacttgggtgggaattttcggaacttccgaaaggattttcgaaacttccgaaaatgcacagaggagcgcacacaaacagaagtatctagatctagaagactaccacatgaaaagaaaggcacatacaacaactagaccaatagcggcacaagcaagcaaaattagaggagagggatgaaaagatatcaccaaggtgaagcttgcaaacttgttcccggagttcaaatccttgggggattctactctccgttgaggagctcactaagagccgggtcttagctaaccctttcctcaagaggttgcactaagcactccttccactaagaggtatctcttcccttgcggaggcgagatccggccttcacaaacttctcccggccaaccacaagtagatcggtgactcgggagtgacacctagccgtctaggagtcctcaaccttcaagagtaaaagatgatgcaaagaactcccggagattatgcaagtgctcacaaatcttcac

SEQ ID NO: 43578 - DNA, 1501 bp, Oryza sativa
tgccattctggggtgcgcggcacgtggggccataaaacagcctcgtgcttttgcgggtctcctcgcctcctcctcgtcctagcgaggagcttagggtgcgcatccatctgccactcacgcgaaaagcccagctggcaccatgtagcaccggtccagctaagagcactgtgagaggcctaacagaaccaaccgatacgctaatatgaatcccagcatttcgacctcacatgatcaatactccttctgtcccataatataagagattttgagtttttcttacaacgtttaaccactcgtcttattcaaaattttttgaaattattatttattttatttgtaacttactttattatttacagtactttaagcacaccttttcgttttctatatttaaaaaaaattaaataagacgagtggtcaaacgttgcaagcaaaaactgaaaataacttatattgtagaatggagggagcagaaggtagtatagtcttccaatatctattactacataaatgtcaagtagcaccaaagtacagtggccttgatctctctactaagacataaattaaagtagttcatgtagtatctgcaacaataaaagctactacctccatcccataataattacatttctagaaaattagagacaaattaacaacaaacacaatttaccacaataaccctatttaataactatgctgcatacgtatattccatatgtatacttgattaataggaaggttgaggaacacattccatatgtaaacttaattaaaagaaaggtttgggtacacattccatttgttgcgtcccatcttatcagaaatacaatatttttaggacaaaatttaaatggtagaaatgtaattataataggatggaggtagtaaatcacacgtagcattgatatgtgtctcaatggatcaaagcggtactgatatgaaagccaagtaacatgtatccctgtcatggatcgaagcactactcaatggagtagtattcctgacatctatcccaatagacaagtaaccctcacactatacgctatgtcatatcacaactacttcatctataagtaaacacatggcatctacaagtaactccctcacatggatgtgtctgacacctatccatgtgaccaaaaaaacattgtgactccaaaaaggtggcttgcactgcccaaaaaattgactcctttaccgacctgcatcaaacaaataaattttcagtgctagctgagtttttctacaagtgtcctcagttaacgaggacactctagaagtgtcttacattgtggatgccttaaggggattagcagtgcgccacctatttttctcagcctggggctgtcacataggacgaagacacaagaagaataatacttgccacaagtctcacagtgctacatagcctcaaagagtagccacacaaataaaaaaaatcatttctttctcccttatcctcagtccgctccccacctacgcgcgcttctccatctccgcc

SEQ ID NO: 43579 - DNA, 376 bp, Oryza sativa
tggggtaaacccctagtcggtgtgcttgtggattgggtagacaagcttccgctgttctatatatttatttggccggtcggctaatgtaactaaagtagatgtagtttataatcgctttcatcttatttgtgtttgctatgtataatcatgcttgagatgaaagtgtgaatctattgcacatcctgggaactagattcacatgagtatgagttaagaatatttgagatgttgtagatctttagccatttttgtcaagtctcctgaatgtgtaacacatctggtcgccgccttcgagtggtttgacgggcacatctcaggttgaagttgactggcaggttaaaggcccagcaatgtctccaatattcttctctcgagg

SEQ ID NO: 43580 - DNA, 1501 bp, Oryza sativa
cacactaccggctaatgctccgatgatcgagcatcattagtcaaccacgtacacggcctacttaaatgtagacaatgaaatggcagggaaaaataattttggtgtccttgcaaattgctacagcgaaatataaagcgttctcaatgcatcgagacatatatacatattcatgcatgcggcacataatttaatttgggggccgttgaaacagagcattcttacacaagaattttgctggaatgttatgacaagcattttgttttttaatccctccatactcgtaaaaaaagtcgttttggacagcgacacgatctccaaaacacaattttgacttcttgtttctataaaaatatttattgaaaaataatatatgtatacttttatgaaagtatttttcaagacaaatctattcatataatttttacattttcaaactcaacaaattgagagttattcataatttatatttccaaggtttgacttaaacattgtcctaaacgactttctttacgagtacagagggattagtacatattaagctcagtgaacatttttttttcgtgtgcaagattaatgcttgggctctttattttcagcttccctatcggattactgccgttgattatactcctcgcttctaaaaacgtgagttctcaaaagaaaaaaaaaacttttattgtgttgtactatttagaccgcttattctaagctggtagtatttgttcaactattttgaaatatttaatatctctaacttaagtagataattaacttgtggttgcaataatctggttcaaaccgcagagttatttactacccaaatcgatgtgtaatctcctgggagttttacctggttccttgtccgaggagactgcaaggtataagaacgtgccctaaaataaaaggcctttcagagggatctccggccggttgcatcagatacttggccccatgggacgggacaggggagatccctgggattaggtgccaagccgcggccgaatgacttgcaagtacagcgtctgttcaagcaaagcatttcctcgttctttagatgggctattttgggtgtgtttagttttttgggtgtaaagtttttagagtgtacggatatatatttgaagtattaaatatatactaattacagattctacctgtaaactgcgagacgaatttattaagactaattaatccatcattagtaaatatttactgtagcatcacattgttaaatcattgcgtaattaggctcaaaagactcgtctcgcaatttacatgtaaactgtgcaattgttttttttcacatttaatactccatacatgtatcaaatatttgatgtgacgtttttggtcaaaattttttgatctaaacaacgcctttatgttgtgtcccgtggttactatgcaactttgtcgagaacttttatggttctttaaagtatctcctaaaaatagtaaaacaactagtactattactatctccgttattacaaaataaatt

SEQ ID NO: 43581 - DNA, 1501 bp, Oryza sativa
ccgctgttgacacgtggaccgaaaaggagttttcgggttacaaccgattgtacatgaacctacagggttgcacgcttaatgggccagaatatggggattggatggagatccaatatgagcttaattcggatagggatccaaataggagtcctacgggccttggagtcccgagtcatgcatcctatatattcgtgaggggtgtgactggcggtcgtattgcatcacgtgagaaaccgtagccgccactcccctccccgagcaaaaccctagccgcgcgcggttggtagcacatctgcgcgtggcattccgtccctatacgtatggataccggtagaggcgccgctgctttgcggtgttgatcggcgtgggagtatggcgaggagaacgctcgaggaggagaaggtcgagccggtgcgatcgactacttcctctacatcgacgcgcgctacttcgcaagggttgcttcgcctccttagcgctttcttccgctgcgcagtgcgtcgagtggtaacgatctatgatctaatacttacatggttcctggtttatgcgctagaaaattttgatttatgctatcgtagcctgcgcgtatccctacagtgctatcagagccgccttgtatagtttatgatctaggtcattgcatatagttgatatgcgggcgtagtagatgagatctattatgtagtagttgagttcttggatgatcggaacatgtaatggaccaataggcacatgggttgatgagatcaatcggtatatgtgttggtgactttactggaatgtctagtactcaccacggccaagcaagattgtgttcatcggatagttcgatatccactcgaactgcacgccaatgagaaaaatgaaccaatgagattgacttagtttttagcataatttgattaccctattaaggttttcatatggcgaatcgtagatgagatctatgtaccccgtgaccttttcaggacgctgccctgaaacccgcgggggacggctcccccctcaacccccatgtgcgttgcccttagatttcgcttggtttttatattaataaatagaatttgattctatatctagcatatgatgtttatctatcttactttattactgttgtatattttatatgacatggtaggatagattccctcggaaaaattaattataatttatgcttttctaatagttgcacctattacggttgtgattataagtgatgggtttgccatagcagagtgtcactttttatcatgataaaataggatagatgtcggacatctatatggggagattattggtttacttaacaaggttatcaaaacggttttggaccttggggcataggttgggttgctatatggagatgtcaccccaacagcacaagagtcacatatgatgtaattagcaaggtgttgcttacctattttgataattgtctagctgtgatgccaaagctcactagacactaataaaatgaggatcttgctagagggaattt

SEQ ID NO: 43582 - DNA, 1501 bp, Oryza sativa
aatattttttttccttttcggactgggtttctcgcgcacgttcgcgcgtggacgcgtcgtcacctgcacgtgccgctgccgctgccgcacgagtactcctacgtgcaccggcattggatgccctgcgttttttagcggcagcaagtgttgggggagccatgagtatgtacgtggaattaaatttggaaatatattgtttatttaatttttttttctcaaaaatattcgagatgcaaaacttttttcagaaatatatcgtcggtctcgcataaccgttgcacgaaaatgatatgggaataacgttatgggtagtatcacgcggtgaaagcgcgagaccgcgtggcgcgagaccgttcggtctcgctgaagcaataagcgataccgatgccatgccgatttaattagtgattaattatcctaattagtgattaattactaattattatattaattgttaattgagtaattaatcactaatcaaatggagatgctggatagtgccgctgtttgatttggtgaaactgttcggtctcgctcttctattccgcgagaccacgcggtctcgcactttcaccacgtgataccgcccgcgacgtcacgtctacgttatttctgtggaatggttgtgtgagatcaacggtatatttccgtaaaaaaatttacatcccaaatatttctgaaaaaagaaattgaatgaacggtatattttcaaatttaattctatatacgtgtacgggtgtacatgtgggcgtagcagttgggaaaagcggggggtgttgctgatgcaatcactctcccgctagcggctagctgccccagcctcgtactaccaggctaggaaaaagagaaacagtgacgctgtagaggagttgtgaaaaaagcagtggagatggagatcctcgataggttttgtttggttgcttttttgcctgcgacgcccacgcagcttgttgtagcagaggcgaagcagactgactcccaagacaaaagcgtcatctccgccgtccccaccgtgtctgccgctgcttcggcttttcgagctcggctctcgcttcggcggcgtcatggtggcctggcgggtggtgacttttcggcacaaatccagccgaccttgtcatccacccggccgaatccccaacctaccacctccgcatcagtccagtccctgctcccacttgggcgttgataacctaaatgtaaatgctattcctacattagaggaaggtatttctctttgagcagatacaataaactattttagctagtgatagtgtatccacgctgacgttattgatgatcaggatagggaacagggtgtgagccggcgactaattagttgccaactacacacgagctccaaggcgaaagaaacaatacaaaagagcaagatgaagcgatgacggcgggagcaggctgtgacgcgagatgccaaattaaaaaaaatgatatattaatccattgaagtttgtgcatatagccggctgctgtactatcgatgagt

SEQ ID NO: 43583 - DNA, 470 bp, Oryza sativa
ctacagctattagaacctaagtatcatgtgatacctcgcaagtatcacatgacaccacacaggaatcatccgacaccgtacctataggtatcagaacctgatatcgtaagtatcttgtggtacctggtaagtatcacttgatacctcacgagaatcatctgatgcatcgcatgtatcgatgaatatcaagtgatattgtcgtaggctttccggaccttccattatatttgagggatgaagtgaataattcaagtcatcaaacaaacataatgaaacatccgacacctcgagagaagaatattggagacattgctgggcctttaacctgccagtcaacttcaacctgagatgtgcccgtcaaaccactcgaaggcggcgaccagatgtgttacacattcaggagacttgacaaaaatggctaaagatctacaacatctcaaatattcttaactcatactcatgtgaatcta

SEQ ID NO: 43584 - DNA, 1501 bp, Oryza sativa
gatacctcttagtggaaggagtgcttagtgcaacctcttgaggaaagggttagctaagacccggctcttagtgagctcctcaacggagagtagaatcccccaaggatttgaactccgggaacaagtttgcaagcttcaccttggtgatatcttttcatccctctcctctaattttgcttgcttgtgccgctattggtctagttgttgtatgtgcctttcttttcatgtggtagtcttctagatctagatacttctgtttgtgtgcgctcctctgtgcattttcggaagtttcgaaaatcctttcggaagttccgaaaattcccacccaagttccaaaaattactgcttccgcttttcttaagtttttaaattggcctattcaccccccctctagacctaattgaccttttcagtttttacattttgatactatagggagcagtttccttcaactagttgtactactacttattttgagatgtagagaggactatgggtgtgtatagttctttttgtgtaaagtttttgaagtatacataaacacatttgaagtattaaacgtaaactaataacaaaataaattatagattccacctgtaaactgcgagacgaatttattaagcctaattaatccatcattagcaaatgtttactgtagcatcacattgtcaaaaacatgacgtaattatgctcaaaagattcgtatcgtaatttacatggaaactgtacaattgttttttttcacatttaatgttccatacatgtatcaaacatttgatgtaacgttttttaccaaaatttttggatctaaacaaagcctatattaacttattttgggctgaattttttacaatttgaccctttgcaaaaactatttttacaaataaattgttgccaaaacttatttaaatcacctgacgctgaacttagacaactcagcgccatatcaactgacgctgaatgcaatggcaccgcggatgggagactaagtcagcgtgccaacgcatattcagcgccacgctttggcgctgaggtgtctaagttcagtgcctgaacaaaagggttatttttgaaataagctttagcggcggttcatttgtgaaaatagtttttgcaaagattcaaattgtgaaaatttttgtattttgggagtatagactagtagtggacgtttataaacaaaatcctccgctaaatcaccctcaaaacctagatccctgtcttgtcacggacaacccccccgccgcagagcccacctcctccctcccctctctctctctctctcctaccctaccaccatggcgtccgccgagacccccaaccccgacgccgaaatccccaacaccgacgccgccgccgccgccgacccagctgccgccgccccagctgccgccgccaccgaccccgccgccgctggatcgccgtcgcccccgctcccgccacgcaaacgccgcctctcccctacgccctcccccacccgccgctcctcccgctcccgctc

SEQ ID NO: 43585 - DNA, 928 bp, Oryza sativa
ttttatcatgctaggtaagaaactgagttttcttgttgaaatgatgaatagttgctctgttttatatctcttttatatgggttcacgctagagtactctctcaaagattgaaaaaaagtagccacatattatccgggaacctgaggtaagtgggctgcacttgctgaactaagtctaggttgttacaagatatgagagagtaataagagctgctatgatcccgttctaagtttgacttaaactccggatgttttattttccaaaataataaactttgaagttcctcatttaatataaattcctaccagagccaaaaatattcacattgacaaacattatacattttggttacttgcaattccattgaactttgtcaaattcttgtgacttgtgtagatacttttcatgctctatgattaagatcatacacccacatatatgtacatgctaaactcctacactaggagctagcatttattgattccatttatccacaccaccatcaaaataaattctccatgcttttatgtgctttcttctcctaaaaagaaaatcctttccgagaaaaaagagagaaaagggagggaaagtcatggttatgaaaataataaagttatgctccctcaattatgagcatgatgatggaaaaaaaagagaaaataatgtgtagccatgccctctccttacttataaaagaaggatttttggagaaggaagtaagcacaacggagaagcattttctttatttttccacatttcatttccaccatatatcacacacacacacacactttgcacgatcttgatcttgagtatgtctagtcatctactctagtataagcttttgacttagtaataaatgtgaatacaactatgtcatgtttgatacctaccaagctccacatattaaaccttagagcagaaatca

SEQ ID NO: 43586 - DNA, 438 bp, Oryza sativa
aaagggcactgcgagttcaaaagaacagcgaaccaagcttacagaacgataaaaggcacctagttctagctaatcacattcttaataataggagatgtctaatcgtaatactaggttaatatattttgggatggagggagtagattatattaagaaacagctttaaaaatgcccctctggtgcagacagtctgaaactctgaatgcaacccagctcaaacatttactttgtaagttatagggtctttaagaaattataagaaactaatatatttgtgatggaatatagtatatcaattgtcccagcataatatgacttagtggatacctagtggaaagtgcatataaaatagaggtattatctagcatatacaaaaggtaatgtatagcataaagatacactgtaccacaaatgttacaaaaggatgcaattaatctt

SEQ ID NO: 43587 - DNA, 1501 bp, Oryza sativa
  unsure (1)..(1501): unsure at all n locations
aaagagatacaccaaggattgtgcggggcacatcaagtggcgagaactattgcgtccaaagtctttcggcagggcgtatactggccaaccgtcctcaaagtatgtgatgagcagatcaagaagtgcgaaagctatcagcggcatggccgaagtcagtccattccccagtataagctacaaccaatcgcaccagtatggcctttcgctagatgggggcttgatataatcggcctgtttcccactgtccgaaatgggtatcgcttcaccattgtggcagtagagtacttctctagatggatagaagcagaaccgcttagctcaatctcttcaacagcagtacataagtttatttggaaaaatattgtctgtcgattcggtgtacccaaagaattcatcactgacaatggcaagtagttcgattcttaaaaattcagagaaatgtgcgaggggctaaaccttgaaattaagttcgcctcggttacgcacccgtaggcaaacttggcagccgaaagggcgaacggcaaaatccttgacgcactaaagaaaagattggagggggcaccgtagggtatatggccagacaaagtgttatcggttcactaggcccttcggataacgcctacgagacctaccaagattagctccttcatgctcttatacggcgatgaggctatgatgccaagtgagctaggggctaattcgccaagggtaatcttctctgggggtgaagatgggcgtgaagtctcacgcgaactcctagaaggggtgtgagtcaaagcacttgaacacatggcgaaatacggcaatgacactttggcatcctataacaagaaggttcgaccgacnnnnnnnnnnnnnnnnnnnnttgtgctaagaaagaaggcgaaccagatggtcgttggaaaactgaagtcaaagtggaaaggagcatatcttgtcaagcacagatctagaacgggttcttttcagctggcgacattggagggcgaagagctaagccactcctggaatgccgcttcgctcaggcggttctatgtgtaaaacataggtggcacccattcaccagttgtaaatatgtaaatatggtgttgtaagccttcagcacgaaaatacaaaaaaaaggaaaataaaaaaagaaaaaaaaactagatgaagggttattatccattctggaggcccgaaccagtataaaaatccctgtgtgtttcgtctcttgtgtgaatgatgtcttggaaaaaaaaaacctctaaggcaaacacctgcttaacgaaaatgacaggggtgcgaagtgaatcggtcaaagcatcgctcactgaacactaaaattacaacagctcgttttcgatcatgcatcgatcatcgcattaatcggcttacaaaaagcacttagcatttttaaacgtttgctaaagatgagaccgaggtgaaagacgagagttgagaagtcgaacactcatcactaaaaatgaaaaagggtcgaagtaataagccctcaaacaaa

SEQ ID NO: 43588 - DNA, 1501 bp, Oryza sativa
agccataattggaacccaacttatgcatctcaagcaaataggagtcatatctgtaatcaaaatgcaagtgaaactctctcggggagcacttgaggccgcgccgaatccatctatcagtatctgaagaacggagagaatgatatctgtcacatatgcgaagtcggaatgtgtccaatttcgcgggcgatccacagcgataggccagcacattatctgcaaaatcctcaaacttttcaaggtcacttcgggagattgcccaattctcactggcggccgcgaactctctctggtcgatgtcgaggcatggcacggagcgccaaagatgcctccacctcttggagagcacgctcgtctgaaccatctgtcggcccttgagtgaggagaggatggtgtggaggagggcgtccggcagcgcgctcagccggtcggtcgccggtggagatggtgtctggacagctcctcttcctcgcggtcgccatggatgcagaataagccaaccctgcaaatcatcaatcaggcatgaacaaaaaaaaccccacattctaacaaaaatctatgggcctgttcaaatattggtagtgtgtatagaattttggtatcaatcctatcaaaattttaacaatgttaccaatttatctaaattttaggcattgccaaattttggtaaggttcaccctaagaaccaattctatcaccggcgggaagtccaagccctcttggtccgctgactatagaagctcctaatcttgcttctctgctcctagaactcagctttgcaaacttccagatttcagaccaaatgcggtacctcgtgaaagcatcaatacatctcaacaattacagttctcacaaaaataaccgcagcaagcaatgcacgcttcttagcaatctacttaatgtcacaaatcttgtgctggtgggcttcaatatgatggtatgcctttctatcctggataatgatatatgtatttatcttgcaactcttattatcttagaccaaagatccacatctgatcttttgtggtgattattacttatagcttgtatttcgatgcatgtctagcttgatgcttgattttacctttcttacaactgatccagtactaaataaagctgtacttgttaagatcggataattatattgttatctatagtgtgtgtttcttaccgtatgttagttttttctattgtccgatgaaagccagcaaggagcactggccctggtcctgattagtctttttggtcttagagaatgtgcatcgtgattatggttacaaaactttgagatggtaattaagttttctttgtgctgtgatatctcaaagttttatttttgctgtgatattccaaataagtcatttgttcttgttattttgttctgtaacacttgtgagcaaggcgagctgagttacaaactcacgatgttcgctcaaaaaaagagcaacactaataacgaaattactctgcactctaaagtctatgctagtaactttgttgggcc

SEQ ID NO: 43589 - DNA, 714 bp, Oryza sativa
caccagcgtgtttcgtgtctccacactacaacaaaaatgcatggaagagacatttctctaataatatagaggcactttttaaatgtctctagaatattctagaggcattttcaaaaatgtctcataaatgctttctagtgaattgaggcactttttaaatgtctctagaatactctagatgcactttacaaaatgtctctatgccttctggcactttcatagaggcacatttttaatatttataagagagtataggcattttctaaaggcattaaaatcttccaaaaccatggcaaaccaatgtaataaagaaaaaaaatcacttcccttgcaattgccaatcctttaactttagacttattgcatatattatttttaacttgaatggtctaaccatctcaacctcatgttattacttgtacatatgtgccgcgtgttacttttatgtagttaattagcttagattaaatttcctataagtgcctctatagagattgaaatgtctcaaaaaatgcctttacataaggcaaattttaaagtgttgaaaaaagtgcctctacaagataaatttaataaattgtgctaaaagtgtctttagattaaaagcgttttagacaatatttaaagtgcctctaaaagatgtctctacactttagaactcttgattttaaagtcattttaaaaattgcctttgcatgacgtttttgttgtagt

SEQ ID NO: 43590 - DNA, 438 bp, Oryza sativa
aatttgggagagagcttcaccactagcggcacaaactgttggaaactcgactcatgccacacctaagttatcagacgaagatggatttggtaatcggttgggagtacgggtcagtctaccaatagcacagtgctgctgctgctgctgctagcaccacaatcttggccaacccaaacagatatcaaatcagctcataatgtggacgtcacatacccaattgatgagcacagatgatgaacacactggagtatttggaccatatgggatcagaggaactgcaaactagtgttccaaactgtcaaacatgctactgtatttgcatccgaaagaaagaacatgcatgctcccactgatgatgcatatgcgcatcatcatgcagggattcaagattcacgccgcgtgcgatctgatccccaatcccccctctccttttgcagt

SEQ ID NO: 43591 - DNA, 292 bp, Oryza sativa
gagatcaggtaccgctaaaagtatgggaatcaggtttcttcttctattgtgggacaacaaacaatctatccccgtttcaacatctgactaagtaaacaaggattagccacaatcaccatcaattcctacacggaacgccccccgcgtcgggcgaatcggatggggggttttgcagcgggaaggatcgggatgggagggtgcggtaccttgagagagcgcaagtggctcccggcgatgcggtacatctctgccgtgcgcgtcgcggaggcttggaggaggcgaccggcggaga

SEQ ID NO: 43592 - DNA, 1501 bp, Oryza sativa
tatcttatgtatttgcacaaagtttttaataaaactaatggctgactaacaacgatggcatataaggagaaaatggattgttcggtagtatattgtagaactaaatttgttagtggcatattgtagaacccacacaattgttaatggcatagaacggattgactcaacttaataagatatccttaacaacccctggaagagctgtctactaccatgttcggcacctttgtatattcttttatttttaacaaattaataagtattttttgtgactcgatgttattccgttacaattaaaacatgtcattgagtattgactgtgtatcccactaaacggatctgaatcagctgcagtcatagtattgactgtaacttaaataatttgcagctgctgtattggattgaaattaaacggtactacatattagcttggcaatgtagcaaaaactgttatagtataaaatattgttttatgtactactgtttgagtagtggagcggtaaatatgagcttttgatcattaaaatgaacggttacaatacatgcagtcctatggtgcagttgtgtctgcatcggatctcaatccccactaaacaactactccctccgtcccataatataaaggattttgagtttttatttgtattatttgaccactcgtcttatttaaaaaatttgtgcaaatataaaaaacgaaaagttgtgcttaaagtactttagataataaagtaagtcacagaaaaaataaataataattctaaaattttttgaataagacgagtgatcaaacagtgcaagtaaaaactcaaaatcccttatattatagaacggagggagtacctcttggagtatggagaaggagaacattagacgcatcagttaaacatttcaagtatactgagcatggacctctaaaaaactcttcattccctccgtaccattatgtttgggttctgttgtgctcccttttcttctcctaacgcaagcgggacacgaaaatcttttacatgtactctagaaaatgaacctcttaattcaatagcatgaacaaaacgctgcgcgttgaggaattgttgttgcacctaccaaaccatccaaccatcaaagagcacaattatgcagctgttgaagggcctgacgcgaaagagcacacacaccacgtttcctccaccaataaattccatctctcattctctcaccaacaaaaaaccacgaaccagcgagaccagaccgtctcccctggccctctctccgattcagcaaaattgccacctgtttccgcatccgcctctaccgaggttttagacaccgcggcgcaggcgctcttcccatttctcgcgtcccgcgaggcagccgcaactcgccatcaccacctcccgatccgcgcgctttctctcccgcgccccctgcggatctgccggctctggaagggcgagagggcgctggagtcgtctcggcggcgctagggttgaagctggtgggggaaggaggaggaggggca

SEQ ID NO: 43593 - DNA, 1501 bp, Oryza sativa
ccccatactatacaaataccagaatcgtgacatcaaacatcgacaataatagagattgctaaaggacgctccatcttgtttacaaacaaggtcaaaatgatttgaaatcaccacattaacacaaaacagatatctcccaaaaaaaacagagagagaagaaacctacatcagtaaccatgaaggatctacattattataacggtgtagaatgcagattgactgcatatatattatatttattgtagctgtcacagttgtgtgtgtatgtgcgtgtgtgtatatatatatatacacacacacacaagcaaaatgcccgtgcatcgctacgggtaaaagacatataaaatattttattaggctacatattgataagaaatttcaatgacaattcggatggataaaaaccactattgcatactgaaatacttgctctttttcaactcccgcgtggtaaagtgcgcgatctcctttttctaaaattatacctgggctcgcgtacaaagtgattgtgtcacgcgtagatgacatataggcagtcgagggagaagacgtaggcgctggtaccaacccatcactgattgagagaagggagaaccagagaagggacaagggaagagcaggtgcgttaagtgaatggcaaggcggataattcccttctaactgtcagggtccttaccgaagcgagttaaaccgttagatgattcaatcggacgattcaacatggtccgtgtaggcgacgaatgaaaaggagtgtgatgatcggaaaaatccgtttttttaagtaggaagggataaaagttcgtgtattggtactcgggcagaacatccttgaatgaaagaagcatcggcatgcatcaacaaaagctgcccgtcctccctgctcgcatctccttagcctagcccatctctcatccaagctaagtttgacatgcccgaggagatacacatgcatatgtttggttgcttacacgagagatacggtttggaagagattttgtttggatgattttatggatgatcacttctctttatttagttaggtgaggttatctataaaatatcatattaacatctgattcaattaattaggtgtactcttcaacatgcaaaatatgatttttttactaatgtgtaaatcattgttcccaaaagatgtgaaaaaaaaaccacatatacagtatgtgtgtgtcaaacctagctaatgcatcacagctagtatatgtgtgtgtcaagcagtagcagtaatctacagttaggctaatctgatcttaatgatcaagacacgcatgagtgagtaacaaaaaatgcattgtcttagaaaagtgggaactgggaagcttgcgtgtgagcgcctgagcggtaggagaagaaaaaaagaaaaaaaaaacagaaaaggagcgttgtttcctcgccgcccccgataattatccgcatgtgcagttagtgaaaaaaaaaaacaaaaaaggagcatcgttccttcatcctctttcctcgtcctcat

SEQ ID NO: 43594 - DNA, 1501 bp, Oryza sativa
tacagttaggctaatctgatcttaatgatcaagacacgcatgagtgagtaacaaaaaatgcattgtcttagaaaagtgggaactgggaagcttgcgtgtgagcgcctgagcggtaggagaagaaaaaaagaaaaaaaaaacagaaaaggagcgttgtttcctcgccgcccccgataattatccgcatgtgcagttagtgaaaaaaaaaaacaaaaaaggagcatcgttccttcatcctctttcctcgtcctcatcgccactcgtcattcctctcagctcgccgccccgattcatttgcttgccgccggatctgacgcctttggactcgtggccaacgaatcccgcggcgggaggaaggagagtgtgctgaatcccgttggattcggccgcctagaggccggcggacactggatccaaccgccttgaagccaaaggccgcccgatccacagcgcagcagtggcggcggcgacggcctcagcctagagctagcagtggtggtggtgacggcctcatcctccgacgagcagcggcggcctcccccttctccttgatggccgcatggtaggtgtggatcgaaggtgaccacggctgagagggagattgatgatggtgttggcggtgagtcagtttggttctcctgttattttgttgaatgtctaatatggcagaagaattttgatccgtgatttggttctgctgttgttgatgacgttgacggataattgaatcaatgtaaatttcctcttcttgatttctaaggtgcttctcatctttgacctgtggatgtggaattttttttcctaacttataaatgtggatgggggatttgggcaactgtggatgtgtgattcttcgtaatctgtaatcgtggatggggatcgaggggggggggatgtttacaagattgggttatcttgagggaattttggttgtaatttgtgtgtttatgttttcgattcggttagcttctcatacgggcattgagacagggaagcggggaaattcacatcgatgtgacggacaaaaacggattggctcggataatgtgacgattggaaaaaatatgaatcttttaattagttaagatatagatatagatatatatatatattttttcaatctttaacaataagcaaaggaattgcaaacatagtacacgttgagccgccgcagccgcacaattgtgccggaaaattcagttagttatatagtttgtctgccacttctaaccaaattctctacctaccaacatgctccattatccatagaaacctaactaaagatcacacaaccagcaaagcagcgcagtatccagcatccagccacaagaaaacatgacgagaacaatgctgacaagagcggtacctaccggagagcagtcgtcctcggaagcacaggcgcaagactttgacaagtgccaagactgtgatgtgccaaatagcagggaacattgcccccctagaaaaaaaaggtactacggagtagcagcagacaaatagt

SEQ ID NO: 43595 - DNA, 1501 bp, Oryza sativa
gctcttagtcgcttctccctcgacgggatctagatttgggtcgtcaccctcgagtactagtcgtcgcccagctcgtcaacgctgactccaactagttgcattggttatcgctgtggtcgatgcgagtctctcaatctacatcagtgctccgcctgccttgtcgccgaccaagggagtaggcccctcctcgtgcctcccgtggcgcaatcgccgactctacccgttggggtcctccttcagcctctgctatggccgttaccgtcggtcgggtcctgctcctgcttccttcaatgcctgcaaccgccggtgtcggggtccccaacgccgccaacatgtcgccgccctacggttgcttccttcttgtcgtatgtgggtagccccgtgctggtatctactctctttgttttgtcttttctcttcccaatgaacttgtgcatgttagccaagggaggaaggagagaaaattggtgctaagagatttgagtcaactgttgtggactgtagaggatgtgctatttttgttgccccgcctcaatgttcttcaccgcaaagacacctcagccatcactcacagaccagcgcaccttcaccgacccgatgtgtgcacgtgtactgggcgagggcccgcaggcccgtaccctgggcgtggagctcgtccatctccttcctcccggtgttgtagcattggcgtcggcaacgccgcggacaacgataagccccaccacggcaaatgagaagcaacaagacacgacgttgcactccaccacctccctccagacaccttgcagatctcactccaccctgtacatgggtctcacttcaatttatttatttttaaccgaatactcactaacgtgtgggtcccatggttttatttgactttgtcaacaccacgtagatgccacattagttgaaactgttgttcaaaacatattgggatcttacttgaactggttttgagagttgagaggtgcgtcatattttgtattgtggatcaggaatgaatttcaaactaggcaataaattgagtgacctaaagtgaacttattccggcttttgttgactagtacaaaactgcacatccacttcagcccattcctctgttacatgatgctatggtgttatgtgaaactaatgctttttccccttttttttccttgagaaacacacggaaatctagacgttcactatgcgcgcgctcaccctatcaatgcacatatgcacatcacatcctattaataccttcggatgactagactgacatatcccttctttttataaagttaaggccaaaagctcaaacctcatgcttccacattattatcaaattgtgaaccgttggatgaatgcattagatcgcttctcagacgttggatggaatgcagcatagagcccaacccattagtcaccgagtgagtctcttcacctcctcagcgccaaatgtagcccacatgaacaaattggtccatctccacacacatctacatgtatccagcccgtc

SEQ ID NO: 43596 - DNA, 1241 bp, Oryza sativa
ttgtgaaacactctgtgaaagagcatgtagcctagtggttgcagtgacttaagtagcatccgaaggttctgagttcaaatcgttcttaacttaaaaaaaaaaaaaaggcaccccaaggtcctgagttcaaatctccgtaactaagttcctatttttttaaaaaaaaactgaatatatctggttggatatagaagtcgggtaaaaaaacttttaaaaaaaatgttgaaacactctgattcctttctttccatatctcctaagcaacacggacggtggagactcttttcttagtcatctctaaggtactggccaacgttgtcatatctttctttccatatctcctaagcaacacggtggagactcttttcctagtcatctttgaggtactagccaacattgtccaccaagtatggatcaaatatttccatatctcctaagcaacacggaggagactcttttcctaggcatctctgaggtactagctaacgttgtccaccaagtatggatcaaagtaacggagttccaacttattggcttgataagtgttggtttctcgcccttcatggcgtggccctggctctctctctctctctcttctttttttttttgggggggaggggggctagccttcgcctgctggagaagggttttatatgttttagctgtttaatgtaagatatatttgaacaatatgccactgtaattgatcaggctatacttggtcgattggtcctaacacaaattttattgcgattagtctcaaatgaattgtcaaatcaaaccaaccatccttaacataataggattgcatcaaagcagagaaaatcaattgtgcacaatgcatgtcacaacctagtcgaagtttgattccccaatcccaaccatcttaacatgaaagaattgcatcaaattagagtaaatcaaatcaaatcaatcatgccctattctcataacatagtgggggtcgaagtttcccccaacacccaaccatccttaacatgtactcgtagtaaatcaatcttgtggggtcggagttcaattccctgaacccccaacccatcgtcaaataccataggcaattgcaaatttactacaaatcgttattacaaaactgccactagaaaattataaaaataccactagaattatcattcgagtggtatccttgcaatattgaaaaaacaggtggcaaatttgcaaatgcccataccgtttttgtgccgctgacacccaccacatca

SEQ ID NO: 43597 - DNA, 1122 bp, Oryza sativa
aaacgacatatcaagacaaagtctagtatgtatgtgtgtacagctggactactatactattttaaagaaatactccctccgtcctctagtataagggattttgacattttgcttacactgtttgaccattcatcttattcaaaaaattatggaattattttttttacttactttattatccaaagtattttaagcacaacttttcgttttttatatttgcacaaatttttttaataagacgagttgtcaaacagtgcaagcaaaatatcgaaatctatattatagtacgaagggggtttaggttttagagtttagggtatagtactcacggtaagtttaaatcttccgtcgttttgtccaaccaatttattgacacgtttttcaataaccataccactatgatatcattgtacataaatcattgacatggcaactgctagtactaaccaaaagttgtcaggatagctacacctgagagaatgttagacgaaataagggagggaaaaagggtggcaagtccattttgagagtgcaattagaaagctgagtacattgcaaatcgacagcaaaggaccatcattatggacaagttctaggttgtgaacgtaaaaaggcctaatcaccaactccgcccatcaatgctttccaggggtgtaaatgatatactaaaccgcataaaaccacaaatcttttggattttttttctcatttcctcgaggccttattcgattaatttttatgagggagggattagagagaatttattccacacctattgtggtgtggaattattcctcccgtctttaatcctatctaaaccgaacaaggccctattgtggtgtggaattattcttccacagtcccctccaatatttttcaatccccttcaaaccgaacaagctctcacggctgccactcagccactcacatcttctaagggtgcgtttggtttacggtcaaggttagataggatatggcggtccataatttgctggatttgacgatccagttttttgtttggtggagtgagtatattgatccagttttttatttggttctagggatgaaggtggatttggtgatccaattttttgtttggttagagggagtaggatggatgaa

SEQ ID NO: 43598 - DNA, 1501 bp, Oryza sativa
gagttcggatttacgactatttatttagtggtagcatggtaggtggaatacccatacacaatgaaacactcacgatgacttcatcaattataaaactagaggatgccccgtgcgttgctgtgggacttggttaacatcaatttgttagataggaggtacaatctcaagaagaaacagaagaaacaaatagctttcttggagaaattctttttaacagctctatccaaaatttgtagataatttaggtagcacatgtcaactgaaggggcgttcagccataaagctcttttatacggattgacgggctggatacatgtagatgtgtgtggagatggaccaatttgttcatgtgggctacatttggcgctgaggaggtgaagagactcactcggtgactaatgggttgggctctatgctgcattccatccaacgtctgagaagcgatctaatgcattcatccaacggttcacaatttgataataatgtggaagcatgaggtttgagcttttggccttaactttataaaaagaagggatatgtcagtctagtcatccgaaggtattaataggatgtgatgtgcatatgtgcattgatagggtgagcgcgcgcatagtgaacgtctagatttccgtgtgtttctcaaggaaaaaaaaggggaaaaagcattagtttcacataacaccatagcatcatgtaacagaggaatgggctgaagtggatgtgcagttttgtactagtcaacaaaagccggaataagttcactttaggtcactcaatttattgcctagtttgaaattcattcctgatccacaatacaaaatatgacgcacctctcaactctcaaaaccagttcaagtaagatcccaatatgttttgaacaacagtttcaactaatgtggcatctacgtggtgttgacaaagtcaaataaaaccatgggacccacacgttagtgagtattcggttaaaaataaataaattgaagtgagacccatgtacagggtggagtgagatctgcaaggtgtctggagggaggtggtggagtgcaacgtcgtgtcttgttgcttctcatttgccgtggtggggcttatcgttgtccgcggcgttgccgacgccaatgctacaacaccgggaggaaggagatggacgagctccacgcccagggtacgggcctgcgggccctcgcccagtacacgtgcacacatcgggtcggtgaaggtgcgctggtctgtgagtgatggctgaggtgtctttgcggtgaagaacattgaggcggggcaacaaaaatagcacatcctctacagtccacaacagttgactcaaatctcttagcaccaattttctctccttcctcccttggctaacatgcacaagttcattgggaagagaaaagacaaaacaaagagagtagataccagcacggggctacccacatacgacaagaaggaagcaaccgtagggcggcgacatgttggcggcgttggggaccccgacaccggcggt

SEQ ID NO: 43599 - DNA, 1501 bp, Oryza sativa
atcctcgtacaagatttcagtacgcttcaactttcgacatcgaatcttcaacaggtccttagacttgctcgacttggtctttcttttccctatatcggaacttttggaggccttcgcagcgcacaatgatttgtataagctatcaaactcaatcaagtgagaataaaaataaatgaaggcaaatttaccttgcagcaccgcatagtgagcttctccaaattaggagacttcttaagaaggtgccacaatatcccgaaattgtcacctagatcacacttttccagcaacaaggttcttaggtttttgaatgtagggaattcaaatggtccctcatttggcatcacctaaaagatagaaaaatagaactcaataaacaagtacttgaaaccaacctgtttcattgtaaaatgaaagagaggaaacttataattttggttttaactgtatggcccaacaaagttactagcatagactttagagtgcagagtaatttcgttattagtgttgctctttttttgagcgaacatcgtgagtttgtaactcagctcgccttgctcacaagtgttacagaacaaaataacaagaacaaatgacttatttggaatatcacagcaaaaataaaactttgagatatcacagcacaaagaaaacttaattaccatctcaaagttttgtaaccataatcacgatgcacattctctaagaccaaaaagactaatcaggaccagggccagtgctccttgctggctttcatcggacaatagaaaaaactaacatacggtaagaaacacacactatagataacaatataattatccgatcttaacaagtacagctttatttagtactggatcagttgtaagaaaggtaaaatcaagcatcaagctagacatgcatcgaaatacaagctataagtaataatcaccacaaaagatcagatgtggatctttggtctaagataataagagttgcaagataaatacatatatcattatccaggatagaaaggcataccatcatattgaagcccaccagcacaagatttgtgacattaagtagattgctaagaagcgtgcattgcttgctgcggttatttttgtgagaactgtaattgttgagatgtattgatgctttcacgaggtaccgcatttggtctgaaatctggaagtttgcaaagctgagttctaggagcagagaagcaagattaggagcttctatagtcagcggaccaagagggcttggacttcccgccggtgatagaattggttcttagggtgaaccttaccaaaatttggcaatgcctaaaatttagataaattggtaacattgttaaaattttgataggattgataccaaaattctatacacactaccaatatttgaacaggcccatagatttttgttagaatgtggggttttttttgttcatgcctgattgatgatttgcagggttggcttattctgcatccatggcgaccgcgaggaagaggagctgtccaga

SEQ ID NO: 43600 - DNA, 1501 bp, Oryza sativa
ataaataatttaaaagtaatttacggccaaattatatttaaatttcaatattttctacatatcttcgcaggcggaagttttcttttttgcaagcggacgattcctattttcgcaggcggaccggactagccaatgtccacctgcgaaaattatcttcgcagacggacggccgccccgcctgcgaagatcgcgatcttcacagtcgttggcttacaggcggacggccgccccgcctgcgaagacccttttcggccgcttgcgataatgcttttcctagtagtgggtattcgtcttttggtgcagatctttgcatcaacaactataccgatggctgggctcgaatcagatgcacctgaaaccaagtatggcctgttgatttggtcttttgcaggttcatgtcgatgaaaacgggctgactcaattcacatgcacggcggggtttgggtgggtggggctatgaaagaaattgggtttttttttgggaaatttcaaaacaagggtgatgattggggggaatttgaaacaagagcattaattggggatggtttatgcaattattttgatgactagatgcaagttatgtatatttctcaacatgtataaactttcaattagaaacttttttctacacctaaacatatactattaaaaacagagccatcagtactttccaaatccaaaacaaagtcgtcaaatctttccgaatcaaacccatccatcggtactttctaaaacaaaaccgttaaattattattcgtagaaagttatttagcacggcaacactatttgcatctgtgtaaaaatcaattcgacacacaaagtttgatcggaacagtgcaaaaattatttattaaaatagataaccttctacggtaacaatatttgtacatatgtataaaattgcaagtagaaagaaatataaaatttctatacacaaacttattttttaatgaagtgaaaaatgtttaaccataaattcagaaacactttatggcaccaatactgtacatgcataaactttcaataaaaagttattaaactttgtaaaaacaatctattatctatgaagtgaaaatattttatccgtaaattaatttatgaacttcctaggataaactttgtttacccacctctcaactttgcgtatcaccagaacaatttactcaagtaactaaaatagtatcggaaaaatgggaagggaggtattctcatgctgcatgaaacggaaaagaaaagaaaatacgtaccgcaaattcttgcgtagcctaaaattctgcatcaccacccgtaaaataacaagcagaccaggagacagtgactaaaaagaaaaatgagaacatagcgtgacactaccttcgcccataaatataaaagttttttttctatggatctacacgacagatttttccgtgcggtcgaatcagattttctcgtgcggaacttcggcccgtctagagcaaatcgtctgcgaaaatcactatttttgcgtgtgggtgcttat

SEQ ID NO: 43601 - DNA, 377 bp, Oryza sativa
gtaggtatggcctatcccatcagagggtcattcgaacaacagccatggcaaatctccgcccattaatgagggagtaccaggaagatccccgttgttaggcgagtgatgacgctgggcctcactcaaagacaagctgtgatttagcttccaggcgaaggcgcaagtcagttttttcttttttggaaagatagggtgagtccccacccaaaagaagagtaggtagaagtggtgcatgtgggatccccttgagatataaaaggaggaccttgcccacttggagaagaggggagctcggagaggagagaaaaagaggaagagggtctctagagtttgaactctcttgctctccagctctttgtaactccttcacacacaga

SEQ ID NO: 43602 - DNA, 1501 bp, Oryza sativa
gatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagaaaagggcggccgtatcaccctcgggcccgacccccccccccccccgagggggttaggccacgtgggtgatcgtgtctgcctcaagtctctaagtcatgatactcccggtcccatgtgaaattttctttaaaaaaacatcatacggtaatttaggaaatgcatattaaggtggtgtttggatctagggactaatttttaagttcccatcgtatcgtatgttttgaaactaatttagagtattaaacatagattaataataaaactaattgcataaatgagagctaattagcgagacaaattttctaagcacaattaatctataattagcacatatttattatagcatcacataggctaatcatggattaattaggctcaatagatccgtctcgcgaattagtctagaattatgaaataagttttatcattaatctatatttaatacttctaatctaattaatatccaaacatccaatatgacatggacaaacagcccgattgaaaatcaatagtagacggcagccgtatataccgtctgggggtccccccattttctcccttttgtcctcccctttctccgtccggaggagccgaggagttgtcgtctgtccgtgggtctcgactccatcggtcttgcgcgctatctccgaggctccggcgacgcggctgggccttgtgcagcgacggccggctgctccgacgttagtccccggcgatcccatctctccgacggtttattttttttcctgcatctcttcaaacctctctaatgtttatttatgttcggtcgagtccaatgtactggagtaatgctttgagtttggttggaaaattcttgattcagttactgatgtagcaaaggatctcccgtttttaagtttggtgattgtgtgggttcaggtaagaaatggaagtggagaatttatagggcttttgttcgtctaatcccttatatatcccgtggagattggaggggattggggataataagccgttaccaggaaaaaaaaagagggttttttataattgaaatcctgcatcagccactatgatctgctagttgcatctccttttcaagcttaagctgattttgtgaattcgctatatatatggaaatggggattactgtggttgatgcaatatttttggcactcttgtagactgcagtggaattgctccgagagcagagctctccaggtctccatggatctggacaccacacgaaagcggcccc

SEQ ID NO: 43603 - DNA, 1501 bp, Oryza sativa
tttgcttccgaggagcaagtttgacttgcccgcgcatccattttctagaagtcccttcatccccatcggccttgaagggcttcgcccggggaggaagttcgccgtcgtacaaccggttcgcccggccggccgcctgccgcataagcagctggctgtattcggcgaccgacacatcgccaatcatcttccgagcttcagtgtcggcctgggcaagagttaacgctgcaaaaacgaagcgtgttatcatattaagcaccgaacaggacgaaagagcgaagcacggataaatgtaggaaatcaaagactcactgttcgccccttctggcatgatgagtctcgtcaagccatcgacctcttcgtctgggctcacctcgacttgccacgtctaggagagagggaagatccgaagcatgcaaaactctttcaccaggtcacagcagctaagacgggagcagaccttgcgaagcaaggcaaaccgagcttctatggcgccgtcgacggtgaccttgggcttttggttcggtgcgatcgccctgcgatgccatcggagagctttcgctgactcggacccggcctcgaaaaggatggagtgatagaaccacttcgacatccagtggcggtcccacttggacatggcggcgttgaccggccaaagatcggagtgcttgggacgaacgttgaagtttacgctcccgaacgctatctttttcatccctgcgggcgtgaccaccgttttcgaatttacggtggcataaaaaatagcgtcgaacagccccgctctcggttcgaacctagcggtccgacacgcccagtgaaagatggcgatccggacgagagccgatgggctcagttgggggagctccacctgaaaaaggcaaaggatctctagccacagcacgttgcacggaaaacgaagtcccgcctcgaagaacacggcgaataccaccgtccggttgtcgctgggcttcggcaccacagcctttcccggggcgaaggcctgattttccgccaacaagccggaggtaaccatcttcgccaactcatcctcgtccacgagcgaagtcccaagataggcggtggtgtcgtcatctatcttgctgggatcagggcctatcgcggaggctgggtttggcttgcgaggggccatggcgaaaagtgtgggcggtggcgaagaggggaacagtggaatggtctattgactcaagagcgctgtgaagtgagaggcggagaaagagaaagctcacggtgaaaatgacgggggtgcggcggtgaaaacgggggggggggggaatatataacccacccaggcgtcgattcgccttcccaccaaatcgtaagctgccacgtgtcacaagggtaggcgaaatggtaaattcccattcattgagccgcacagtgctaggcccacgaagggaagcccgtcgctgttcattgcggcccacaggaagaaataaggatggcttcgccgtttgcaaaaggcgaaaactaagaataatcacta

SEQ ID NO: 43604 - DNA, 430 bp, Oryza sativa
aatatatcacagtagaaattgataacctaacttgcattttggaggctggagaccatcctacaaacaccaccttttgttactatttattggttactgatgtatgttattgctattctttcttatacacttcatagcattttaacattttcagatgcctattttcagcatgctggtataattgacattcatgttaagttattttcttatttttggtattcaagttaaaaaagaggttgacttttgatggttgcaagcaagcactgcttataatgtgatatattttaggtcggaacataagttaatacttttaatgtaatcaaggtgttgagttttccttcaacagtcgagcacatgcttgtaaatttaattttggactatgcttttttgttttaaattttattgtcatgcatgcggcctatggttcctgtca

SEQ ID NO: 43605 - DNA, 887 bp, Oryza sativa
cctcatcgcagcaagtcatgcaagtaccaacatggttcaccgggcagccttcggccgcaaccacgcaccggacccctcacgtacaagcacaagttcggccggtcgctgcccaagcacacccatcggtacctgttcaggcgccacaagcaaggacggaagggacctcagccttgcaagcgcagtttcaagctttcctccagcaactcaaccaaccccacaatacctcaagtgcaactctttcggcccagccagaagggaatatgagtcaaggtgcacctagttggctaccgtcgaaccagcccaatccaggggctttgtcgtggactcaaggactgcagttcgacccaaatactgccactcaatcaccaaccattcgaccacaggcaacgacaccaggcttcggaacgaatcaagcgccgaaccaggtcaccatggcatggacccagcctacattcgaccaatccatggcggccccccaagcatcgccgttcggagccgggcaaccgaatgctgtgacccaacctcatgcgcaagccatgactttgcccttcaccacgccgtatccacagctggtgccgaacaaggcaggggggcgaaaaggggctaccgctgagcaggggaatcaagagtcgtccaatcccaccccagtgcgggcaaggcagtgatggccgttgaagaagtacaagccctccgcaaggagttcgacgcccaacaagcaagcagccatcaccagcctgttcgcaagaaggttagaaaagacctctactgcgcctatcatggatgctcttcgcacaccaccgaacaatgccgaaacatttggcaacgcggcaatgctcaagatccaatgtcacaacaaggagcacctgtcgaagcacctcgcgaggctg

SEQ ID NO: 43606 - DNA, 1501 bp, Oryza sativa
tgtttcgggctttcaagttgcaaccagtatgttaaactggttaccttgattatactacaccatgttgaaacttgcaaccagtaaattttacttcctccatccacaaaaattacacatattacacatttgagtttttccaaataagttgttcctatttgtagtctttatacattcaaaacttaaataaaaagagaaattaaatattttattagaacccaaggagtcatctaaatgtttattggttgcatgcttatattcacttcttgattttgtaacatccaaggtgatttaattttttcttggtctttatgtcaaaaagtaatatgtaatatgtgtaacttttgtggatggagagagtaccttagttttcattaaaatgtagattttgccatagtttttgttcgcacttttttaaactgctaaacattgtgtatcgtacgaaaaaattatatatgagaatttctttaaaatataaaatttatattctaagtttgtacataattaaaacttaatttattattatgtgttactgtctctctcgtattacgtgcattaactccaactctatctcgaagggccaatgtccgactagaagctcctttgggctttatatgtctcggccctgtaaaaagggaccacgtgggtctaacatttcaaggcttgggccagtccatatataggactgtgggcttaaacgtagcctgtccgacacacatcctgggctaggaaaaagtacaccaaaggtccctcaacttgtcatcgagttacaaaatcgtcctctaaccgcaaaaccatagcatcgcttaaccagtcaaaaccggtcacaacatgtcgttcggtggttttgaccctggttttgtcctacgtggcggctgagtcagcatgggaccatataggccccacattgtcaggctgaatcatctctctccctctcttctcttcctcggttcctcctctctctctctctctaggccagtcggcgactcggcgaggcaaggcgggagaggaggagggcggcgccgcgacggcggccggcggcggcggcagcccagcggagttccgcgacggccaaagatgggctcggggaagtggcaggcggtagcgaggcgagaacggcgcgggcgtcgacggggaggcacggacgtgcgcggacggcgcgggcgtcgacggggcgaggcaggagaggaggatggcggcgccgcgacggcggccggcggccgcggccgccgcagtggggaagcacggcggcagcccggcggatgaggaacagtcgtgggccagcggaggtggagaggtagcatgcgtaggacctgcggagctgctcgtcgggcggcgcgctgaacacataccggaatattctatcgtgaccgccctcggccaggactttggtcccctgcgcgaccctccccacggccgcctccccgatgctcggctccgtcctcactgtagaatcgatggagcaatgcaggccatcgataatcacaatgggaaatcaatctcc

SEQ ID NO: 43607 - DNA, 541 bp, Oryza sativa
ggagaagacgagagagacagagagccatccccatcactgccggcgccgctgccctaaagccccctcgccgagctccatcttgcggctgcctcctagagcccctagagcatggcttgctggcgtctgctccttcccgtcgtcgtccggatgcagctcccgcaagcgtggggcggcgccatcgtccaagggcagaagtccacaataagcgggccaacgggcaagtcctaggtcgccgccgcgcgtgcctacggctccctcgaggtccgactcgtctccccaacgccgctgccctcccgcccgccgcccgccacccgccactccgccgccctcccgcccgcagcacaccactccgccgctgtactggcccctgctcgccgaactgcggaagggggggaaagagagataggagggagagagagcgaggaggaagaagggatagacccacatgtcagtgggccccacaaatttttcctttgtgtgaatgacaaatgggtcccacatgtatatttttaattctaatgccacctaagcgccacgtcaa

SEQ ID NO: 43608 - DNA, 1501 bp, Oryza sativa
cgctcaaccaattttggttaagcccaacgaaatcccgcggattttgagtcgtttctatccttcgcacggacaatatcaatataaatccctttttatccttcgcgcagagaacgtcgatatgaatcggattagtgaatccgacgacggacgaaaaacccataccggaagccttacatattttttaagtaggtatagattagataataaaacatgaataatactttctgcgtgacttatatttttaatttttttttaaaaaaaattatcgaataagatggacgattaatggttgctctgaaaataggatggagggagtatttgtttagtacatttttattaaactttactgaaggttataggtaaatttatttcaaaaatttgtgagtataaaataattttatttgattcatattttctaaaagaatattgttgattaaaaatacatataaaatatatcttaatatttaatatattaatttattttatatgtatttttaaccaacaatattcttttaggaagtagtatgaatcaaataaaattaatatattttttgcaaggataaaataattttatttatatgaatgaaataaaattatttccagcctaccatctattgtttctagatacacacgttcttgtaattcgatacccttaaaatagtgtaaggtgaggtatctttatgcttgtggatttatatgtaacaataaccaataccaactatatgatcaactaaaaaatccaggcatgggtaatatttcacctcaaaactcgtgcagatcaatgttgactcaggcacatgtttatctgaaaccaatttacactatttttatgtcatgtaaagctgtctgcctctagattatatacttacatatttatatatttatatggagacatataatatgctagctaagtcaaagataatatatatagagaggttggagaaagctcgctgcttgtttaagagagaaattaacatgcgttggactggatatcaagcccaatcaaccagcgctccgaatcttcgatgctaggagggcgagccgccttcaacacttacgtgatcacttctccagcccaactaaattgggatgttaggagggatcagagagcttaatttgcagaggcagcaagcacatccatgggatgctggtgatcatgcatgcatgagtagatcatatggcatcatgcgttcggctacaaaattgtgtgatcatgcatacaggcatttacaagaccaaccagcacttctcagcccaactaaattttggcgcccacacacttgccatatgggcattgtcgtcgccgaagctggtgatgcgcaatgctagaccgagatcacgatcgagaatcaggagaccaagattaacgagtagggaagtttaacaagatctggtgatttgtctttaattagcaattttttttcgtccggtatatctcatgaatagaactaattatcaaacattttacctttgtcgttaatagtagtcacttttatctaat

SEQ ID NO: 43609 - DNA, 1501 bp, Oryza sativa
gaactacacatcaattaagaatagaaaaaaaaagactaatatgaatacaatagtagacatggcacctaccaccaagcaaaccatggtcaatttctcactagttgtacttgggaattcagagaggtacggcagcaaaacaaattcagtaactgagaactgtaaaacgaaatgtaactaatgcttctcgggccaaggccacgactcttcttgtcaggcaaaacaacgaacacctagcaagcattactaccgagtaccgacccgttcaaccatcatacaaacggaataagtacgggcatacagcagaggcagtgaggcacgggcgcacggccacgggaatacgcaatacgagagcatacaggggaaggcgggggatccattggaggtaacggatggtgtatacctcccgcggcctcgggaggcatggatgtagattgtagaccgggtgccagcctgaatctcgctcgcttggggctggccggccacgcacggacgccatccgtcgcctcctggacaactgaccgacagaagaggctggccatcgtcgcctactgaacaactgaccgacagaggcggctgctctgccatgggaaaccaggacggcagccgtcggtgctcaacggcgcaacggcccgtggccgtgggatcagcacctcggcgcgggatcgcttttcagacttttcagttctcccgtgaccgggaattctaacctagagttcagacttcatcagagtttccggctgggcgacgaaccaatcgatgcccaatgcaatgaacgtgtgaaaggctgtcttgacccccaatctcacattaacaattcctatggaggttattatttggttattaggattgattcaaaagattttcataggataggaaaagattcctccatattttaaagtatttttagcgtgagatctaaccttatgttttcaaattcctttaagaatttcaatacaacttatatctttctctctcacctctctctaacaaatcgcaatataatcttaagttttctactctatcataaaatataagcatttttagcatactgccaaatcaaatatttgtaattttaactattaatagcaaaaaaataagatcaatcatgtaaaattaatattactagatttatcattaaacaaactatcacaatatcgttggtcaaaatagcatctcgaagaccgtatcaaagtctaaaaatacttatattttgggacggatggagtatattgttcctgtgaatcatccaaatatctattttgagcgattcatgtggttttgttttctctgggattcaataagtcgtgatgacatatttctatattttccttatccctgtatttttaaaatattgtgtttcatagtagtctaaaagagaattcgcataacacatgagaaaatctctaaaacacgttgtcgacgtttgatgtcgcgattccggtatttgcatagtatggggatcgttggtactaggatatatgtgagactgaggtaaaagaga

SEQ ID NO: 43610 - DNA, 1501 bp, Oryza sativa
acttcttaattgaagatgcttcctgggaagtgtttgggtgaacagatgggcacctgcctaccttatttagatctctgaccctccaggctacatccagatctgtgcgtgtagacacgttcaagtagtgagttaatggttcctattgtttcctcatatagatttttttacttttctattgtaaaaaaaaacacttttcacccactgtatataggaaatgaataaattcttttcatttatagtgtaagattcagtcttaattcatggagctgaggcataagtagtagaaggaaatgaataagatttgcaaattgcagcagaggaattcaagggttttgttatcccataacttgtgtacgtgagttttcatattaaacagtggtactacatttttgacatgcaaagcctagctgcctaagccatcagatgcatttggagggatcattgcagatgtatcctcctgcatgacctcatggaatcatgcacgtttcacatttccaaatttcacacagccagattttattggaaaaattactggtttgttaactggccttccaaacctttttttatgggcatggcatgcattttatttactaggatgtggcatgtattctttagtggaactagccactaacttctttattcatgctgcattacaatctaaaaagaactaaactttatatgcacacagccctatattcataatctggaatgtggtattttttatccacaaccccgtaatcactaaccacacctctcctgtacagtttttctaatatatataattaaccataggggcctccctactgttcttcattcaaagaaactggtgtcatgatgtcggtcttttgactagggatcttaactagggcgaatatcaaaagaccatacatctttagtacaattgtcatgcaaatttattctcatgtggtgtcatttattttcagtgaaacaaaaacagggggaaaagaaagtatctcacaggagaaacaagggagcatataatcatatgattttttatattatggcgcatattgcgttacatgagctatttagtacagaacaggaagttgtttagttgccttacagggctattgatgccattgcaatcatacgtaagcagtatatatttaggaaagacttttgtgttatcgccttttgaagtacataagcaaatagtagatcatcagtgttcattatttcagtattataggattgcagagctggtaatgatctgtggaccaagggatggcagaatgatcaattgttcttgataacttgatgagctctctccattagtaccactggttttggtatggcacaggtaatcttctcctccttctctggtatctggaaagctgatgcagggaaggttttcgtaatcccagcaatgctcttgcagatgagtttcccagtcttttgttcatcaagggcaatctcctctactggtacccacaccatgagctccctagtcttgatccctttgactttcttgatcctcccc

SEQ ID NO: 43611 - DNA, 1428 bp, Oryza sativa
atctgattaaaagatatgatcagcaaaccagttgagcctatgactaatggctttagggcctatatcacgttttgcgtgagagtgattgtgcgaaagctgtttctgacattgactaatcaaatcgtggaaggtacccatagatatgcgcctttcaactcttcgtccttgttagcttatcgacagtaaccaaaattttaatcttcacacttaattttagagttatttaatcgtaacacatttcgatatttttaagtattaacttttaaaccactaagaacatagatatagtgttttacctgtaatttatctaaaactgtttttcgttgctttgttcactgctttttgttgcctttgttgttaaatataataatttttaactataaatttagatatatatttgtttagattcgtaattaaaagttgttatattataggatggggatagatgttttattagcagtagctaaaacgatcgtgagttttgggtgtgcggcgacccatccgagcgtcggccacgacgatacgtagtgggccggatggatggatcgctcgctcgctacagtcgtgaattatcgacgcccacgcccaagcgcgagggaagatatgtgctcagagtcgctgagcacgcatctccaggcagccggccgttgcttcatcgacacgtatacttctgagctcatggtcacgtcatcggtactgcaggtgggccccaacgtgcacgtgacccccgtatcataatcacgtcctgccacccttttaactaatcactcccagccttttgctgatcggtgggcctagttgcccgagttctgacaaagtaatcagttggacatttggaactgattactcctactactctagtgaaaattagggaatttgacgggaacacccttcttggctctcctaaatgcacggccggcaggtgccatctgctggtccctggctgtcatgctcgttcgttcgttaatcttgtgaagcttttgatacataaacccctcacgaaatctccatattacaggcagcagcacgcagagccacgaaacgaatccagacaaagcccgcgttggggcatctgcaatctgagccctacggttacagaaaggacaaatcagggccgttcatacgtaagggcatatccgtaaataacgtcaaactcgagggcgatttattcgcgagcaaaaacgcccaactcgtggctctcgtcccattcccacgcttgcgcaagcggaagaaaagagtagaggagagagactgagggagggaggcaggaggaaggaggaggaggaggacgctgcagtggtgggtggcgtagctcccgatccgggaagccgacccggtctgggggatttgctcctggcgcgcgctcgatcgagagggaggccagggttgggttggggggagcgtgaagaagcgcgcgcgcggctatgg

SEQ ID NO: 43612 - DNA, 1501 bp, Oryza sativa
agaaaaaaaatttaaatgggtcctatttgtcagtcaaaatgatgccacggcatgtccatgtggtatgccacatcaacgccacatagaatgctgaaggggttgtggcgatttgggacctatatgacacactatgacaagttctaggacttggatatgcattttgagagtttagggacctagatgacacacccctacaagtttaaggaccgcccgtatactttactccgattattttgttgtacgatcttacctagggtgcacgaaccaagattagaaggacattattacatggctaatcttatagattttataggtgttgattaggatactatgcaaatatatactcactctgtctcataataaaaaggattttggtggatgtgacatatcttagtacaataaaactggacagatagtctgttcagatttattatatcacatctatccaaaatcccttatattatgggacaaagggagtatctaaaaagtttgccttttaggtcctgttcgtttcttctaccatcataggattaaattttggatacttgtggcgcgcttttcaaactgctaaatggtacatttcgtgcgaaaattttctatatgaaagttgctctaaaatatcagattaatccattttccaagtttgtaataattaaaactcaattaatcacacgttattaccacctcgttatatgtgaaacacttaatctttatctttatcttcatcttcatcttctggagatttaaacaccaccttagacatgcatatattcagtaaaaagacaaaatgaggcgtagtgattatatagaactagacaaagatatgaaaaaccgagctatgatacatgggttagaaacatatgaaattcatagtttcaacgatgaaggaaagtagagatgtttataattatagcttgtcttatgcatactcactgtatgtgtgtacgtcacatcctaattaacatcaacttgataaaattaacattaccaagccattttggtccttgttcacacgaattagacaatttcgtgtatcaaagcgagcgttctataagttaggttaatgtactaaattacattcacataacaaggttatgtatcaccactacaatttactcaaactatatcataataccatcaactcatttttataaacctgtcttactataaaatcagtgcccaaagtatcaaaatttgaccataatttatcctaaatgtaaaaaatatctacgatcgattggagaatacatataccatggcaaaaggttcgagattcagatagacaaagaggcaattgcaaatttaccactattttgaatcgttattgcaaaactgtcattagaaaattacaaaaataccactagaactattattcgagtggcatccttacaatattgaaaaaaccagtagcaaatttgcaaatgcccccttagacaaaagatactcaacatattccagggaatatacgctgaagctcgaaatcccgttaaggttttgaacc

SEQ ID NO: 43613 - DNA, 1501 bp, Oryza sativa
gcaccgacgaccagtgcaaggatgtgctggactctctccttgtgctcatgtccaccggcaagctctctcgccgtgacgtgaaaatccttttgtttgacatccttgcagcagggaccgagacgaccaagatcacggtggagtgggccatggcagaactgctgcgcaaccctaatgtgatggccaccacgcgagcagagatgaaggccgcacttggaggcaatgggacgatcacggaggccgatgtggtgaaccttccgtacctccaggccgcagtgaaggagtcgatgcggctgcaccctgtggcacccctcctgttgccgcacctggtggtcgaggacggcgtgaggatcggcggctacgccgtgtccaagggcacgacggtgatcttcaactcatgggcgataatgcgtgactctaccgcatgggagagaccggacgacttcttgccggaccgtttcttgggcaagacggagctggacttgtgggggaagcaggccaagtttattccgcttgggtctggccgaaggctgtgccctgctttgccaatggtagagctcgtcgtgccatttacagtcgcgtcattgctgcatgcgttcgagtggcacctgcccaaaggcatgtcggctgaggaggtggacgtcaccgagcggtacacaagcaacgatatccttgttatggctacccctctcaaggctgtgcccctcatcgtcacctagttactgttggaccgtatgagatatatatactcgtttattgtatggaaaatttaaataaagtgttgatgacaataaaaacatggcaaaaaaaggtcatgctaaaatttatcttactgtgtagcgcatttgccctgccggcagttttgtatttttattattactagaaaaaaaaataaatgtgcgttgcaacgggtaaaaacttttttccagtaataaaatagctattatgagctgatgaataattaaattaaaacattagtatcgctatactttaaaattgaaaaggcgtctcctacctacctcccttcatagcctgtctctcttaacttccagtagacagttatgtgcctgtatggtaccggagccaatcatccctatcaaatctatgatctcccaaaattgattgagagctttggatccactcgatctcctctttccgttttttccaaaatcggagtgaatccgcaaaacttgggataggaacaaccgggggaagatagctgtctaaccatcattgataaccgttaaaccgagattaaatctagtgaattaaatccgaattgaaaaagaaaatcacaaaggaaaggatgagggaggagtgaacaatcgatttttgcaattaattagaggagaaaacacatggaaagataggtcgatgtggtggcgacatggtgcccgtgtggcgccatggacgactcgagcaggagaagtcgtcggaccaggaggaccaacggagaaataattttttttgtttgaagcagattttgttttttaagtaggtaaag

SEQ ID NO: 43614 - DNA, 533 bp, Oryza sativa
aaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaaga

SEQ ID NO: 43615 - DNA, 1501 bp, Oryza sativa
tcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtccc

SEQ ID NO: 43616 - DNA, 1501 bp, Oryza sativa
gcaccccgagtccagcctaaaaccattttgagggttttgaatagagggggaggtgtgaatccaattccgaataatccatccattccatagtgtccaggtgatgagaatattcccgaaatctagagttgtaaaaccacctaatgttacctaattaaccagcgaagcatctacctaaattcatactagtggtaccatgagtagagtgtcaactagctggggttttctttaatctagggtgaacaaggtaataatatcaataacaatagtaataaggtcataacaaaggtaaataggcatggctaaataaaacagtgataacgcgggaatttaaataaagcgataatgcaataatttaaatcaaaataattttataaactgggatttaatatgttcaaggatcatgtgacttgccttactcactttcccaaacatcggcttcaacctccacgaagagcggatcttccgaagctgcagcgtctacacgaccaacggaaaagaaaaggcttttactctaataaactccatataacaagcaggaacaaagcacaaaaatggattcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggaagggggcgcggaccgggtccatgggagtggggcccacgaggcagcctcacggtccacggtggatcgggtgcacccgggctcacaccggccggcgccgtgggtcccacgcgtcacccgcacccgtgggcgcgggcggctgacgaccgggccccacgcggcagccactcggcccgcccgaaggcggccacttggcgcggccggcgggaggcggcgcccgcgcccctatggacgccggcggcggccataatcacggtggagcggcggccgagagaggggaagggaagggggaaaagaggcagcggtccacggctcaccctaggtcgacggcgacgacgaaaaaggcggccggagcggaggaaggcggcggcgcggctcgggtcgacggggtcgacggcgttccggcggtcggcgaactcggcgagggggtggacggggtcgacggcggcgacggaggaaggagagagcgacggcgcgagctcgattccggcgaggaggaagggcggcgagtggcggaaacggacagaggaggtgcggggagggtttaaatagggttggaagggggagagagcggccggaggggaagcaaaccggcgcgggaggtcggccgccatcaatggcgctgccgagatttgcgggggcaaatccgcccgtttgaacacaagagagagagggaaaaatggggggaaagggagaggggatcacggggagtgatttcccccactttattgcacgcggggacggcgggatgcggcggatttggcggcggcggcggcgcttggcgc

SEQ ID NO: 43617 - DNA, 517 bp, Oryza sativa
ccgaccccatgtggaaagggagagggtatcacgggaaatatttccccccgctttattgcacgcggggacgacgggaggcggcgggattcgcggcggcggcggcgctagggcgcgggcgaggcggcgggagcggcgggaggtcggggaagacgggtgggccccacccgtcagcgagggtggcgggcgggcccgcccgtcagcggcgcgcgcgcgggaagaggccgagtgggccgcggggagaggagagagagagagggggggaggagagattggccgggccggcccaagggagggaagggggacttttacggtttttctttttataaaactttttcaactttgtttatttattagtaattattatttgtgctctaaaaattccactaaaatttatttacaccttttaggcttttaggaaatatacaaaaatcccctaagccttatttgacttttaactttgcacattttaattgttggaggctttcacacggattttaattattctaggcataattta

SEQ ID NO: 43618 - DNA, 1165 bp, Oryza sativa
catatatatacatatatatccatatatatatacatatatatacatatacatatacatatacatatacatatatatatatatatatatactagttttcttttaacatcgttctactataaatcatattattgaaatagcgaaaaaaggcacattcataattccatattaatttcctttgcagcccagctcaatgttggtctcaataaaccagaaagaacatatcaaatgcaatttaggattaactaattaatacatcataagattaattgcaatttggattgaaaaatataataatttagaagttttttccacaagaatttcaaattgaaaatccttcagtaacttctatttgaataaaaacatggctgtgttcggcaatagtgatttgggagaaaatcttcattgttattcgtgcgcacgtttttcgaactgctaaatgatgtattttttttcaaaagaagttctatagaaaattttattaaaaaattgtattaattcatttttaaatcttttttaaaaaatactcaattaatcatgcgtaatagtacaactcgttttgtgtattttttttcgatcttctctgttctcctcctcttaaacacaaacccttagataaaaaattgttgtgtaaatgcatgggacatcattcttgactttgtttatctattgtaggatgaaaaatggatgtttgagatttatctacgtcatcctaactgaaacttttacttatggtttaatttaggagtaaaagttttacttggtatgacatgtacaaatttaatttatacgtctatttttacatcctacagtatttttataggtttccattacatattagccactcaaagttgtgcatttgtgcgaccatgagatgcatctttgttaaagatcttaaattttttttttacaattatagtggtcttgctgtcttgcccctaaatgttactactgcgaagtagcccataaattacatactactacagcaatatctttattttttttacacaacaccaattcatgtatgtttgttttacttatttcacttctcaaatttaattaatcagcacgagatcaaacagtagtgtagtcattttccatgcaaatcaatatcctatagtgtatttttcatgttgtggactcttttttccttgccatgtgtcaaagg

SEQ ID NO: 43619 - DNA, 368 bp, Oryza sativa
tcagagtaaaactattcgagtagccgttcccgtggttataggcggtcaaccagattcaccgtgattagtctcaccctagtgtaatcttttgaatttggatagtttaggtggatggttgggcctgtcgtaacgtgggatagcgttggacagtggatagttaataataattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagttcgagtatgtgtcagatggagg

SEQ ID NO: 43620 - DNA, 418 bp, Oryza sativa
ataccaatgtttaaaattttgtaaccatatattgatgtcgcttgaaacaacatatttgcatgaagtgacacgttgctcgacaagggcatgtcatattcacaatgatcatgcatatgccgcctttcatatgcgcttgttgtagtagtggatgaagaatcaatgtggattgctacatctttacctgctttgtatggtctatgattttgttgtagtggatttagtatttgccatatgtgctttgtgtttgttcttattggaataaaaggacggacatcctttatacgctccatttatatcttaaaaacaaagtagcttcggatcgaatgtaagcacacaataaaattgtagagtaccgatgatggtaattagtcacgacaacgtactaggatatatccttatagaggcatagtatttaaat

SEQ ID NO: 43621 - DNA, 1501 bp, Oryza sativa
acaggggttaggaagaaagtctatattcagtacctcgactattcatatagtttgatttccattgctcaacaatattggataaaactcacttgtccattattaaaactatgaaaatgataacttggctaggcttatacgtggctttatgttaatatatatgcttctgggtggcgaaccaaaagaagaagacccattaggttatccatgtagtactatgattctagtcttctaggcatattctccccgcctcaatttttttctgtttaaaaggaaagaggacttgagatgcagagaatgtagcagatgagattgctaagaaaatgatgatgaggcaagccaccttacccaaaactttttacaaaaaagggggatgtcgaagagatgaaaacccaagttctctcctacagctgctcgtggcaccaaaagcctcagggatcgtgttgcgtgacgctaaacaggactagctgtgagcgaggccaaggacctaaccctcaatttaggcgaaccacgccgtgtactcgggacactagctcgaagcaggccttgagcacgctatattaatatggtaggacgtggcacgtctctccctcgtgtcgcacacctgatcttgcatttaatgcgaaggatgcaaatccgatggccacgcgcatggagaggagtggatgacaagacgacgcatgctgaccgtggaacaagcatcatcacccctaaaaagttgggagcgtgggttgtcagctgacataggtccttaacccggtgtactcgttgttagaggccgacgagtgggccaggctagcgccacccttggtttcgtcaccaactcctaggccacgcatcgagaccaggtgcaatgggctagcttgtagttggccacccatcatcgagcgatgggactagcctttcctaactcatgtgtacatgaagcccacttgtaagcgactgcccaatgtggtgcccctcgggctataaggggattcacaccttgaaaacccattaaggatagaaaccctcgcgagctttagagaaagaaacaatgcactttatgcatattgcagtaaataatccagttaagaacttaataggagtaggcttcactgctccctgctattggagctcgggctttgactagggaacattaattatctaagaattttttttttcagaagatcagtgcatttattgagaagaagacaaccattttatataaagcacaatattttattttgagacaatattcctttgactaagaatatctataaaaataagatgttttaaatgaaaatagtcatatattatgatagttgtttaataataaatctagtaacatcaattttatatgattgattttttttatttttatactatttcttgtcaaagttaaaaatatttgacttgacaatattataaaaatacttatattttgagctgaatagaatatttggctaacggggatatgaccatcattcgcaagcagcttacgatataaaatggagagagcata

SEQ ID NO: 43622 - DNA, 1501 bp, Oryza sativa
tcgggtccaccggcgacgccaagtgcttcaagcacaccggcaaaggcgagtagataagtgcagcggcggcgcggtgagtcacaacttcatctacggcaattgaaggatcctcccgccaccaaagtgattcaaatatttcggagtaactattaccaatttaattgggcccaatcaattctgttttggaggcccgtttgttctttgtgttgtgttaattgggccggattggtcggccggccacatagatgtgtaacatttgtatttttttcccaattcatttttggtcttctatcagtgtacgcaccttcaaaatggtgaatttttacagaagtttttgaagaagacttgtgctctgtatgcgtggcaatttactttaacgatcgacacgacggcatctaattctgacgaaaacgagagataaccaatacatacacatagtattaggctatgttcggcaccctgggttgggaacccatgtcccacgcacaaaaaagatagcgatccattagcgtgtatttaattaagtattagctttttttttcaaaaatagatcaatatgatttttttaagcaactttcgtattgaaactttttataaaaaaaatatactatttagcagtttgaaagacgtgtgcgcgaaaaacgagagggggagttgggaacctggggcaaagaacaaagcctagtaaagctagcagttcgtacaagagtgtggtaattgtgaattatccagggtctgcataaaatcgagtttaattcttcgtgtggttctgataagttccttgctgtacagtgtataatttggtttttagagaacgacaaatggataaacagcgtgttctagaactgtacatagaacagtgactcaaattaaggatgagaaatgggtggatcagggacgacacatgctatacatctctccaaattgttatccatttcgtctgtgttcagcatcagttggcctaattaaaactgataatcaacaactttaaaaaataacttatggcttatatatatataatcctgagcgatttaatgccaatacgaaccccaaaaaatcaattgaaaaactaaaataaaagttccaattttaacaatggcttatatttaagcaatcggtgcttctcttgctacacatttataggagtagagtatggattttgcagtgacaattaaagccaaacacacaaaattcacgataaaattaagaaaaccacacaaaaaaaaagtgagccatgcatagcgagagccaagtggcaatcctctagtacactcgcagctgtggcccccgcaaaatctgccacgagccaccaaaccccgccacgtgtcgaggtgggccccaccaacgaccggactactcccgcctcctcatccggttcccgccactcctatttatttcccaaaaaaataataaaaacaaaattcgacgaagaaaaaaaaaataaaattcggcggtaaataagcggggcgaaggaagaagaaaatcacggaaatgccactac

SEQ ID NO: 43623 - DNA, 1501 bp, Oryza sativa
ggtgacccgcgcggcagtcaggcgcaaggcggccggcggcccacggccgggcggcggcgactgcgaatttttttgaatgatttgtatattttggtggagcattttgttggttgatttagggatgattttgtgattaatttgtggattgtgattgatttgtggattgtggatgtggatgtattggggatgtattttgttatgcttgatgtatttttttttttgagattttgtgatgtatttgagtatttgagatgatcgattgtggatttggaggcaatttgaggatgattgatttgggattttggggatgggatggggtgaaatcaatatatattaaaaacaatgaagaaaagaaaataataaagagcaaccggatctagtctttttagtcccggttggtaagatagataatctttagtcccggttggtaacaccaaccgggactaaaaatggatttttactcccggtttttttacccgggactaaagataacgatctttagtcccggattcgtagtcccggttggaaaaccaggactacatgggggttacgaaccgggagtaaaaaccccttatccaccagtgcatactagctagtacatagatacaatgtaatcacacgatgcaagtagagagaaaattaaaaggtagcccgttcacattggcagatacctatttatgtgtggatgcatttttattgaattattttttactctattctaaatataattttctgaactaaaattactcgaaatcacgcagttttaaatctatgagaaaatatagtgtcgcactaatagagttgtttctacgaaactatatatcatttgtgttgtatttgtttattttttagaatatttaggatatcttatttttggagtttctaactttaagtaacatctttttcttatatactgtatacatatgtctttctatattttaggatatattggttggtgatattttctattaaaaatatgcttaatagcactacttcatctaacgaaagataaacttatatttacttatatttcctccatcccataaatctgagtattcaaattttataaaaaaaaacagggattttagagcactacctatcccatccaactatctcttatttatttttttacccaatcatactccaaccaccttcccactctcaacagacctttaatttaataaggggtgttatagtattttcccttcctccttaattttaggatccttaaattaatattttttaaacggtcaagctattgccgacgttttatatttagaagaagacgcatgtcccattttaagaagtaaatgagaccaaatcttacagtgcctagttaatttgggaaaactaagcgaaaaccacaattacaacaccacaccaacagctaacctaacctaaggtaccacgatggagcccgacacaagactctggccaagcttaacatataggtgacacaatagcccacacatgttatcgttgccaagcttgccacccaagc

SEQ ID NO: 43624 - DNA, 1501 bp, Oryza sativa
cgatcgattgatcgtcgcctctcgtcgacggggactgcccatgcgtctgcgtgccacactacatttattcgagctgttaacatccagcatactcgcatgtgaggcacagctgggcaccagctgctacctgggccccgctgcgcgacaggccacgccggctgcatatatcatacaacgccccatcttatggatgcaacagcaacctagcttgatcgaattaattcgtagcgaatgccatgcatcatcatattaaaccgattgttgttagggctcataaagtcataatctcgtccacctgtcgtgtcgatccatgtcgttactggttactggttaccaacccgtgatcgatgattctgattcattctcctcgtcttttagtttctttaattttgggtgattagttgtatggcctacccatcataggccatttgtacatcttatatccacagacagtgtcagtgtaatgttggcaaacattggacaggggactcacacagcggtccttttctctgagagtctgaattagcatctggttgtttcaggctcaagtcaaaatacagtaacatggctatcttcgtgctagagatcaagactccattataaaaacttcctagggcaagtacacaagattaaggggttgtttggttgatgtctaagcttgtcataactaagcttaggcaagttgtggcatgtggcaaaagtatggctaagaaatagttagccacaagtgtggcaatattagctctaattatctgagtatgatatgtagtacctaagggtaggaaagtgtggcatgacataactgtggcattgaaacaaacacacgactaaaaactgtggcatgactgaagtgtgacgtggtaaagtgaagcaatcaaccaaacacctcctaatttcaaaaagaagaagaagaagaagatgaattcagcctacttactttgagtgggtgttgatatgaactgagcttattaaatgatgaaaatgaaacgagcagagagttgatcaatccgtgtcgagtcaatatcggccatgctgtgatacagtggtagcatctgcagccagctacgagatgattgcaccgattgtttcctctggcctcgagccaaggatgtaattacagtacgtaattggtgctattcaggccagtttttttaagcttagattaagttgcgcggcgggccagggagcggccgtagagtatttgttttagtaatttagggtttagctaggcatgcacgagccaacgtggagaagatatcgttcatgtgcaaaacggcaaatctcttcccttcctacgtactactactactagcgtcgtccaaaatttgccgaccgaatccaaactcccatctgcgcaggcgcagcgacccaaaccgggccgcacgcggctacaccaccactacatataacacgcgcgaggggagcagcagcagcaacggccgcgataacacctgcgacaaaccgggccggggtgatcgagcgcagctagcgcgcggcgcca

SEQ ID NO: 43625 - DNA, 183 bp, Oryza sativa
cccttacatatgtaatttatatgaatttacaatgtaaatatatggtgactattttttggtaaaaaatatagcgccataaatatagctactactaaaaaaatagagatttcttagagttgttaagagggtaagtttgcttacatggaaaagagagaaagataatggcgacatcgactcatagca

SEQ ID NO: 43626 - DNA, 1501 bp, Oryza sativa
gggtgctagcggtggtggtccaacgatggttgttgtgcatgatggttgtgtggggttttgattgggactcattggtaaaagccttgctaggccatgggccagcatgactacgacgacgccattaggtgtcgtttcccttcttggaggcgtcgttctggcattgacctctcgtagcagcaagaaccttccgcgtgcaacgatagcattggtggactcctgcaatgcctctgatcccctacaagcctagggtgtttgacgaggccttcgctgccttggttctgttccttgctctacggcgggtgttcatcattcttatttgtgtactgctgggtagagtcggagctgcttcgttgtaggggtgcgacaaaacttggcaacggtgacacactccaatctttttataggattgttgatgctagctgcgtgcaggaactggttccttggtagcttaggctgatgtccttcatcgatatcgtttatgtttgctccttttggagttggggtagcatcgtagtgaagtcgaaactgctgtgtcgcttgggtggcaagcttggcaacgataacatgtgtgggctattgtgtcacctatatgttaagcttggccagagtcttgtgtcgggctccatcgtggtaccttaggttaggttagctgttggtgtggtgttgtaattgtggttttcgcttagttttcccaaattaactaggcactgtaagatttggtctcatttacttcttaaaatgggacatgcgtcttcttctaaatataaaacgtcggcaatagcttgaccgtttaaaaaatattaatttaaggatcctaaaattaaggaggaagggaaaatactataacaccccttattaaattaaaggtctgttgagagtgggaaggtggttggagtatgattgggtaaaaaaataaataagagatagttggatgggataggtagtgctctaaaatccctgtttttttttataaaatttgaatactcagatttatgggatggaggaaatataagtaaatataagtttatctttcgttagatgaagtagtgctattaagcatatttttaatagaaaatatcaccaaccaatatatcctaaaatatagaaagacatatgtatacagtatataagaaaaagatgttacttaaagttagaaactccaaaaataagatatcctaaatattctaaaaaataaacaaatacaacacaaatgatatatagtttcgtagaaacaactctattagtgcgacactatattttctcatagatttaaaactgcgtgatttcgagtaattttagttcagaaaattatatttagaatagagtaaaaaataattcaataaaaatgcatccacacataaataggtatctgccaatgtgaacgggctaccttttaattttctctctacttgcatcgtgtgattacattgtatctatgtactagctagtatgcactggtggataaggggtttttactcccggttcgtaacccccatgtagt

SEQ ID NO: 43627 - DNA, 1501 bp, Oryza sativa
gccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagc

SEQ ID NO: 43628 - DNA, 1501 bp, Oryza sativa
ctcgggcgcggactgggccgacttgggccggggagagagagaagggttttgggccgactttcggcccaaagccaaaagagactttttttaaaacctttttcaatttaaattatttatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttcaaggcttttaaaattatttctaaaaattccaattaaacaacaatttatatatttatgattttcagggtgtgacatggtgctagctggaagaccccgttgccattctcataacaatggatatgagaggaggagctctcatattggaaattattaagaggagtgaggctcaaaacaggattagctagaccactactttcagtgctagctggaagaactccatgctaatatagccagaggataattaatgtactgaacaagaatattcggagataattaccattacagctgcatattcaccttgaagtttcagagataatatggttgggagtattctcagtacagttgtatcaacttgacgaactgagttcaattaaaactttcattagcttaaaaaaaactgcatattcacagggcattgtcttggtactgttgtgtaagtacattgcaaaattggttctgtagcataataaagtgagtgctcacgtacttcttgcaaattgtatgcatcatattgacaaaagtgagcaagcactatctcaatatagttctcaacctacatgagtacatccttatctgtgtaggatgaacagtaacatgagattgtatcattgtagcgatggattagtgcaaattaaataaaggcaacttccgaagagctggcgcgatgtcctgtctattattcagattggtgtctcaagatacagcaaccatgttgtcttgttgggttgatgatcgatgattattgctgtaccctgtacgcgtcgtcctgttcgtattcatggtccaccagggattatcgatacacaagtgacggcaactatgtttctctatacattatacaatcctgtgtcagaaagacaaatgacatattttcttcttttttttcaaaaaaaaaaagaagccgacagagttttcaatctttgtttgaatttctagtgcaatggtatgattgaagatgggctatctgggcagcggcagccgtctctcgccgccggtcacagtatcacgtggatcccactgttttttaagagtaaattttataaaattaccagtataaaactacagatttaatggtaaatttatcacaaaactatatattagcgataaattcatcctaaaattacatatttaaggccaaacattataaaactacatatttaatattgaggttgtcacaaaactacatattttaaattttaaatccctagcactaccactatgaagctataagc

SEQ ID NO: 43629 - DNA, 739 bp, Oryza sativa
tcaaggcaactcgtctcaagccggagctagcgtgttatctcttagagatggcacgttagccctggttagatttataccaggcttcatcctaatcattacaggcaaggtgttacacaaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggtggattcttttccagatttagagcttagaacgggggagaagttggctgacactttgtagctcattcatacaccaatccacaaaaacacaggagtagggtattacgcttcccagcggcccgaacctgtatacatcgtccgtgtctcgtgtttcttcctggcacgcgatctttccacacacagcgagagcttgagatctcaccctaagcccccggccgaaccggcaaaggggggcctgcgcggtctcccggtgaggagccacgagctccgtcagacttgatccaaaacggacggccgagatcgatcggtccacgaccggctcacgggagacggggacga

SEQ ID NO: 43630 - DNA, 587 bp, Oryza sativa
acgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacaga

SEQ ID NO: 43631 - DNA, 1501 bp, Oryza sativa
ttctgcacttagctaaggggggccaatgtaccggccgaaagccagcacaatccggatatcaaacaagcacgagttttgtcaacaaagatgatctaatggtccaagcccaatcaattgtctctgacaagcatgaatagtaagcaggtggagctccactccaatccaatccaagggttcagcgaagatcaggagttcagacggggtaatgtcctcatcaacagtggtcccctgtggtcggggcgtggaaggaggtggaaccattccttacgccacaaccaacagcagcgccaatggccacacggatggagtatgtgcgtaagccagccaggaagacaacccatcaaatcactcatcgcgcccccacttgcccggataagcgtgccgctgttcctgtcctgggcgcacgccttgctcgcgcggcgcggccacaccctctcccatatcatatcgcccccaccccaatccgccaaacggcacacgcacacacgcgcaagaggacacacgggcgaaaaaacgcgcacgctttcgtgatcgagccgccctctcttctataaatggattctctactgtaattcacatgctaatcttccagccacacacctagtcagtcatcaaagtgtgcgtgcttctccagaacagtgagagagagaggggcaaagggaggcaggataaaaagccgagctgtaggggactaaagaagaaagaaaagcatagaaaagaacggcaagcaagcagctcgaggcacccgcgctagtacataaagccaccgaggtgcgatttcgcgagctctagccgcttccacttggccatttcccatctgcctcctggagctttagctctaactctagttctagctctagctccggctacgtttgcaactgttgtttatctcctggtgagtcctcctgtcatgttagccgtagattttggccggagcacaaggtgtttttgttgcttgctgattttacaggttgcaggttgttcttctctttcctgaaatggttttgacaaaagagctgttttgatctggggctgcctcaatcatttgcttctatggcaggctatacaccacacttttaagatgttttagcctcattggtattgtttatgtttcattatgagttattacgaaagactttaattaaaacaaacgtctagggtgctgcttgttgcacaaatgagttattcgttccgctttcaatttttcattgccagaacctgatcttaactccgtgtttttccgcgttctctttcgttctcgcttagacctcagcttacgcttcgggctggtttggtgcttttctccagcctaagttgagtgtagaactaaactttttaaggagttggttgaactcctctcattgccttcaaactcttcctactattctaggtggatagcatttagactcttgaagactttgagctagttaaccttatggaagaagggtccaacaaaagagaaggacttcctcctcaactcctagatctcatcccagatgag

SEQ ID NO: 43632 - DNA, 1501 bp, Oryza sativa
aaaaaacaaataaatcactatatgccacatttaggaagagacgtgagccaattgcttacgttgcattagagaacaggcacaaagaatacctttacagcacaatcagcaatataatttcacaaagcaatgtaattaaatataaaatgttagctaaaatggcaaattggaaattgtgtaattcagaactccatgtggggcaccatcctgcatatgtgcaaccttataatcaaccatcacctagcctacaaaataagatcgggacgcagcaatagtgcttatatagtttttaaacattatttttctttcagcaaagatattgcatcttacctgtgttcaccgaacataaggcagaaatttgttcccactttatccaggtatgccaactataatttggggtattccccaaaactatttgtaatggattgttccatttcaggtaataagttgggtttctgtgtcttgtattggcatcatgttcctatttccaactctctagccaagtacttgttgaaaaacagtataaggatggtgtacttatgatctatcaggtcaaaccagtgttttacagttgacagctcagcaatgctctttgttttgagaagaaaagtagaaaacatgatggctactgtgcatcagtaaaccttcccgtgtcataagaatatacaaggccagtttccttcattttcaaaatacctgtcagcaactcagccttgactagtatcattattcaaattttaaccaccaagaacttctaaattgttaggtcatattcaacaaaagatatgtgattacatttgccatgcaacatacttcaataatacaataatatgatagctttgaagtattttcaagttcgataaaaaagtggtcaaagtttgaataagaatagtgtttagtgacaagtattgtgagtttgtgacatgggagtagtaatattattacaagagaacatcttgggctacaatagcaagagcaataatatgactatattttgcgacaaaacatgtctaggtatgaatgcatttgaaagagatgtgaaactatagtcttgtagcttgcttactgtgaggctggtactgttgaactattatgttgttctgctttcacttcctaacttttactaagatgatgctgaaagttcaaacatcacaaggggacaatcataaaaatcagatttccagaagatggaaaagaacgccagccaggagacggtaaatagcaggaccagattctgtccagatggttctatttgacttccaattcacatattttttcctctaaatcctaattttcagcaacttgtaaatcaccaacgtcctccatccttccaccaaaaaaaaaaagaacacaatattaatactactgtgaaacagtaactcgtggccctgcatgctgagcaaggatcagttaactctggtttttttaatctccaagcaccaccagttaaaatagactggcattatatttccagaaaataatcacaaaatggatggcaatcccc

SEQ ID NO: 43633 - DNA, 1311 bp, Oryza sativa
aagtgacgcttggatctcgggatttcttgttaagggtatcggaggtgcaaatgggcttaggcctgaacagtacctcagctcagtatttttaacagcgtggcccattgtgttccttagggacttaggcattttttgctttggcaatttatgcgcacaatagtgttgcccaatgctgataaaatcctttttatgcggtcatataattctttggaattattgcaatgcaaattaaaaggtgcccgacagaaaggtgttatactgtttttgtcagctttattaggctacaaaagctgtctgggttaacttggaatgacttgtttttaccatagtcatttccttggtatgttatatgcctgttttcattatggtaaatagtcatagcctaggctattagacttattcattaccataatttttataatacttggtgggtaatctttagagttttttattcggatgcctgtcaagtgtgttcattcgtgaaccttttatagtgttaaccactcggatttcttttattatggctaaaaagcagtcggctagaatgcctctttaggcgccgcgtatgcttttgtcatatgatgcatgattgtgctattattttgttctcaactatatgtttagtttgttaactaatcacatagttgggggctacacctaattaggtgcatctattcgatgcaccatattctttatcttttcgccctttacagtcttcgtcttcgctactcggcagatcttggcatgaaaggtttgaagcactcagattattatctttgagaaggctatgatggttgactgcaaaggtctcgggggctactgtggagattatggatatcccatatctacacggcgatgatatttgggctgaatataggataccgaatatagatagaatatcttatttgtgtctcgggtttgtttctcaacttgtacaccaaggaaataccttgagacttagtcggctacgactgtatttgatctgtatttgcatattccgttagggatatagattatcttttgtaacacggactctttcccatatataaggggggtccgggtgcctctaggggcacatgttgattttctccaaatcatacaatcaataatacactcggcggattcatccccggacaggagtagggtattacttcttgaataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 43634 - DNA, 325 bp, Oryza sativa
tgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaa

SEQ ID NO: 43635 - DNA, 431 bp, Oryza sativa
taaaactgcttttgttctgatctccattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagc

SEQ ID NO: 43636 - DNA, 1501 bp, Oryza sativa; identical to SEQ ID NO: 31412

SEQ ID NO: 43637 - DNA, 173 bp, Oryza sativa
ctgacaatgagaaaggcaataaggtcagaagtcaggacattggtacctcaagctcccgagtgattgaagcaccagacaccagttgtgtgacactggtccaacacctgattaaccagaaccgattgcttatagagatactacagcagcatcagacgccaattctgaacctgagt

SEQ ID NO: 43638 - DNA, 272 bp, Oryza sativa
ccaagcccagaagaggagctccttgaagatgaaggttttggtgtctagctcgtgcctgccgtcaagcgcctgtggtcgtcgccctagtcttccgctggttctcgtttgtctttgtgtgtgctgggccttcgtcgcccatgtaataagttaactatttacgcttccgcttgttaaactctgaattgtatcaacttttggtgtaccttgcctcctgggacaaggattaatgcacgcacgtcaggaacgcccgttgggttatttccggacgtgac

SEQ ID NO: 43639 - DNA, 1501 bp, Oryza sativa
aaaaagtttctatacaaaagttgcttaaaaaatcatattaatccattttttgaaaaaaaaaagctaatacttaactaatcaagctctaatggaccgctccgttttccatgcgcactttgcatgttgggaacagctgattccaaacacagccttgattcgttttcgagatagaaaagaactaccacagatttgtagtgtgtcaagaaccggtttcctttgggtacatcatgcgtgagttcctctagttttgttgaaacatcatgtttattatccattttgtttgcagtaaactatcgacttgctatgttagaatgaacttctcatagaatagctagtcccaagaaagggactagctagtgtgctgtcgacagttttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctatgtaactaactagagtatgtaactagagtataagtgttatgtacctagggtgtaagtgatatataactacaaatgctattaataatcagaaagtgcccgtacctcagcgtaacgtgtggcaagtttgatggatagatcctagctcgttcaatgcttgtctagcccacacgagattttttttattctacccatatggccgtatatgttgcacgaatcctggagtgcatctaatggctagaaaatcgaaagttttctaaagaaaaaactgtcgccagttttttagcaaaaccgttgtttcttttttcttttagttacataaagagacaaaaaggagatccaacgtcccacattgtttcaatccccgggacttagtatattttgcactacttgacgagctctatacatccatggttcctgatcgcctattcgaacaacggtttaaaaaaattgaacttttgcgcatttgttctaatattccccgaaatatactaattcgaaactcggggcattacacaaccttagtgtgtaggagcattccataagtaagacatctcataattttcactttggaagaagtgtacatttatttaaagtcactctttcgtgactgaataaactaagaagcatcataaatccttctttctagttttcacccttattgttgctgctgcacattttgcttctatactgaattagttatgtctaggttatacttctgtgatgcaaagtgagcgaggctcaactaaagaatgccttgtacactacatcttgtcaagaatgatggacaactgtcacgcccagaaattcacgaaccagaatttctaagctgaatgtgcattaaacccatgtccagaaccagccagggtatacaaacgacaattgttgaaatacagatccacgttttaca

SEQ ID NO: 43640 - DNA, 1347 bp, Oryza sativa
ccgccaccgtgtccgccagctcgaagtgctcggcgatggtcttgggctccttggaggcaatcttctctagcatgcagttgtgtcgcacgccgttctagaacacataaacgaccgcgtgggccggtatgcagggaatagtgttgcggacctggcagaagcgctgtatgtatgagcggagggactcgtcgtccttccgttgtatagcgtgcaggtctgcctcctctcctgggcggggatacgtgccttgaaagttcgtaatgaactgctggcacaggtcctcccaggagtggatggagtcggggggctgagtcataagccagccgcgcacctgacctttaagagccatggggaagtaattcgccatgacctagtcgtcgccccccgcatcatgatgatcgtgctgccatcatatttctccgtgaggttggggcgaaacttcgggggccaccggactctggagactcgccttgaaggccctgcaactggtccctccaggggtaaatgtgaggggcgggccgcctcgcgtggaggagcggggcactccggatgaggaggcgccctccccatgcgggccgcccagtgctcgtccctgtgttgctcaatgttgattcgagcgtccctcctcgtagaggccaccatgacgtccccggcttcccgagatcctcgatgacgttggggccgtcgaccacctcgaagtcagggccgaccgacgggccctccttcttgctgacgaggaaagagcggtgggttacgcgaggtaccagaggcggcgggtcggccacccgcagcctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtg

SEQ ID NO: 43641 - DNA, 1501 bp, Oryza sativa
taagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcgtcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccgccgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttg

SEQ ID NO: 43642 - DNA, 1501 bp, Oryza sativa
gctaggttggttgctgtcgcctatcatcagcttgctcgtgaacaggttcatctcctacctcttcgacgcttcgccaaagatccaagagctggagattcagactgtcccgaagctggagcagatgctgcgaaagatagaggaagagaggatgcacaggaaagcgaagaaggagagatcagccgtgcaaaatctcgacacgctggcgaagctggtcaagtctgccttgtacgaagcagaagacgtcctcgatctcattgcttatcaccagatcgagaaggatgtcatcggcgatgacgagccacagggaagcagcagcaaatggcatccgcacatcgacgatgccatccacgcttgcaagacgagctggattgggagatgcataaccactctactggagtgggcacagggtttgtatcgatcgctacgcagcagatcagctgcgctgctaccgatttcttgtagcagatgctgcgggtcagcttctgactccttgctggagcggcttagttgcttgtccaggcaatttgatttcatcagatgctgccaatccctgttcatctggtcagtcaactggtttgaggttgctcgctcttatcgagattggttttatgatgcaactggcatcacagccacaggttaccaggttggttaccacttctctgccccctaacacacacacaccccaccccaatctagcaatgcatcttctctcaatctaggggaatgttcctattttgcatcaacactaatacactatgcaaaaggagttacaatgcacgggctatgatcttggtaaaatttatgtcgcgctcctcaattttattcggaaatcaatagttgctggaatgtgttaaagggtcttagtgtttgagacaccactaatgttactacatctaatagttcaatttttgaagtaacaagaaaaaatttccatgttctaaacagaagcactaatttagaagaaaacaacatctattattaatcaggggacaacagtcgtcagagagtagaactagttcagtatatatatattttttaaggaagttcagtatgtagctcacatggtcctgttcttttgtgctgaatggctaaattggttgaatagctcaatgattaaagataattattcaagtgtacatacgaattgaattgatactataaagtggaaatggatttaaaagagtttcctaataaattcgtatatagaaagtgttcgcaaaaaatgcaccatttaggagcttggaaagtatgcacattcctccaccattccattctaatcattttttttgttctttattcttccagctggaggatggtacagcagtatattctttcatgcctgctattgctagatggaaattgaggaaaagaatagagaaactagaaaacactgtcacaaacgtggagaactctccctatttaacacagacaagcagtggtgcctggaatgatattgtcaacatgaacaggagaagcattacatcgagtagtacacgcaagg

SEQ ID NO: 43643 - DNA, 1501 bp, Oryza sativa
cgcttgcaagacgagctggattgggagatgcataaccactctactggagtgggcacagggtttgtatcgatcgctacgcagcagatcagctgcgctgctaccgatttcttgtagcagatgctgcgggtcagcttctgactccttgctggagcggcttagttgcttgtccaggcaatttgatttcatcagatgctgccaatccctgttcatctggtcagtcaactggtttgaggttgctcgctcttatcgagattggttttatgatgcaactggcatcacagccacaggttaccaggttggttaccacttctctgccccctaacacacacacaccccaccccaatctagcaatgcatcttctctcaatctaggggaatgttcctattttgcatcaacactaatacactatgcaaaaggagttacaatgcacgggctatgatcttggtaaaatttatgtcgcgctcctcaattttattcggaaatcaatagttgctggaatgtgttaaagggtcttagtgtttgagacaccactaatgttactacatctaatagttcaatttttgaagtaacaagaaaaaatttccatgttctaaacagaagcactaatttagaagaaaacaacatctattattaatcaggggacaacagtcgtcagagagtagaactagttcagtatatatatattttttaaggaagttcagtatgtagctcacatggtcctgttcttttgtgctgaatggctaaattggttgaatagctcaatgattaaagataattattcaagtgtacatacgaattgaattgatactataaagtggaaatggatttaaaagagtttcctaataaattcgtatatagaaagtgttcgcaaaaaatgcaccatttaggagcttggaaagtatgcacattcctccaccattccattctaatcattttttttgttctttattcttccagctggaggatggtacagcagtatattctttcatgcctgctattgctagatggaaattgaggaaaagaatagagaaactagaaaacactgtcacaaacgtggagaactctccctatttaacacagacaagcagtggtgcctggaatgatattgtcaacatgaacaggagaagcattacatcgagtagtacacgcaaggtattcggtagagaccgggagcgtgatatgataagaagtatgcttcgtgaggatgattctttaccaagctccagtagcaggaaatgttattctgtaatttgcatatatggcattccagggtctggaaagactacactggcacagtatgtttgtgagtatgaaaaggaggataaagatagatactttgacacagtcatgctaatttatgtttctaagacttacagactggaagatatatttcgtgatatgctcgaggagatcacgcaaagccggcattctgaaattagtgactgcagaggtttggaagcaaaattggtggagaatttgagaggcaaacggttcttgttgg

SEQ ID NO: 43644 - DNA, 1501 bp, Oryza sativa
ggatggcgtccgtgcgtggccggccagccccaagcgagcgagattcaggctggcacccggtctacaatctacatccatgcctcccgaggccgcgggaggtatacaccatccgttacctccaatggatcccccgccttcccctgtatgctctcgtattgcgtattcccgtggccgtgcgcccgtgcctcactgcctctgctgtatgcccgtacttattccgtttgtatgatggttgaacgggtcggtactcggtagtaatgcttgctaggtgttcgttgttttgcctgacaagaagagtcgtggccttggcccgagaagcattagttacatttcgttttacagttctcagttactgaatttgttttgctgccgtacctctctgaattcccaagtacaactagtgagaaattgaccatggtttgcttggtggtaggtgccatgtctactattgtattcatattagtctttttttttctattcttaattgatgtgtagttccttataggtgccacaccaaatatgtgtagcgttgatcaaacattttagtctgacacatgacagatcagtgctttatctaattatctgttgtcttaatgatatcgaaaattccaaattgttgctctgattactattctgtgtagtacttctactcctgtcagttttccacaaacagatagttcattaggttggataagtggttaaatttagttgcaaactctgggagagatgcaactgttatcttaacaaacattggatcaggggaagcacatggagtgtagaagataagtcaaacttatgtcagattcccaaggaacatgatatcatgatacacatgcttccagtatagttatacattagcacctggctgcttcgccatttgttgtggtgatgctcatttattatagttttttgagcaagatgcacagttctattaagtcatgtaatgcattttttcattatgcacttgacagctgctgaattttaaattgactttcagtagaagtactattgatcttagactcaatatttttcttaacgcgtgcttgccattctgaaacacaatttctagtttacctgcggctgttattaactcactgcaagttattttctgaacacgaacttgtaagcaattgttctagtacaaattcatatggccatgcattatgtcagcattaatattagtgaaagtgggcaaatggatgtcgaaagaattaaaattaacactttataccatgaatgaacttccttctccatagctttattattctgattttacattaactgtgaagtttcacctgtgccaaatgtaaaagcaagataggttacttttcaaatgtttataaatgctcttccaaatttatttagcatgctgctttatctttcattttcactgtgaggtttgctaatcgaattctttttactgggatattcctggattctgactagattgatcatttcaaaacaggaaataagtttggtgtaaattgaaaatcactcacaa

SEQ ID NO: 43645 - DNA, 1501 bp, Oryza sativa
agtctcgactctcgagatcgatcacacgcgcggtgcgcacgatcagctcatatggacgtccttttcgagcttaccaggccgcgcggaacgccgaaaccgttagtgctaatcaccgatgtggacactcccagtcgcttccgttcaactctctcaggaaggtggagtggatggccggacgttgtatgcacaaaatactctcaccccgtcccaaataaaagaacttttatacatgaacttgatatcttaggacatacagattagtgagtactcccttcgttctaaaaaaacttaatttttaggtttccgtgtctgatgtttgaccgtccgtcttatataaaatttttgcatgattagaattttcattattgttaaatgataaaacatgaataaaactttatacatggcttattttttaattttttttataattttttaaaataagacgaacgatcaaacgttagacacggaaattcaggaattaagttttttttttttggacgaatggagtagagaatagtgagtgccatttttattggtagagcagtattcgatcaccagtattgtttgcatgataaaatctgtatactctactataagctcctgtgtcggggcaaagctcggttacatatggcatctgtagtttataaacggatttgtggaacggtaaattaacgttctggatcttgactcttgaccagttcatccacacgtgtgtagtccgtttgttggttggttgctttcctgttccagctggaagtttttgacctacagtaacatcatttttcgctttctattttgattccccgttgccaagtcgacagccgacttgaacctgagcctttcggcgaaacttgaaacctccaatccccaatagcccacgtacggttgcagacagccttgtagagtcgccgtgtttcaccggagcgaactgtatactcctacagtttaagatagttcggtggaaaaacgagtcgttagttaacgacctgagtaagctccgacttaaaaaatggtgaaaaaatgctgttaatcatgcgtcgggaagacctaactcacatacccatatttacaaacgaaaaataatttatgaataaaacttttatatatatgttcttaacgatctaaaagtaaaggttgaaaaataaatatggataaaaaacaccaaaattaacttcaaatttaagaccgaaaatttaaattttgactgataagtataagtataagcgaaaagattaggctgccagttgggcctttcctgaattctggactctcgatgtcttctcgaataaccatgccgtctgaatcactcttaagtcttactaatccacagaaaacaatcatgtgctccggtaagcaacatgaagcttcgaagcaagcacgcaggagcttataacggtctcgttcccgccgcatttgcttaacattctcaaaccgaactccccccacttcttcccgcgtccacagcggcttgcggcgggggcagaacacaccatggaaacca

SEQ ID NO: 43646 - DNA, 1501 bp, Oryza sativa
gtttagtttgatcatctgctgggctaaaaccccatatgtatcttcttgcgttgagagtttatgcatgttttcggattccttttgcctcgattgatactttttgtttatttagttggtcttcctaggtgttttctcccttttgtttactcacaagtatcttccttaggtaatctgattaaggttgtcatccctcgccctgatcctagtggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattcttattcaaacgcgtgatagttcatgatagtagtagtaaattaacaggagaaatgagggcaatggcatggatgattcatctgcacacccgtgcggtacatgctagacgtgcaaaactatttgcaccaatggttttaaaacaacaacaataataaatacaggtacagatggaacttgaaacagaatgatagcttacaattacatgcagtggatgctatgtttagctaatctggacgtcgccacaaatgctgtgccgtatgcagtatatcaagatgattaatcaacggattatttgctgatcgatatgcttaatccttcgccaatttggatgtccaggggtcagacaggtgtccgcaagagaagggtggcaaccagagattacaatgctcttgagcgattggggaagcttgggcagtgtcatcatgttgggacactcctggacgatcaattccctgagtgttttcaggcggcacaatttgacaggcaaatagttccagctgcagtctgtaactgacagtgtatgcaggcaggtgaagaattcaccaatctttg

SEQ ID NO: 43647 - DNA, 1501 bp, Oryza sativa
agcgcgattattgtagggtatcacgtctaaacaaggttataggttatggtgtttatggtcgattggattgtgctaatactgggaggcattatggcactagctcggaacaagagaataacaatactatgagacttcgcttaggtggtgctcgtcgagtaccgtttcctcaactcctaggttatgaatatccagatatcacctagtgtttttccctttgcaggttggctttttggctgaccctgtacatatttctcttgtatttctgctcctctattaatatacgaggcaaagcttttaccctcctttcaaaaaaatgaatatctggatttagccttagctagttataccgggcaaatagcagtttcctcttccttgttgggggtgttgtctagacttttaagaattgctctctacagtgaaaacctatggtttagtctttgttgatcggatcatgacaacatatgaacatacctgtgttcttatcttaggtgctattttaggggaaccttagtcgtagtccagtgttactttggtccacgacgaggaaccttttaaaaatctgttgtatataaattacaaatatatttgcataattatagaagtcaaaagttgtatgaaaaatccaattccaattatatataacccttcctatatagccccgttcacttctcagctgggccttttttacaggtacctttcagttgggccgagcctgatacagctccaggctgaactggccgaaattttccgggacgtcagatgcgaaacgaaaggacaggatcagaactcagaagctgactccaccgaccttccctgccaatgccggtgcgtccccctctcaaaaaggttccggcccaaactcgagcagatttgggtcctccctcctccgcctcctccgccgccgccccctgtatcccaccggctcgccggagagtccgcctcgccgccgcggcctcacgggcgcgtatccagcctcgcggagagcgtgcggaaccgcgacccgtactagggcagcgcgagagagaagctgctgcgccctgcgctgcaaaggtatggctgttactgttcttccgaggggtctctaaatttccggcgattcgaagctttctaaagcatcccggatactgtatcctgtaggctgtaggtagattccgacagtggaagcgttagccgtccccttgcgctccgctgccaattggtagtctcagaatgtgtagatgcagcgtctgcttggggaatagggatgctccctatttgcgctagcctgataggacggcacttcagttgcaatctgatatcctgcttagtgcagaaaagccaaacatggcatgtgaagcgtagaaaatcagaagtaattttgtaacttctcttgctaggtctacagttggagctcttgctgctgcttggaagacttcggacaagaacctaagatcatggtgagttcataaattcacttcaggtcctgttaagtaaccatgtgcaagtttgtttactttgacat

SEQ ID NO: 43648 - DNA, 1501 bp, Oryza sativa; identical to SEQ ID NO: 43628

SEQ ID NO: 43649 - DNA, 1501 bp, Oryza sativa
cccaacagcgcccgtggcccgtggaacggtcaccacgacaaaagccaaaaagactcgcgtaaacatctataagaccagtaattcctcggaagccacggtcgaggcgactccagaaagcttcccctccgcggtccgctcgcctcctcacggcgccaaagcagccaggaagaagaagaaccacgctgtttctaggacgattcctggaacagccaacttctgaacctctatctgcaagactgcaggtaatttgcatgctccatctgatcaaatctcttcgcctcctctcctggcttaaatttcccattttctaggataaatctcctctctttttattgatcttccatccgtctagaaaaaaactagattctggtcggccaaacgggatcgcctcgtctgccttatttatttgccttgcaaatttgaggggcctgatttaactctctttctatggacccctgttcttctgcttgcttccagagagtgcgatcctctggttgcgtctgttttattcgcttgcttgcaagagcaggacccgtcttgctttctccttgcattcttgctgttgagttaacaagggatccatagggcacaggtattagtgtggagtatttgttttctctccagttgccttctgttcttcccgtttctgaatcgattcttctttcggtttctgaatcggaagtaagatgatgctatggttgaaggagatttttgtttcttgtccctccaattgttgagttgattgaattatagttctcttcttccgttttcctcttggtccttgaacttgattatttgtaattttagacaatgggtagtaaaaaagatttagacaatggaatgatgccttcagaacttcttgccaagataggaacctgaccaaacggcggttcttgattttgtagcattaaaacatagggccttcacagttaaacttcaggtcgctgtgtattgtcaattcatagggccttttgctcgttcaacgcatatcaactaatcggaactggtcgtcaactcctgtattttccttttgctcgtgatgaaacgggaaatcccacttgggcaagaaaagaaagtgtcggttctgaatatcgtaacatcctacctaatcgcacgaatagcgaagtgcaaggtagtttatgcaattcgtctttatacaatttttaaattatgaccaacttaacttatcgtccacattaaactacgtgcagtcgtcgccccaataatttggcaaaatattgttcatttcgtcagatgcttgcgtgttccttgcagaataagctctatagctttcaccgtgtccatttgctgccgaacaattgtgaaccagaagttccctattccatttgtgtcaagctgttaaattttgtggtcctgtggacaactcctgatgatttctcttttggccttttgcagacagtataatacttcttcctggttgcagccgcctcagcggaaaaaccaaattcagcttcattcatgggttccccaagcaaaacac

SEQ ID NO: 43650 - DNA, 421 bp, Oryza sativa
gcgaattcgagctcggtacccacatttttggaattagtttttttgtgacttattatccaaagtactttaagcacaacttttcgttttttatatttgcacaaatttttttgaataagatgagtggtcaaacagtgcaagcaaaatgtcaaaatcccttatattatgggacggagggagtatttaagtagcaaatgattatcactatggaaaaaccttttgatctggtcatctttgtggtccattgctcttgtggcaattgtttaagataatgctgcttggttgcaaaaactgcacttttcagattatgtaataagttataagttatttatgttaatgagcttgatatgcattttaacgatggccgctcctattcttttccatagttgcctatcaggttaactataaaccttctcttttcaga

SEQ ID NO: 43651 - DNA, 807 bp, Oryza sativa
aagttgcaattgtggaccgatgtgtggtgtattagttataacacttctcagttactatggtggaattggattttagccactacaacttgcgttatatttcagtgtgcacatgttaattattattaatggggtgctgcgtagatcgaacagaatgttctgatggttccaaattaactaaaaacatttcttttagctgaaaatgcaaaataagtcaagtacgtactcggatatatgcagtgttagttttttttttgtcataatatgctatctgtactgcagcattttattttatttgcttatatactgaaaggtttgatctaaactattgcaatgaagtaccttatgttcatcaaattctaggggatgctaagattagcactataatttgttttctggctaaacccctaagtaaaacatagggcgtccaatttgctgcaaatacatagacagttatttttccttgtggctaaaccattgacaccttgtttgagatggataatactaaaaaaaccgtgttacctaatttagttagtaatgactatgcatcctatttctttgatccaatatattttctttaaagaatcatctatccttctatcgtgtttatattatgttatagtcctggatctgttcaaaatctgtattatttcaattctatatgcactttactatatttttctgctatataaagctacacagttggaattacaaagatttagttgctactcatgatcctattctgcttcttcaactcccactttagctgttaattgatatcatttcgccctgtttttttttttttgtagg

SEQ ID NO: 43652 - DNA, 1175 bp, Oryza sativa
tctgatgtttcaacaaaactacaggaactcacgcatgatgtacctaaaggaaactggttctagacacactataaatctgcggtagtccttttccatctcgaagacgaatcaacgatgtgtttagaatcagctgttcccaacatgcgaattgcgcacagaaaacggagcgctccattagagcgtgattaattaagtattagcttttttttttcaaaaatgggtccatatgaatttttgaagcaacttttgtacagaaaccttttgcaaaaaacacaccgtttagcagtttgagaagcttgcgcgcgtaatacgatggagaagggttgggaaccctggattccaaacacagcccaagtctatccaaaatgtttagacaagaaaacacgtaacaagttggtttacagaaatacgaattagatcaatcctgcactacaagtagagtaaagtggtgatttctcttaaatctctcgaatggtgatttaagaattcagtgcaaacctaatccttgctataatcaaatgttcggtaccgcatcaacggaacaataaaaagcacctggcataccataattttttcattcttgttgaaatttgtaatttaagatgcatgagaccacacgaccttaatgttcaacgtgtcatgcattagtgaaataatagctcacaaaacgcaacaaatatagcaagataacggttgcaatccataccaaactaacgtataaagtgagcgatgagtcatatcattatctcctgcctgctaaccatcatgtacaccatccgatcccaaaaatgacaacttctagggatgaacctggacaaggcttagggtttagggatgaatctggacaaatgattgttcacgttcatccttagatgttggtttctccttacgggacggagggagtatatgtgatggacacaaaagttactttcatgatgaaaccaaaggggatttgttagggcacctaatagaacatctgtccaaatggcatgacttacttatatcctaataggatatccaagaaaaactaacactctaaagcaaccgatgaggaattgaaagaaaatacgtgccaacgcatctataaatggacaagcgcaatggaaaccctccttatcgttcacacagttcaagcattatacagcaaaatagaaagatctagtgttccgcagcaa

SEQ ID NO: 43653 - DNA, 525 bp, Oryza sativa
gaattgacatcttttggtacatgatcagttccttcacaaaataaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggt

SEQ ID NO: 43654 - DNA, 1501 bp, Oryza sativa
accactagtttaattttaggtagatgcttcgcaatttaattaagtaacattaggtggttttacaactttagactttggggatactcatatcacctggacactttggaattgttggtttattgtggaattggcttcacaccgctccttctattcaaaattccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttataaaatggctttgggcaactaagtgacttttcgatgctgtttactgcaaaacttaacccctatattattatccccttgtactcccttgcattaattatgcatctccggtgtggcttgctgagtactgtggttgtactcattcttgctcaatctttccccccttcagtaagagaagctttggagatgatgtcttgggtggagtcctggcttataccccagttgagcgcctgtgaagatggagccgtaggcccgctagtccgctgctgtttatttttgattgtcaggccttaagcgcctttgtaataatgtaaatattatcgatataataaagatgtgtcttttatatcatgtttgtttggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctttttgcaaaaggtttactcccttcttccttcttcggatttcaactagtactagatggtcagg

SEQ ID NO: 43655 - DNA, 702 bp, Oryza sativa
tggttgatatagaagttgaattcaaatggatgaatgggaggatcaagtactggatgaaccgatcgaaactagggatctgaattgtattcctcatgaagttatcatttaatttcttcagaagtttaggacggtttttggaaccttgaggttgagacatcatttttagagacatcatactctaaggctgataatgtatcactttaatatggagataaatctcgtaagggtaaaaattggacatatatgaaatttgtaaaagtaaaaaagttgattatataccaaatctccatgcgtttcccctctttctacacattttgataaagatacctaatctagacttatcacttgctactcttttcccttctcgtcactactgaaaaacgatttttctgtacagcgacccatttagattgtagatggaccataactggtcgcgtctaggaaaataagctcattttcacgtgtggtccatttaagaggaccgcaagaaaaaatcgatttttctgtgcagtcctcttaaatggaccgcacgcgaaaatatgcatttttgcgtgtggacctattaagagtgccgcatgcaaaaatacccactccctcttttccctcttacccactttaaattttcccctctatctctcctctcctctctatctctttttcttctatcagtcaacaatagtggcctcactcatctgtgccctc

SEQ ID NO: 43656 - DNA, 1501 bp, Oryza sativa
agcacagatgaggagctccttgaagatgaaggctttggtgtctagctcgtgcctgccgtcaagcgcctgtggtcgtcgccctagtcttccgctgtttttcgttgtctttgtgtgctgggccttcgctgcccgtgtaatgattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatctttgattatttgtgaaaattgtctagtctctctctgtcttgctgcttcatttatcatcaaaacctgaccttcaaaatgttgcttttctctttgtttttgtttgtagatggccggcagcgtcacccgtcgtggtttggacatgactggcttcgttttggagctgcggggcatgtgcgtggtcttgggatatccacatggagtggactaccaggccaggccgctcccggagcaggagggtgaggatgcagagccccacgctggttgggaggtcaccgcagtgatcctctccggctctcccgagcggacttcgctggcagtcaccgcgggtggagattcctttcccgccgcttgccagaacgccgctttcctcgccatcggcacccttcaccagcgctacccggacgagttgcagcactcgccctatcgctaccaccctcgtcgcggaggagcccgtgactacgccaccttctgagatgctagctcggaggatgacgctaccgtcgtgcatctggcacgcatggtggaggcatacgacgcggctcgtatcgacttccatcagatggtgcgtcgtggcatggtggagaacaacatgaagattctggagctgcgtcaggagaacctgcagctcaagaaggacctcgacgcgttggagtcgcagctgcaccagctcaagctcgcccaaggagaggacagccgccccaagcgccgccgcgtctgccgcagccagaagatcaccgcccgcaagagcacctccaggcccgagcttgttcgtcagtccttggcgtggacctgcttcgtcgagacccctcgtgccgagcctgcgcccgtggttcctcaggagggggaagcctccggcgttggtagcacggaggatgcgctgttgctcgccttccgtcctggcccgtcgcagcggtagtcgagtagttagtaggcttgcgcgtgtgtttttcctcgtttgtcttcttgagttgtgtggggcatggttatgccggtgtgtggcataactatgtcggagcctgtcttgtttttatttgcctaagcaacttgaacttaatgaaccaatttaatgtcagtaataaattcaagatttatagtagtcgtgggtggttagttttaatcgttagctctccctgtctgctggttctgtgtggggttttc

SEQ ID NO: 43657 - DNA, 1501 bp, Oryza sativa
gatacggaagggacccacataccgaggtgcgagcttcccttttgtctgaaacctgtgtacacctcgcaatggcgtgacccgaagatatacaaaatcacccactgcgaattccaggtcacggcgacggttatctgcataacttttctgccgggactgtgccacctttaaattatcccgaatgattctgactttagcttcagcttctctcaggatgtcagtcccgaacacttggctttctccaacttggtcccacaatagcggtgtccggcatttgcgcccgtacaacgcttcataaggtgccatttgtatgctggcttgatagctgttgttgtaggaaaactcggcataggggaggctcttatcccaggtcttcccgaaatctagtacacatgcgcggagcatatcttctaggatctggtttagacgctcggtctgtccatctgtctgcgggtgatacgcggtgctgaaattcaatcgagtgcccagctcttcttggagcttcttccagaagtgagaggtgaattggcttcccctatcagatacgattttcttgggaatgccatggagactcacgatcctagcgaaatagagttccgctagtttgttccctccataggtggtcttcacaggaataaatcgagctacctttgttagtcgatccacaattacccatatagaatcatatccaccttgggtttttggaagtccagtgatgaaatccatcccaatttcatcccatttccattctggcacttggagaggttggagaagtccggccggtcgctggtgttctgccttgacacgctggcacacatcacatagggccacaaactctgcaatttcccgcttcatgctgacccaccagtatttctccttcaaatctaagtacagctttgtactgcccgggtggattgaataaggactttcgtgagcttcctgaagtatcagctgtttaagttctctgttatcgggaacgcacacccgctttccgttccatagagttccgtgttcatcctctgtgaaaccagcggctttaccctgtttcatattcttgaggagtccatgcatgtccggatcattcttctgagcctcgcggatttggtcgagcaaggtaggcttggcttctaacgcagccaagaatccacgaccaactatgcttaggttcagggcttccatctgttgattaagttcgggtggaatgcctcggacgttaagagtattgcaatggcttttccgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaaatcatgtgtagggtagttgccttcatgaggccgtagctgacgtgag

SEQ ID NO: 43658 - DNA, 360 bp, Oryza sativa
tcagcatcggctttgaagtctgagattagccgatgagagttgtcaagtcgtcagttgtcggattcttgctatattcggttaaggaaattgatctactaaatgaagtttatccagaagagaccgagttcaaaagaatgcggcatggcaagttatctattaattaggaatagtttgtaagtttccttttatctttaggaaagtttctttcttgtcctacaaggactagtatctacccataggtataaatatgtacacccggggtcattgtaaactatcttcacgatcaatacaattcggcgcatcgccacccttttacttctacttttgtttttacgttccggcggaacttggcacccgaca

SEQ ID NO: 43659 - DNA, 1501 bp, Oryza sativa
  unsure (1)..(1501): unsure at all n locations
ccgcccataactgcgggcacggctattcgaatagttttactctgatcagaggtgtaccactgtacccacaagacacaaccccacatcatgtcaccatgtgcctcaataccaccacggtacctcggaaaggagttgtgacaatactccttgcacaacacaatccattacagcgcaccttttctggatcataatcacccccttataaacaaggcatggactccccagcgaccccccgtgggcttatctccgccacttctcagtctggtgctctgcaatgaaccatgctatacaaaagataaagccgttgcccacgctggcttgtggctggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgagtcataagttatcccaataatgtgctaatgtttctaagcagggctaagcaattatatctaatatctagttgaaccaatataaataaagctcaactagtcaaattataataacccaaggtatcaaggaataaagtaataaagaacaaaagggctataacaaagaataggttaattccacccaatgacattcgaaaataaatgcaatagttgaatagaaacaatagcttaaaatatgatcaacatgctcaaagggttgtttgggatctgtgtgacttgccttgctggccttggaactcttcaaactcttctgctgcgaaaacggactctccggaaacgacggaatctaaacagaaagaagcaaaatcaccaaacagcacataaacaagcatgaacagtacatgtggatatttttaacatgtagatctcaattttagaaaaatttagagacttgaaccaactaaatccgagctaagatgaattagttatgaattttcaagattaaatcggattaaaatacttatattgattttaattgaattatggcgcaataatgaattatttttgaaaaggaaaagaggattattgcgtcagcggctagggtttcggtagaccgggtgcacggcggcggttcacgcgaacggacggctgagatcgactttgtcggtgatatgggaccgggagtatcatgaccagaggcttgaggcagacgcaatcgcccacgtggcctggcaccttcggggacgtcgggcccgagggtgaggtgtccgccctcctcgtgatttcccctgagggggggtcgggnggcgcttgcncggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtca

SEQ ID NO: 43660 - DNA, 652 bp, Oryza sativa
agatgtataactaaaggatgccccgtacgttgctgcgggacttgatttacattaattggttagatagtaggtacaatcattattgtgttagataggaggtacaccctcaagaagaaacaaatatgtttcttggagaaattctttttagcagccttatctaaaatttgtagataatttaggtagcaaattctttttagcagccctatccagaattggtagataatttaggtagcacatatcaactgaaggtcctatccaaaatttgtagataatttatatagcacatatcaactgaatgggcgttcagccataaagcgctggatacatgtagatgtgtgtggagatcacagtagaaaaaatcggaccggaccggcggttcaactcaactgaaggggcgttcagccataaagcgctggatacatgtagatgtgtgtggagatcacagggaccggaccggcggttcaactcaaccgaaggggcgttcatccataaagcgctggatacatgtagatgtgtgtggagattacagtagaaaaaaccggaccggaccggcggttcaaccggaaaaaacctaaactagggacctcgccggttcggtgtgtttcaaggactgttcgtgcagttgacccggtgtgaaccgacggttttcagg

SEQ ID NO: 43661 - DNA, 1501 bp, Oryza sativa
aaaacactaactagatgcttggctgtgtagcgtgtcttcaaagttgcaccgactcaacgagtataatgctgcactgctgctttcaactttgcacatgacctcgcgaagatctggactaatcaatctttctgagtcgtgtcagactgtcaggcgagctcacctactaatcactttttgaacgtcacagtagttcgcggagagaattaactgagattttttaatcagtccatgtggtactcgtcaaagttctttgtaattaaattgtaatcacttgcacatataggtcactaatcgagcattgcgagattggaataactagcagtaatagtacatggacgagaaaatgcccctttctgctattcagttcatgcatgtatactgtcttaaacgtgtttacgtccatgggagtaggccgcatcctacttcgatcgtaagtactccgtaacattcagtttgcaaatcgcaatcgtgtgaacgaccatcggttgtgccatacctttcctttgtctgcaagcattgaagcaataggagtagtacgttgctcctttttattgttggtcctgcatcgatgcagctcagcagctcctccatcatgcctggccctgcatgtgctgttgatcttgaatgagttgaacttctcttgaaatgaaatcatgttggattcaacttccatctagggttgtgcttagatcaaaactccaaaactgtatttgccagattcataaaaaaatttcatcacgtacaacaagtgtatattcctgctcgttgaattggtgttcgttgtctgtctctgtcacatgggccaccaggcccaacttgttagtcagcttccttaacgggcgcaatgcgccgcgaaggcccaaaccgcggcaccaaagtccaaacgcctgcgactgggtgcgaggctgcgacactggaaagcggccgcgacccgtgaccgtgaacccgccggccgcgccacgtcgtctactacctctcccccttcctgctcttcttctcgtccagttcgtccatctgatatccccacccatcctctccgcctcgcggatctcgccatgcaccgccgctgatccccaacctctccgccggtgcgccgcaaggccaatcccacccccgaacgccaccagatctgcgcgcctccgcattgcgcgctgctcacctgcccccttccactccacccccgctctctctctcgaatcgctcgcggttttcactgtcgttgaccgattccgcccgcatttttattcccgagaccttgttcggtgtttggtgttgatgtcgtaaagccctagcaatggcggaggaaccccgcgagtcgttggattcctcgccggagccgccgcccccggggcaggactccgacgagcagttctcggcggtcccgctcgccgacgaggtgcgtgcagaggggagcgagctggatccggatacgagcgcgggcacgtcggtggcggtcacgccggcgcggtcggagccgtcgccgccgccgccgaggaggaga

SEQ ID NO: 43662 - DNA, 1501 bp, Oryza sativa
gaaggacgacgggaggacggcgagccagtgctgttggatggcaacaagctagctaatgcatgttgattaagttaattattgtggcaacgtggccaaccaatcggaggacgacatgtcatcactgctacagtgccatgcacaaaccaatgcgtgggctgaagaagtcctattggtttttcttattcgtcccaaatgagatgccgagctttgattaaatccggttaccgtctacatcaaccatctttaataatttctccctttcctaatctaatctcgacgcaactgctgtgacgtcaagtcgttcgagctacgcaactccatgcatgttgttcaagaccgacgaggctagacgacggagggcgggcgaagtcgatacgaaggccacgctaccaacaccggcgcacggaccgacgaggctgtggatcgctgccggcgctcgcacacacacatctacatcatcatcccaaccatgcatggagaacgcgaagcgaagacgacgagacgaccacaagcagcttaatcggaggttctcttgcaggcctagacttgcggaggtaattaactgggagcttttcgaggccccaggaaccaggagaccacatcgcacaagtcagatctgtccaatgacagattatggagcgcgcatacatatatattacattgggaatttgtatttatgatcttttaagattaataaagagcatgttctctatgttttgtttacattgtgtatttaggtacactggcacgcccgcacatatatgtatctctaaacaaacgagatcttagacgttattttccaccctaaacactgagtgtattactttgtgcagcacacgaataaatgacttgtatgttttgtgggcggttaatttgacttcgatgttcagtaccttgtgggctgtagagatttgggagcatagttttcataccttggccctgtttgaaggttgtagatgaaggctgtagagatgttcagtgccttgtgggctgtagatgaaggttaaaaattagtgcacacaaaacgagctcgttattagcacataactaatcaagttttaattgctctaaatttaaaattttggatttacttgataatttaaagcaacttatatatttaaagtttttttacacgaaacacaccgttttaatattttgaaaagagtactaacaacagcggaaaaaaaatccaacaccttatccagaaaaggacacatattgtataggctttcggagtaagaaaagcaaaatgaaaccaaaacacacggggttccacggttatggtgaaactatctatggtcacagccatgatggtggagacggagttatatacttgcttccttcgtcatctcgtaaaagtagtatatatagtattgaatacgaaacattctaatattacgaattcaaataattatatttagatttatggtattaaaatatatcatgttcagaatgggacattagaaagcatgatttaacatgtcaaccaccttctaaatta

SEQ ID NO: 43663 - DNA, 1501 bp, Oryza sativa
accgtacactcttggccgactgcacggggatgacctgccgcggtccactccgcgtgcgacgttgacgccatcaccgccgggcgcgcagcggtgaatgcttgtgtggacaaggtgcagattgtgtggtcgggacggtggaggaggggtatcgagcagccgagaagggattatgtccagcgtctataacaaccatacttacggaggtgcgaaaacgatagaaatacaacacaaagcgtgaaaacgatagatggcacgcggcctagctaggtgcaaaaaaaaaaccgcgtccagcggacagggccgtggatcttggggatgactaattggcgcgtataagccatttcaccaagtctcgcgcacgaggtgcaaggcagctatgggttcaatcttctgttacgcgtttctcgttccacatgacaaaaaaaactcccgtgcatatttccttttttccggcaaaaaagttctctatgcacgtttttttttctttttttctgttttaaactaaggtttgaatttttttaaacttagattcgaaaactttcaagtacagatttgaaagtataaatttatatttgaaaacttttaacttagatttgaaaattttcaagtaaagattgaaaaattttaactcagatttaaaaacttttcaacttagatttaaaaactttcagctcggattaaaaaaattcaattgaagatttgaaactttcaactcaaaattaaaaaatttcaagccgagatttgaaaacttaactcgggtttgaaaactttcaactcaaattaaaaactgtcacctcaaaattcaaattattcaaatttgaatacttttgtctcaaaatttgaaaacattcagcttcaatttaaaaaactttcaattgaaattggaggcaaaagatccaatttataaaatatatcttcaaacttttagaaaaacaggaaattgtgttttgtgaaaaaaaaaggaaggttatcttagtaggtcatgttctttggaaacaaattacttaatcacaattttttccccgcgcgcgtgcggcagtttcacctaaaaaaaaagaaaaaaaaaagaaagcacgttcgagccgcgcgcgagggtatagcccagaaacgcgcgctgcctggactcccggagcgtacgcgctagaattctcggtggaaccggacccggcgttcgtgggggctggtggtggcgaggcggttagtcgtgccgccgcgaatcaaacccgaccgtccgatccctccacgacggctctcagtcgcgccactacgccggttgcaggaaccccacactgagagttgaagcacgaagcattgtcgtcgtcgtccccgctctcgcataagaacaccactccctcccaccactccctccctccctccctcccctgtggctgggcttttgcgttcgcgagcgcgcgtggggcggcggttgtgagggcaatggcgagagcacctggtggcgttcgccgaaggagcgggaggaggggcgcgggcggcggcggcg

SEQ ID NO: 43664 - DNA, 1501 bp, Oryza sativa
ccaacaagaagagtatgttcagtatggtccataaccaactttgccgctctgattccatcctttacatatctcatggcagcgacagctccgatttccattgtggtctgccaattttcttaagcaaaacaaatgcaacacattatacaccaagaatgctgcaacagaaactgcagaatgctcagtgggctgtggcatgagtatgtaaaaaagctgttaccccatccatgatgagagcatctaatgtagtttcaccattctcatctgggcttccacctgggccaactgcatgaaatgtaaaccatttaaaaccagtactatagttgcttcatgaagctaactgaaagtagtcaagtttttgaactgaataaggtccaagggattcaaccaaaataggttttgcaagatctatattattgggtttaaagcactgcacagtaagacaaactagaaattattattagaaacagaggaggcaaaccccaattcgatattcttattcaaaagtgaaacaagaaatacaatgtattttctgtgtattatatttcagtgcaaataattatgtgcaacataataggaactgctgataatgtcatcttcacgagttcatgatgaaagacaggaaaaagattgtaaaaggtgcttttgtagttcggtaagcgcgatgcaaatatgttatatcgtgtttcaatcaaaactacacatattctgcctgctgcctgaaaatagttgttcatcagaattgtttttttttattactctcgtcaaacatcacttatctaatggaagccaggggtgaaattcctccaagtggaaacgaaactcttcttgaagtttgttatcgcagtttttgacccaaccaaccagattagtgtatcagcactgagcacattgcatcaccactgttcccaattaaactcagtgaactactacaatcaatcccacaccccaggttgaatacaactgacctgtgccatcacagcggagcacctcgcaggcggagcagccggcgacgacggcatccacggccgaacaacctgcgccgccactggctgacaccacctcccaggccgccctgaccgcctcccggaaaggccaggtgctcaccaccaccggaaaaatccctcccccttcctccgcgcctccgccgtcatcagccaccgcctagtcaaatccccccctccccccaaaccccccattaaatccatcacatccccaatccaaacatcacggaaccaacctaaatcgaatcaacactcaccaagcaccagctgaaccgtagcagtaggaaccctaggagaagaagccgcgcgtagctcctccgtgaccttcccatggaaagctgcgatttcgcggcggggtttggttgttctacggtggcgtgagtcccttcgagctcacccacatgtcagtggcctggcttggtcctcctcttccacatgggtcccacatgtcggtgaggtttcgtggttgtttaggttgttgtttcactcgctctggctcc

SEQ ID NO: 43665 - DNA, 1501 bp, Oryza sativa
tgagccgtacgactacaaggcccaaccagatcagccggactttcatgcggcctctgtgtcccactgaacgtcggcccaagtaagattttagggcccagcgcccgcaagcgttcactattgcaccattccggcccaactaaatttggaaaccgaggcggaccgtgttctcttgggaaaaagaaaatgagagagattgagtttgccgcttgtatttgatcgctgcctctgcaaaggaaaccgtccattttacctttctcacctatagccccagtttaaatcacatttctcaaccctaaaatcagatagggagactccttccgctatcgaaactcccccgatagattgaatggtaattttgtcctttgtgaccagaaaacctgtgctaacgtgtcatcgacgtaagttccggttaattcaagagctactagatcaattgcatggttgggcagtcgtccttatgcacctagatgcttcagtacacttttgctaagaggtaatacgagaacaagagtgatgcaccctccaccgagatcaccgcctgacctggccagagtgatcggcgatgatgagggatcggagctgctatgccttctggcacatgcatgaccagctggcaatgacacaacgggagagagcaaggagggcaccttagcttagtgctggccagcctagccctagaggtggctagtcctgctccatcatcggctcgtgcgatgacaacggtggtcatccaccatcgtccccatcattgtcgccgcgtcctcccctgcgttggctaaggctcgagctcttaccgtctcgagctcggcacagaggacagtttcagcgatgcggtcagtaggctagtggtgcgataatggggaagcaacatcccacggcggtgctcaagtgatcgattaccctctgccgctggcctactaggttctacaatattatttttatttaagctaatcataacatgtgggttctgttgagttcttttatttatttttctaatcatattctctcatagacatatagcacgatgaacaatgtcacatagacgccaaatttatagtgaggtaggcagttaaattaatagctacgtggctctcaacggaaagtaagtacggcagacagaaggtgccacatagacgccaaatttatagtgaggtaggcacttaaattaatatctacgtgactctccacggaaagtatgatagacagcaggtgtgacaaccatgtccatcatcccttctatccccacgtttacttacatagatctcttggtagaccagggatgaactggacaccaattgatagatttttatttagtttaagcttagttaattaattcataggaatcccctctagtttaagcctaccatttgtatggtagaatcatgtttgtagatatacacatctattattcgatatccttgaaatactgttaggtggagtgttgcagcggtattcatacacttggatttattggtaactgtaacaaataccaataataacc

SEQ ID NO: 43666 - DNA, 1501 bp, Oryza sativa
actcatggtaccactagtatgattttaggtagatgcttcgctgtttaattaggtaacattaggtggttttacaactctagactttgggatattctcatcacctggacactttggaattgttggtttattgtggaattggcttcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtatagttctaggatcgcgtttacaaaatagctttgagcaactaaacgtctttaaatgctgtttactgcaacgctaacccttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacaagttggtatcagagccacatttgaccctaggacgagccgtagatcccaagccttagcaatattttcaaaaataaaaatctttgattatttgtgaaaattgtctagtctctctctgtcttgctgcttcatttatcgccaaaaatctgacctttgaaatgttgttttttttgttttgtttgtaga

SEQ ID NO: 43667 - DNA, 599 bp, Oryza sativa
caaatgcatcataataataacatcacatacttacaaaagaaaagaaaacagcagcggaattaacggtctagcgagggcttcagctccactcccacaggcagctcaactgaggtataagccaaacgtcttctccttctgaattctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtaaattaattaatcagaaattttaatcaacactgaacagcacacccatgctgcacaggcccaaccatcctgaacaaccatacccggctgtacagatctaatctccaaaccaggagctaagcaaactattaccaggtataacatccataattattgtgagaggtgtgagactaatcacgaaaaacattgctcaactcgcccataaccgcgggcacggctattcgaatagttttactctggccagaggtgtaccactgtacccacaagacacaacctcaacatcatgtcaacca

SEQ ID NO: 43668 - DNA, 265 bp, Oryza sativa
tttggtgtaccttgcttcttgggacaaggaataatacacgcacgtaaggaacgcccggtgggttaattccggtcgtgacaagttggtatcagagccacccttgaccctaggacgagccgtagatcccaagccttagcagtattttcgaaataaaaatcccccgtatttgtgaaaaccctctattctccctccatcttgctgcttcacttatcaacaaaatctgacctttttaaatgttgctctcctctttgtttttgtttgtaga

SEQ ID NO: 43669 - DNA, 183 bp, Oryza sativa
tcgtgacggtttggatccgaatcgaactcgttttgttttatctctaaaaaccgagttcgttttcttcccgattcgattcctcccgtttgcggcttgatctcttcaatccgagctcatataaagcttcctcgtgtcctcctcttccgtttgccccctttcccgtgctctcccgtgccccgtagc

SEQ ID NO: 43670 - DNA, 1501 bp, Oryza sativa
atcggaaaccatatcttgagtagtttgataggattccattaccacactgatacaaggtgctagatttttccaaattttctacttatgaacatatcagccgatttctagctcagctgggagaggcatcggctaatgatgcttttagatttaggatgttccctttgtctttgtctagatcggcctttacttggttctctaatcttccatacaattctatcagtaattgagccgatttggaaaagcaattccatagctacttttacagtggcgttcatgagatgaagctgacagatctgattccagtcaagtagaagcatgatgaatctattcaagactatattcagagattcagagatatgaggaacagatgctatagtttgtccttttcagattctcaattagccgatctggctttccagggtttattgcatccgatcagagaaaatttttcggctcaggacttcgaaagcttggctcatctggcccagaaagttggagtgcatgaacaacggttttaggaagctaagaagattgtcaaaaagatgaatagtgtttattcttacaattatgcttctgattccgattatgaagatgagtccgaagtagcagcagccgaatggatcagaaacaaaaaggttactacatgtctgtgggtgaagccatcttccaaggaggagaaatatgattttgatatcaccaaggcagataaaatctttgatatgctacttcgggagaaacaaattcaattgcctgcaaatcatgttattccatcggctgaggaactaggcaaaaggaaatactgcaaatggcataatactggatctcatactactaatgagtgcaagctgttctgacaacagatctagttggctatacaagatggtaagatcaagtttgataactccaagaggctgatgaaaattgagcgtaatccttttcaagtaaacatggttcatacaactgggaagacagccgataagaaggattatcggtccaagcaactcaattctgcaaggattatcaacaaatatcagaagagacatgatcggcatgaagagaaattttatgaagatgatgatagctttgacccccactggagttgtgaattcttcaggttttgctggaatgaggggatgaggctaccatctatcgaagattgccctagttgtagtaatcataaaagggggcatgttgcaagctcaagccgatcacgtcccagggagaatcggctacctcagaagaaacttcctgttcaccagatattgggccctattcatgaagactactttcaggatgaatcggctcaggaacgggagcaagttgagaacaagcaatggtgtccttcaggccctttcaccaagaaccagaagaggagagttcagagtgaggaatagggagcagtttgaggaggtgagcaagaaatcaaccatcagctgaataagaggagacgtgttagccgatgaagcaaagaggttagctaaaggaaaatctgttgtttctt

SEQ ID NO: 43671 - DNA, 1501 bp, Oryza sativa
tattagcagaaatgaaccctgaccatcctcctatactcttagtcttgaaatcaaatttgttcttggagttcaggttcatgtggttagccgatgaggtaatgtccaagccagttatcattgtgatgtcaagcagagtaggggtcatcggcccttggttgaacataaaagcattaagggtgttggaccagaaataggctgcagaagctatcaagggttcatctttagccgaatttgctatggttagggctaaagcctggccgattcccagctcatcccagtggctctgcttgctagccgatatgcgcttgtaccatgcgggccagcttttctctagagaaggccaagacttgaaggtgtttttccagtggcctaggctaggattggctatcctgtaggggatcctattgatttcagcactaataaactctgcccggtgagagttaccaatcggaccgagaaagtactgatgctcgcgggacaagctagggatcacaatcagatttgcaagatgctacaaaagaagagcaaagggaagagaaggcaaactgagaccaagagaaaccgatctattgcataaaagaagggatttagccgataagggcttacctctgcgtactcagccgatggagcggtggatggaccggcggaagacgacattgccgcgggtggaagttgaccggagagggagtcgccttgagatcgtctttttgcgccgaggggattgccggagagaaagaagacagaaatcgcttgagcggttgagggcaaagtaacggtgtgaattttctcggggaggtcggttagtatttaaagccgtgtggtaacggttggaaaaatggcaatgtgcgattttcttggagatatgatatggcaaatccgaaacattaccaaatattccggacttggggggcatgtgttaacgaccaaatttggtaatccaagtatctgagataaggataaaatcgaagcagaatctaagagataaactgtttcgaaaacagagtaagaatcggctgaagtctgaatcggctgcggtcaagattggcagagttcgagtcgaacaaggttagccgattgagccgaattttggcaatacgactcggtatacatcattgggttgaatcaaagtgcttcatatggattgctgcacacgatttgagtcctggaaaggcaattgtatctattagttaggatattttatgtaatttccttatgatttgagtcggtaagagtccgccttagggacttgttcgtatcctaagttgtaatagggctcgaagtcgtgtccgatagggacatatcatgtatctcaggtataaaagtaagcccgaacccttgtaaacaattaacgcttagttcaatcaaattcggcgcatcgccaccctttcgttttgttctattttcgacgagttcttgctttcgagttgggctgcatcggcttcgatctctgacaagaggtaaaacttgttatggcggcttgtgttctcgggattagtgcttc

SEQ ID NO: 43672 - DNA, 1501 bp, Oryza sativa
ttaattcaataaaagattcaagaatagaagcagtgtggataaatgtaaggatatcttctaacattgttggctgacacaagcatgtatccgttagcattaggtctctcattaatgattttttttatggataggttgaaacagaacataaatggaatgggataatgttaagggattatccagtaaccgaaacatttaactgggtttccctgcatctcaagtacatgcaaaaataatagaaataagtgcgcacgaaaatacaaaacaaatacaatcaccagttgatggatttaaactagcaatatagagaaattacagtgaacacttcgggataactatttacaccttattttcaactagatggaatcatatgtatcgataatgctaaagtgaaagagcatgataagtaataattttgccaaataatgagtacatcatttcctccagttagcaaattgaagtgcagcaataacatacaaaggcttaccctttgcactttgggcacagaatatttcgtgataatgatagtttcttcatagatccattatacacatcttctaaagacaccttcaaagtatgcgccacatcttcaccacgtctctgtctgcgtactcttgagctactccctgttaaccataaaagttagcatgaataattctgtttttttttaaaaaaaaagttcaaacaaaaaaatgttgagggtgctggaaaatttcagggtacatatgttgcttacccccaaaggcaccacccccgaaaaactgctcaaatatgtcaaatggattatggaagtcactgcctcctcccattccatccttaagagcatcctccccatattggtcatatatgtctctcttctcaggatcagtgagaacctcatacgcttgtgataattctttaaactgtaaaacacataaaaatgtaaaaacaaaatagagattctgaattcaaacaattgcatgtcacactggcacatcctcaccttttctggatcccctcccttgtcaggatggttttttatggcagccttccggtatgccttctttagctcatccttgcttgcagttttaggaactccaagaacctcatagtacttggtgttgttactcctcggtacacgcccaaacatgtttacagatcacaagataatctccctgtaaatctgtagaactaagggtcagtctgcagtggttgagtcggtgacatattgtgcattggagtctactcaaaataggggaattttactaatcctagtatgactttgtttccctgttacaactataattaaaatgcttatagtaacaatttttaatcaaacatcgaaataaactatggcttttgaacagccaccgaaatgccaaacagagagtaaaaaggccaaggatcactgtaattttaatatatatactccgtactcaacgatcagtaatatgctagtaatataaaatgtaatcagttctgttaaacaaactaaaatgggagctaattttacgcatttacaaca

SEQ ID NO: 43673 - DNA, 1501 bp, Oryza sativa
catctcgattgtgccgatgactgagtacctacgtactcaagtagtcaagtctttgtcgtctatatttgagattttctttatcatcaacagcgatgcgtcgaggatattcgagtctttatatatattttgtatatagtcctctatatatcatcaacagcgacaaaaaatgatgcgtcaaaaataacgatcacaaaacatattggtcaacggcacgatcaacagatcaacaggacgtgccgttgaccaatgactccacaagtcttttgtccggagtctccgcatggctccgcgaggcgacggcccgacgccctcatgaatgaatgaagaaatatctatcgaccatttgaacgcatccggtgtgcttccaataatttcatgtaattaaatatgttagggagaaaacacgcatgtgttcttggtaatgtgaaaatattgtacgtttcgtacgcgtttttactgcacatatttttaagtcacatgtaaagagaaaatatactccctccgtattttaatatattacgccgttatctttttaaccaacgtttgatcattcattttattcaattttttttgcaaacatgaaaatatttatgtcatgcttaaagaacatttgatgatgaatcaaatcacaataaaataaatgataattacataaattttttgaataagacgaatggtcaaacgttggataaaaagtcaacggtgttatatattaaaatatggaggtagtaattatcaatctgacgggagacgctcctgtacttaagcaagcacttagacaaacacttgaacaaaatgttttgtgctaccagaactgtgcagcttttcttagtttttcttctcttatttaacagcaagcaagaacaggaaatctgtggaaatgcaacatgatcctccgcgacgcgggccatgcatcccacgcatgaggaacaccacaaacacaaagggcgctgcaccgacaagcccggccatgcgcttgaccaacacaaggaataataagagaaacatgaaacaggtaaatgaatgaataaacacagaatgtacggtattatactgaaattagcaagaaataatccaaagatcacaaattcacaatctggccatgccagttttattttggcttactgatctcagccaccatgcttaacgtcctcttctctggctgtgttccaaatgccgtgcattggcgtgcatgtgcacaccatgatccgcccccagcatttagtatatttgacaggcttaattacttcctgatcaacaaaacagaatcaacatgagtaacagtataatcaccgtagagcataacttttcaaataaaaaaaaaagaaatggaggagcacacatggactttacattgaacatgtatggatgcttataaatgcttgtttggaatgtgcttgatcttttgccagttttcataaccaattgtttggcacgaactcgtgagcacgtcgctgcagcgataaagtcgaaacgtcttaagagacaggggtagcactgg

SEQ ID NO: 43674 - DNA, 1501 bp, Oryza sativa
ttttggaggagcgaatggaaaatgcgtggttggtcgaggcgatggcgagctgaccgtagaaagtgaagtgggatcgcgggaggagcatgtcctcggcgttgcaggcgaccatcagcagacgcccccgccgcgggtcgatcttgtagtgcgccagcagcctcttgcccggcatgtcgaacacccctgcaccgcacgcacgcacgcgcgcaccagcgtcatatcagttcggtccgaatcgatcgaagtggaggccgctgctccggtacagtgtcacgcaccgctaagaacagggcgcagcaggcgcgcggcggcgtcgaggccggcctcctgcagccacggccgtcgtgctgcagacgcgttcgttgccttgttgtcgtcggcggcggcgaggccgagcaggtcgaacgggccgacggtctcgagcgtccgggggtcaacctcgtacggctggccgccctcccagaggcagagcagccggccgccccaccgcagcacgctggtgttggccacgttcttcatcaccttcacattgcccaccttcttcccgccctgcagcacggagaagggcccccggtgcgtgaaccgccacgacgcgccgtcccggctctcctccctcttcgccgccgtctccacgaacctgcatgcgtcactcacgcgtgcactgtcagtctgtcgctctcactgacaaacctgctgctgctgcatgcgcgcggcgcgacttaccgcgcggagtagtggatggtgcggtcgccgggccggaagcggaaggagcggaggtagccgtggccgtcgagggggtggacggtggagccgtggtcgtcggagaagatgcccggcccggcgaggtagtaggtgccggccgggaagtcgggcgggatcgcgccctcggtgacgcggagcgggatggagtcgaggcactcgtcgcgctgcgaccggaagaggaggttgtagtcccagaaggccgcggacagcgtgtccgtctcggcggcggcggcggcggcggcggccgaggcgcggacgaagacgccacggcggcgcacgcagcggcggggtggtagaacgtggtggcggtgcacgacggcggcgtgcatcggtgcaatcgcttgtgttgccatctttggacttggcctccttcggtcgttggctcgtttctcgtgctttaaatcaagtatatagttgaagggagttacctagtactctacaaatataaacctactagtactattggtgtttaacaagaaaaaaaatggtcctctcttttgataattaagcatttatttgagtagtatgtgcagtggagatgacctgcctagtggtacagatttggttgtgtgtgtttcttttggtttcgttttggatggttttggaaatggaatcattggcattttaggagtggaatccaaggatcgtgtgcagtgttggaataatcgttaatacgtcactgtttatatcgaacaatgacaaaacaaagtgagacagtgtgcccacgtaatttgaaaga

SEQ ID NO: 43675 - DNA, 776 bp, Oryza sativa
ctggcatctgtgattattggttttgatatttggagattatcatcgaagtggttttggagataatcaattttcaggtgatgatcggattcactgctattttatgtgaccggtctgaccgggctgtgtatgccggtcagaccagcggtgatcgagcggtcagaccggccggcccgcggtctgaccggccgacgctgtgtcggtttcggtttcgggttgtttctttggatatccgtgattgtttcatggttatggcttctagatggatactatacgtatgtaatactgttgtttgctaacaatgagtcaagttggtgataacttggtctcagaatatggtttctttatttgtttcatgtgtaggtgactcgatgcctcgggagaatatttgcggtgatggaccgggagtcggcttggtggtaagacgatgtccgtggtggtcagatatcatgcgggatactaaggctagagttgatgcacgtggttggtgaagattccatatggcatacgatggaggtattgtgtacgtatgggatgcggagtcgaatttggaaggagtccaaatttggtacaattggttatgtaaagtttgtgtcttgtactgtatggtttcctaaggtgtttaggactcttagtatgagtttggttcgtggctttaggctgcctacctcatgtataaatagagggggagcgtgaggctttccggtatcgcttttgagagcaattgagttgatagtttagttagggtttcgagtttagtcgaaatttttgtaaggagt

SEQ ID NO: 43676 - DNA, 1501 bp, Oryza sativa
agctaggttggagaagtttttttggcttatgtgaggtagatatatgactcaactactaaacttaggacattaaatccaccggcttataaatcatataagccaataagctgacttaaaagtctagaccaataagcctaagcctaaacaaagagggcctaacatgcggaaaaggctctatgcacataatttttcgtataaaattgttacaaacattgacatggcatgatgcaaggaaatctggatttccaattactcctatctagtaaatcaagaggttgagaatttcgattgtaataaaaaaattaattatgtccagcaaatgctcttaaaaaataatgaaagttattgacttgtcctaatcaaactaaatttggatttgctaatatctatattgtttttagcatcgaagccgcttttacccaacaaaaagggactatattgcgaagtcaatctaggagtaaagaatttatatgctaatccatcgaaacaaatgttgggattccactaggattgatttgagggatggcaggattttgtgcagcgctagcaggaaaattgtttactatgacccgatggagcataatatttaacatgtgtattcaacagatgaaattttgaatctgttagataaaaggaaaatgcatccatctttagttaaaatgaatacgttccaatggtttgcaatgccaagaggagtaaaaagaaataaatactatagttattcctttctactcctacgtcttatacggagatagtctagtttattatgaacagatgaccaaaatgagaaagttacataagtcttttaaagtccacttcccaataatttttccttatgtaacttactcattatagcttcggtcatttacttcttattaaaaaaaacatggagctacttggttccttattatgatgaatttaaagcatctacgatggctattgttattgatgattgatgaataatgttactcgagtgagagatgctagatggctgacggaaaccactatgctctaggcaagattaaggatttgttcgtctaaccctcatctaaagggattgagatatgaagttattcccctcaaattctcctataatcattttcttgtgaggattaaccgaacaatttatgcggaaattggtttcgagctcaaacatgttttcattgaagtatttttgttatcttttcggtataactctattatatttttcttcttgtgttgtgtcaaaaacatttctgcttgtgtagtggttcttgtggatagatcatgtatgatctttctccggttttgtgtttcttttgtttcggagagctgatctggatagttcactctttcgtttgaatcaagtagtccagtatgagatgtgtgacaatcgtcagactttgaatccggagacagtgtcagacaaaaaaatcgtgttcactggccagcctcttctacccttcttctgatcctctcccgtatagccatttcgtcgaacaccttcccgagccgactgccg

SEQ ID NO: 43677 - DNA, 1501 bp, Oryza sativa
ttaagaactagggcacaaagcccccctttccattaatggaacggcataattgtcttacagattctaaactagaaacagaaagcccagaaagagggttcccacaaaaagaccagcaaaacaactggttgagggagaatatcctctaatacggttagaataatatatatgatcaagctaatattcggaattgtcttttttcctcttcttaatcccatcggccataagtggttagatctatattcttcttccctcatcttgctctccaactctattcttaacccatacccagtaatataggccggtatagtccttccctcatctttattttcaatcctattcttatcaacccatacccaattatataggcaagtatagtccatcctaatcatatagacccgttgcaattaatgtgtgggcatgttactggtgtatagaaagataaagatatactgtagaaatgaaaattgttttaattaaggtcttctgacctatagggtggtaagagcaaacaattgaattttcatttgtttcaccaataaaaaatcggaattgctaaatatttgttgacagatttttgatggctaaatctttcactttctaaaccgttggatgtgtcctagattcatgttaacagtttaatacgcatcaagatatgtgcttttaggaagaaaaacaaaatcatatttagggatcgatcctgtaacctcataggatgaagacgtgactgccccattgggctactatatttttatgatccagtttgaacttatatcttacttatactataattacatgcgagttacatgcaagttatatatgtaattatagtgcaaatatagtgtaattatgaaaattacatacgtaattatagtataaatatagtttaattatgaaaattacattgtaattatgttacagttacatttgacagatttttagactaatttttagtcgaatgttgtatagatagtcccataaaaaatattattttttaatttcggatcaataaatcgatcacagcaaaaaggaaatcaccaaggtccataattaccctatctaaatttaagcatatgcatccatacaagaaattaatgctccggtacggttaaagatgcaaactttataccggccatttgaactgctcgtgaattcgaatatttttgtttggttatatcataaatactacaagacgggcaaccatctggacgggataactaaagaggaattttataggacttgaaaaaaaattttggtaccttgaggtaccaaattttatattagaaaatgtggtacctctaaatataattctcaagaatagtaaaattaccctaattaaaaatatctagcgctctacagatttactctattctctctacctctctctctctgactaccatccccatgagcacggaggtaacaatgatggctggccgtgtgggtggttcatccggcgcagccattgccggtggtgtgttgggcgtggaaggagccaccgtcacag

SEQ ID NO: 43678 - DNA, 1501 bp, Oryza sativa
accccttcacttggcgttacagaatctattcctcattatgttgtctatttactttttgtgcgatactgatacggtaagcatatcgtagtgctgtttagtgtctgttgagcacttcagccccttagaactgttgtgcttagcactacaatgcttgcggctatataataataagacataccttcagatttaaggggccatttctgtttagcttgatttttttccccaacatgttgttctgttcattcctttcggtcagtgtttgtggtagccatttgtcgttgcaatcagtgtttgtagtaaccattccattagcgaaacactttgctgtcccttaggtgctacagtgtcgagacttgccagtgttcagcatgtatcacgtttttaggactttcagagttcatttagaaatcatactacaaaacgaaaggacgtcctatctgctgcggatgagttgattccgttgtcgaatttgtctgaatcattggctagggatgggctaatattgtctgaatcattcgacaacagccgatggctcttggggactggattgtgacttgggagaagtttcaaactttccatccttttccaagattattatagctacaggttctcagataaaaaaaaaggattactgttactgcaactagccttgtattgttctaacaggcccgtttatatatcttttaaattacgtagagacactgcctcactattattattgtttgtcactgttcgatataaacagtgtagacgcattaccgattattccaatactgcaaacagtccttggattccattccttaaatgccaacgattcctggtccaaaacactccaaaacgaaaccgaaagaaattcagatttaagcaggtcatctccactgcacatactactcaaagagatgcttaattatcaaaagagagtaaccatttccttcttgttaaatagattaatctgatattttagaacaactttcatattgaaaattttcgcacaaaacacaccgtttagcagtttgaaaaatgtgccatcaaaatccaaaacgaacggggcctataactgcatattctccggggaaaaatattgaactggaattagccattgttcaaacaggcccatttatacatctctttcaaattacgtgggcacactgtctcactttgttttgtcattgttcgatataaacagtgacgtattaacgattattccaacactgcacacgatccttggattccactcctaaaatgccaatgattccatttccaaaaccatccaaaacgaaaccaaaagaaacacacacaaccaaatctgtaccactaggcaggtcatctccactgcacatactactcaaataaatgcttaattatcaaaagagaggaccattttttttcttgttaaacaccaatagtactagtaggtttatatttgtagagtactaggtaactcccttcaactatatacttgatttaaagcacgagaaacgagccaacgaccgaaggaggc

SEQ ID NO: 43679 - DNA, 1501 bp, Oryza sativa
ctacacagcatattgctgcgacttcaggatgtcgagatcgaacatcatatgttaaaggggatttggtcgtatacatctctgtagtccctaaaaaaaaattgaacatctctgttacagaaaacgggttgggttccacgatcactgcgggcggggtgcgtacgcgattttgtggtataccatcacatcattgcaagaagcagtatggataaatagttttgctctgctccactaggattaacgagcctccactcttgatcatcgtattgattttgcgtgtaaccagcagcgtccgccatgagcagtgcttcgccctagatcgtccaagctgtatgctactacctgttggtgctcccagcgtaacgagagctcggagttgacgaattcagagaccaaaaaaagagacgtggggatcacagtatatcagacggcctcacgtcgctttccagatggccgggtctccgaaccgtaacgcgagaggagacatggtgcgcagcgccagatgagagagacggcgaagcaaaccaacccaaaggatgagatttatgttgagcacgagaccatcaagcaacaagcatacgccgatacgcggattgtgcggcgagatctcctaaccaatatgcgcatcgattcgacgggagctcacttgggttttcgttttgttctccccgcgacgtttagttagtttttcaccgtttagtgtcgtggattacgtggtgagaaataccagcgcgtttaaaaacgtgtgcgtcgatataaaagattacatgcgaagtttatgaaaacacttgtttttctttttcttttttcccttttattatgggcttccatcagcagcgtatcgcaagttgcaatttgcaaccggatacttatccatgacgctcgggctggtgaagaccgcggtttttgcgctgcttgtgcttattgttacagaaaaaaaatccaacattgattagattatcaaatggttcgtgagacacacagtagctacgagaaaacagaagaacggtaagacgtcgtttctccaaacaatttgacgatttgataatatgtttcaattatgcgtagcattctcccttgatcaaattccggtgttgctctgctgccagttttttttttcgccggtctgctgctaaattttgcagttctacagtatgcacttctccggttctgcactagtactatcaggtactagtactatctacaaggccattgttgacttctggaccgtctatatgattagcaggagcccatttgacacaaaagtattcggccgattttgttgggcccttctatattttagatcaaaggaagcccattaacaaaagtactacccaaaccatccattagtccatcacaattcactaggatcaaactgcctactatactagattacattgctttctttccttcaaacatccacaaatccacaacctaataaagacacagatcttacacacatactacatgtaactacacgaaaccaaatgcaacaaagattcta

SEQ ID NO: 43680 - DNA, 714 bp, Oryza sativa
taacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctatttggtgttttattaacagttttttatatgtcgtatcaaccgccac

SEQ ID NO: 43681 - DNA, 1189 bp, Oryza sativa
ccattgtgcccgtctgtctccgccgcgcccgttcgtcgttgccgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccacgtggtttccacgtgtgcaggccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatatataacagcattaaacttcggatgatcatatcttggtcatacgagctccgaatcgatccgttcaagtctcctaatgtttgttataacctaaagaaccctgtgctttgttttttatgtattgttattgcttctttataggcttgaagctttgcttgtgtgcttcgcgtagctttcgtcgttccggaggttcccaaagcgtggttcgtggtcgtcgccgaaggttcggaaggccgttctctctgagcaaggcaagtcacatcatccttgagcatattgaatcccagtttataaaattattttagtttaaattaatgcattatcgctttatttaaaattcccgcgttgtcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaacattaggtggttttataactttagactttgggaatattcatatcacctggacactatggaattgttgggttatggtggaattggacatacacctctcttcctctttcaaaacccctaaaacctgttttcggtggggtttgggtgcatgccagttgtgggaagtagcaccccggccactataaggattaa

SEQ ID NO: 43682 - DNA, 165 bp, Oryza sativa
atccgagggagagagagaggggaaagagggggaaacgggggaggggaacgcggggagtgattcccccctctttattgcgcgcggggccggcgggatgcggcggaattcgcggcggcggcggcgctagggcacgggcgggcggcgggcgcggcgggaggagggaga

SEQ ID NO: 43683 - DNA, 173 bp, Oryza sativa
gtgtcttttatatcatgtttgtgtggtgtaccccggcttttcctgggactgggattaatacactcgcgttcgggaaaaggcaattttcccggtcgcgacaactttcagatgaattcggctagaattatcaacaagtactagagaaaatacgacaagcaacaggagaggcatta

SEQ ID NO: 43684 - DNA, 554 bp, Oryza sativa
atcccccaaagtatatcaggcttctgtttgatatattctacttgctttaatatcttaatagtagagtggtatcggagtattagacgatacatgctaaatctatctcatcggctatgctatgaacatatataatctcattgttaatatatatttcgatctaagtgatttatactgtctcggcatggcgaccgatctatcccaatcacttgatttaagtatatatcaacataaggattatatattgttaatatatacagccgatcgagtagatttagttctttcttactgattcatgattgccgatcgattcacatatgacatcggctcaaagataaatgatacgtcatcggcggctggccgatcggctaccatttatggatttaaccgtagtttctttgtctttatttctcttttattgcaggatcaaatcaactggcacgctcacgaacctaaaggcaagatttttggacctgcactgaagttaagcagatcttccaggcctcgtgttttcgcatcaacacgcttttggcatgcccagtgggagacggcaagca

SEQ ID NO: 43685 - DNA, 524 bp, Oryza sativa
ttaacataatgtaaagttgggattcatatactcaggaagtatttcaataccataaatgtataaagaagagtgttttaaataaagttcaagcttacaaaagagaagagaatagcttctagagccatacccgaactcttccgaaggctaccggactccgatttctactctattcctattccattaggttaagaacactaaactaaacttgagagaatatgagagagctttgcttgaggtgtacgagtgaagtgagaagaggagctccttttatacgtaggtaatgacggttgtgatggttggaatggtcggtaataccctccaaccgtcattggggaacagtcccagccgtccatccaaacactgcattcataggcgccacgggaagttcggcgggttttggctgaaccatgggctgggcccacctggcccaaactcgacaggtggcctcctctgttgctcctttatgcagacttgtgaattttggcccaattcatcgtgtcaattctgagttcttggcccattca

SEQ ID NO: 43686 - DNA, 742 bp, Oryza sativa
aatgagtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttatttctgctgttatgtggaatttattagagttaaagcctttttcttttccgttggtcgtgtagacgctgcagcttcggaagatccgctcttcgtggaagttgaagccgacgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaaccccaactagtggacactccactcatgacaccactagtttaattttaggtagatgcttcgcaatttaattaggtaacattaggtggttttacaactatagactttgggaaatattcatatcacctggatactttggaatggtggactattgtggaattggtttcacaccgctccttcctttcaaaacccctaaaatggttttgggctgggctaggggtgcatggttttgatggtagcacctcggccgtataaggaccggt

SEQ ID NO: 43687 - DNA, 1501 bp, Oryza sativa
ttcggcgatcgtcgactccatttgtgttttcagcccctcgtacgcacggttgtaatactctcctacctcctgtgcacaagaatttaattgatcatgcatgcatgacaatgtataataaagtactaattaattaactaactaacattcgcatggtttttgcagcaaccgtcccatatattgattcctggcgcgtagaggttggtaatgcgctaggcctcgagtttgattattctttcttgcctgcggtcagccggagtgggggggtgttgcttgcctggcggacgaccgtctggtctatctcagatgttcaccttgcggatttctctcttaccgcgttggttcggcacctttctgatgttgccccctggtggctctccatcatctatgggacacaggaggagcctgacaagcttcgtttcttagatgagcttcgttcactacgctcctctcgcacggggccgtgggccatcgtaggcgatttcaacctcattctcgaagctcgggataaaaacaaccttaatctcaatcgtcatatgatgggtcgttttcgtcggctcatcgacgagttggaactccaggagctgccgcttcacggacgttgcttcacttggagcaatgagcgcgagtcgcccacgcttgttaagctcgaccgcgtcctcttctctgcggattgggaggagcttttcccctcttgcctcctccaagcggcctcttctgtcgcctcagttcactgtgctcttctccttcatacctgcgtcacctccccaaaagcgcatcgttttcgttttaaggccttttggcccaagttcgacggcttttcttcaagtcgtgcaggacgcctggcatccccctgccaacctaccccctcttgctgctcttgcctggtgcttctctaccacggctaagcgcttacagagctggagtgaccgtcacattggcagtgttcgtctacagcttcagatggcgaaggaacttgtcttccggcctcatgttgcgcaggagagtcggtctctttcccccttggagacctggctgcggcgagatttaaagttgaagtgtcttggtcttgcctcacttgagcgtaccatcacgcgtcagcgttcgcgtttggtctagcttaaggagggtgacactaataccaagttctttcacctgcacgccagagctcgtaggcggaagaacttcatcacgcaccttcgtgatggtgaccagcttgccatctcccatgatgcgctgcaagagcttgcctcctctcacttttgcgccaccttggggacgagcgtcgagcgtgaactcgccctagacctccactctcttggcctctgccctgtgcagcttgaggggctggactgtcccttcacagaggatgaggtctgggcggtgattaagtccttgccctctaataaggcgcccggtcctgacagttttacaggctgtttctacaagacttgctgcccggtgatcaaggtcaaaattctggtggcccttaactccttgttcc

SEQ ID NO: 43688 - DNA, 1501 bp, Oryza sativa
tttggattcttgtgttttaagccggattttattgctgcttgattcctgcagttatggaggcttggcttctgatcaggtgcaatgccggcgatctgagctggtggagtataccaacgtaagggtgcgcagatggatgtgtagctggagatcgtgcgggtgctgtactgcagcaatcggggctacagaggattgatatatttgcctaaacttccatgaacatcggaagcgtgtcatgcaaggtcatgttggtgctagcttggtactgctatatgcttcttcttttttcaaatcatttgagaataaattgattaaaacaatctactccaaagggcacaatgaactggtggaagaagagaagcatccttttcaaattgccataatgggagcaatagacaaactgcatggtacttgttctatttttatgttaaatattagtgacacatgttacaagatcataagttaattaatttagtgaacctactagattttaccacaatatatattgatgtattttcattaggaacaatctgaatatattattcatctaatgtaaagatatagctatggttctacgcagttaatttctgatttttcccaaaatgttattttgtatggaaataaaaatgaggcttggtttcttctccgttgcaatgattcatttcttgccaacatggattccatgtgcattattgtactctgtttatttttcattttcaacttcaatggaaaactaaaatgaagcttgatttttatctaaaatggaaattgactttttttgtatgcatatatgtggggacacctaaattaggcctggtgccccgaaaatccactcgtgatcgtccaggatttcgattacgcacagattaatatacataacaacttttgattaattatacaaatttgatcatacaagctaattatacaactgttaaaggtttaaaagttccaaactaacacatccttatttgaaaatacaaggaagaatccaaactacccaactactaacctcctaaactactaatttacaactaataaactccataggcaaaagctcgagtgtagacaagcctagaaaaactcgttgttgctttagacctcactatcttctgatcttcttgttagcacaattcctctatatgttaaattatgcaagaatgagtacttatgtactcaacaaggcatattataaataattaaatgtagagagatatgaataaataaaacaatgagaaagtaaaagagtagtaataaaatcatatatcatttttgtgctcaaaattttagttttaaaactacttatacttcaggagtatgaatcacccttatgacacaactccaaaatcgggagtacagcgcattcgaatgatttaatttcacctctgtagatactatctagctttacccacacgatgcccacagctagctagaggctgagaataacagagccgttcgaaggtcccacttactactagttagtgcacagtggggttttggcccatca

SEQ ID NO: 43689 - DNA, 1501 bp, Oryza sativa
cggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaacctcgcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctgttccttcgttttttctatacgatttaaaggggcccttaatttttagcaacaccatgtggtcctcaaactcatcagcagcagacaacaactaaagagccgtgtaaatatatcagacaatgcaattagtagggagaggcgcccataacacacagaagagaacaaggatcagagacgaaaaggtttagccttttaacgctgtgatctactcgccgctacaaagagaatggacggattgatccaaagtgcctcgactttactacttgcggcggggtacaccgtgccgcccggcgtgccgcgcgcctcccaacgcgagagggggtttcga

SEQ ID NO: 43690 - DNA, 1501 bp, Oryza sativa
aaatttaaatatagaaatttttagaatacaaaaggagtttgaaatctttttaaaataaaactaaagatatttattttaaggtataaatttgaaaggataaaataaagatgctccaagtttatagaattcaataagaaccaaatataaaacttgtcacaaaagattttctctaatattttataatttaaaattgaaatagttcacaaatgatttaatttctgactttggatgaatttttgggatggtggcaaaaataaaaggaagggaataaattggactttagcccaagattatgtggtacggatttctgagtgaaacatttgtgggctaaaggaaattggactttctaaggaagcgattggaaatagtgttcttaacacaagagcaatcatttaatatttgtattaatattattcttctgccgaggagaatcaaaccttgggaatcaaattggcggtttgatttatataagaatttggatagtggaacatctagaggagtttgtggaaggtgttgtatgaaggagaaacataaggatttctaaagataggtatagatcaagggtttgatccacaataaattccagcaaaaaggaaattatactggtttagccctaaggataaaaagggttaatgggatataacagaaagttgggccgattagagaaacattggcccaaactaatttgtagacttggaaattttgaataggtaatttagatatggaggattccaaagggagagtatttgttggaggataaatttggatttggagataaatgtaggtggggaattataggaatttttataggaacggatttggtggtagtataataagctctaaaactatgttgactcagagggagattgaaagttgatattttatgtactctagagatatttgggtagagatcaaagggaaagtattaactctgaggaaattgaaaattattgttttatgtactctagggatggttggaaattattatttcatgtactttgaagatagttgagtgggaatcgaaagggtatttgtagatgtggagatgttcgggaatggattcgaaggaaatataatctagagccaaagttatagattaaaataaatggaagggttttgtaaaatttgaaataaacaaaataaggaataaaataaggattttataaaatttagaagagagcatttaactttgcaaataaaatttggatccaaattaaaagatattaaaagaaagcaaggttgctcaacgtaagaattgagaagagcatgacttaaaacatttcgcaaaaaattttcatgaaattttgagtatgttacaatatatattgagtgtgcaatgcaaaatgttgggctcaaccaagatataatgcagaaaagaattttgtggataaattttagtggttattctaaccttataactatcattctatattcgattggtaaactattttgatccctcaaggaatgtccccttgtttgattaaaaatcatctaaatggtt

SEQ ID NO: 43691 - DNA, 1501 bp, Oryza sativa
gattgtagttgagaaatagaactaggccttagtaaaatttgaagttgttgggagggaagagatgagtgtgattagacttgcagacatagctttaagaggcttcgcctgcgtgagatcgtttaagagtctgcatgtgaaaataagcttattttcgtatgtggctctgttaagagacccacttgagaaaactgttttttatacgggtctcttaacaaaccgtacgcgaaaatgcaggtcaacttttgtagaggctattggttactaacttactatccgcctgcaaattgtatggttctcgtaaaaaaaattgtttatatagcagtgatctaccaacaaccagttttgttagtttcccatctgggacaggttataggatatcttgacaaaaaaaaaaacacgaactaccatagggcttgtttccaccaaggatcctcacctagaattgctcaactaaatgaaattttcgcgtgtccctgcggaaaatctgcattataatgctaaaactgagttatgtggatttgtcatttatgtgattatagagtcgtacatgcatgtatctgctggagttttaaatcatgacgtttataactacgaatttagacatagcacggtctagatttaacacacaatttataaaaaaactatagtagtacttttaacacaaaacaaacaaattacaaaaacatatacaatgctagattgagtgaaactaatttgatattttagatgttactatttttctataaacttaatcaaacttggttaagtttgattaagaaagatgttaaaatgacttataagatgaaaatgagtagtagtatttttgttctcttttgcaaatttggtgtttggtggaaaccaacaaaaaaacgtttcttgaacatgttttaatttgttgggaagcattaaactacaaaagaaatatgatagtcatgacgattttctcgagtcctcaacatatatacacataaatggcccacgaaagaatatttgaacttgggtccccttactcaggaaaatgacagggtgaaagcatattctgtctagcttagaatttaaatatgtgatatccaggtaattgaaccatgacaaaatagtaaatctcagtttagagataacacttgcctccacgtttccaaatatctttgcaccacattgctgtgcacaatgcaataaatccatttcacactttttggccgaaaaaaaatccattccacactgacctggatgccataaacctgattaacacgggtagatcggttgcattgaacttatatactccctccgttccataatataagggattataagattttgcttgcaacgtttgaacactcgtcttatttaaaattttttgaaattattatttattttatttgtgacttactttattatctatagtattttaaacacaacttttcgttttttatgttggcaaaaaaaaattaaataaaataagtggtcaaacgttgtaataaaaaactcaaaatctcttatattg

SEQ ID NO: 43692 - DNA, 1501 bp, Oryza sativa
gccatggggattaagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagttttttatgaattgatcaaggttggcatccggccaacagctttcaaacggccacccgggcctggctgatcccattagccgcaaattttccaaacatcgaacccaaaccacctcagcaaatttcacaaagcagtagtcaaacaaaactacactaggaatcacctcacattcgcccatgaccatgggcacggctattcgaacagtttaataacctctgcagagggggtacactttacccacacgacattactaacctggatcatccagcccgtgcagaacggccacgactagagaccttaaggctttcatgacaaggcatttcgaaagccgacacaggttcaccatatgccaacaagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccaaccatgtggtcgcacttgtcttatgttcggatgaaattccaaggaaacggtccttaagtgcaagagcgggaaaccgtacacccggtacgttccccggtccccgattttttggaaattcatttagttcgcaagcaccgacccaggtgtcgggttttccaagtcttttgtaaaacccaagttttacccatggttggatattttatattttgagggggggtgttccgatgcgcgtacccgaaggcccgttaacaaggaggtttaagtgttcaataattcaaggagggtaattgcagcaattaggattggggccggcaggccgtctcgcaagccgcggccgaattacttgtgtaaatcctattcatgcaatatttgcagaaaagaaatacttagatttaaattataggtgcaagatgatcaaaggtgacttgccttgctcgagatcttgaacttgatcttcgaaatcctcgcactgcgggtcttcgggctccgaaactacacgcgaaatgggacaactcaacaaacggcgaaaataaagccatattattgacctctaggcgtgtcattagatagatctcgagatttgaggagttttggaagttgaacggagtcaaacggacttacggttgggaagattttgaatttctaagtttattcgatttttggtctaaaggaaaaggatttatttaaatcctttttgagagaagaaaagaaaagaaaagaaagagggaggggaaatagacttccctcgggcggctagggcgcggcccgagagaaaggggcggcttggccaagcttaatgggctggccggtccaagaaggcggcccaaggcg

SEQ ID NO: 43693 - DNA, 385 bp, Oryza sativa
atgacttacattgtgaaacggagggagtacctgtgatatgtatgatctgacccaattatcaaccaggaattgatttcaaagcggttggtggaaattaagagattacatgaagagagaattgaaattttgaacaaaatagcaacttttcaggtttgttgattggtcaagcacagaatgcatccttgcttagccttgaaggcccatgcttaatatttattgcatgggagaattttttagtatcagaacctgtatgactaactttgtgtgtgtgtttttaatctcctccagaatatcttgatggatttcaagagcattcgttcttcaaaagcttttcagcttgttaatgatcgacttcagaagtcacaagcagaattggatcactacc

SEQ ID NO: 43694 - DNA, 1501 bp, Oryza sativa
ttcttcaagtcgtgcaggacgcctggcatccccctgccaacctaccccctcttgctgctcttgcctggtgcttctctaccacggctaagcgcttacagagctggagtgaccgtcacattggcagtgttcgtctacagcttcagatggcgaaggaacttgtcttccggcctcatgttgcgcaggagagtcggtctctttcccccttggagacctggctgcggcgagatttaaagttgaagtgtcttggtcttgcctcacttgagcgtaccatcacgcgtcagcgttcgcgtttggtctagcttaaggagggtgacactaataccaagttctttcacctgcacgccagagctcgtaggcggaagaacttcatcacgcaccttcgtgatggtgaccagcttgccatctcccatgatgcgctgcaagagcttgcctcctctcacttttgcgccaccttggggacgagcgtcgagcgtgaactcgccctagacctccactctcttggcctctgccctgtgcagcttgaggggctggactgtcccttcacagaggatgaggtctgggcggtgattaagtccttgccctctaataaggcgcccggtcctgacagttttacaggctgtttctacaagacttgctgcccggtgatcaaggtcaaaattctggtggcccttaactccttgttcctgaccaacggccaaggtttcacttccctcaacgacgccctgatctccctcttgccgaagaaggacgaggctgttgacgttaaggatttcaggccgattagccttatccacagctttgggaagctgttctccaagatcttagcctcttgtctctcccctcgcctggacgagcttgtggcgcctaaccagagcgctttcatcaagggccgctctcttcatgacaacttccgctttgtccagcttgtggcaagggcgctccacgccaaacgcgttccccgacttcttctcaaggtggatattgcgaaggcctttgacacggtcagctggcctttcttgcttgaggtgctagcccagcttggcttcagtcaacgttggcgtgattggatctccctcattctcagtgcctcctcttcccgagtgctggttaatggggtgccaggtccacggttcccccatcggagaggtcttcgtcaaggagatcctctttcccccatgcttttcattctagtcatggatgtgctcaatgcattgctccgcaaagcctctgactcgggtggttttcttcccctcaattatcgtgctattcgacatcgtgcatccctctacgccgatgatctagttctcttcctttcccccgttcggcaggaccttgagttcatccaaggcatcctctctgtcttcggtgccgcttccgggcttcggaccaacttcaccaagtgctcgattactccgatccgctgatccgctgctcggttcttgacctggagctagttcaatcctcttttccttgctcgatctcggagtttccctacacctac

SEQ ID NO: 43695 - DNA, 234 bp, Oryza sativa
ccagtcacagaacctaagccaccctctagggtagagtcgttagtcgcgtgtttctttgcttgtgtgtgtagcgcgtggtttgcatcagtggggtgtgatgtaaccatgctaggttgtttgcttaatcaacctgcagaaataagcaaaacaaacaacacatcaacaaaaagagttagttcctttaaggtcttgtccctagttctggtctattctttccttgtatgcttcccctct

SEQ ID NO: 43696 - DNA, 573 bp, Oryza sativa
aacatgaagattctggagctgcgtcaggagaacctgcagctcaagaaggacctcgacgcgttggagtcgcagctgcaccagctcaagctcgcccaaggagaggacagccgccccaagcgccgccgcgtctgccgcagccagaagatcaccgcccgcaagagcacctccaggcccgagcttgttcgtcagtccttggcgtggacctgcttcgtcgagacccctcgtgccgagcctgcgcccgtggttcctcaggagggggaagcctccggcgttggcagcacggaggatgcgctgttgctcgccttccgtcctggcccgtcgcagcggtagtcgagtagttagtaggcttgcgcgtgtgtttttcctcgtttgtcttcttgagttgtgtggggcatggttatgccggtgtgtggcataactatgtcggagcctgtcttgtttttatttgcctaagcaacttgaaccttaatgaaccaatttaatatcagtaataaattcaagatttatggtagtcgtgggtggttagttttaatcgttagctctctctgtttgctggttctgtgtggggttttc

SEQ ID NO: 43697 - DNA, 1501 bp, Oryza sativa
cgggctcgcatgctcgccggcgaacggcggcacttcggcacaaacggagggcaccaagacgaagaggacgacgcggcgaactcaccggtgaccaaaggaacggcggaagggcaacggacggcgagggcgacgagaaggaagcggcgaagctcttcgggtcgacggcggcaacggcgctccggcggtcttcagcggtgacgaaggggcggacgaggacgacgacgaccttgcgaacccgatggtggcgacggcgaccgacgacggcgactgcaacggcggcgcgacacggctggagcgacggcgacgacggcggcgcgaagcagcacggcgctagggcgctacagacgccggcgagcgaaggcgagggaggcgacgggtagaggggagctcggggatccttttaaaggggctagcgagcagcgacggaggcccacggcggcggcaccggcgaagaaaagctcggcttggagagaggaaagccgatccgattcgaactcgaatcaaactcattccaaaccgatttggccgacgtttccaaaggagaaaaggaagaggagatcccggagattgtttcccctctatcaatttggccggagaaggaaaggcgcggccggatttggaagaagaaggcggcggcggcgctagggtttgcgggcggcggcggccgaaggaggacgacgaagctgacaagcggggcccacctgtcagcgactgagagagagaggagagcggcggctcggcggactgggccggctgggccgagggaaagagagagaagggttttgggccggctttcggcccaaagccaaaagaagacttttaaaacctttttcaatttaaattatttcttaaatgcaattccatttattaaaaatacttccttagctcaaataaatcccagaaaaatctaagaattatagaattaagcaaagtatttaacaaaattttatctagcccaattttatgttgagatttagcaaattaaaactagatcttctcttttaagcttttaaaatcatttctaataattccttttaaacaacaatttataatttaagggtttttaaacaagaaaagctcttaacaaatataattaatgatcaaataattactgaactgttctttgtattatttaagaattgagctctgaaaaatccgagaaaatttcagagagttgacttaatcatggagaatttaataaaaattaaatccatccatgctttatatttaggaaattttatttcccacatttaacttcacttgtaaattaatgaacatttaatataaattctattattaatttattaaataatttataaatcctgaaacaaaaatcaggatgtgataatggttttgatggccgcacccatggcaattaaggaccggttcgcgggaaaccctggaagaattcctcgtacttgccacaagccagcgtgggcaaggctgggcttgtagtgtagctctcctctagctgacgcatccaggcaagggtgagcgtgat

SEQ ID NO: 43698 - DNA, 1086 bp, Oryza sativa
ttacacattctaggcttttaggacatatcaaaaatcctccaagcctcatttgacttttatctttgcacattttaattgttggaggctttcacatgaattttaattattctttgcacaatttcgaggatgaattttagagtcgttttgggacgcgacaacaacccatcattatcaagttttagttggcaattaattaattaaccaatcacgattgaccatcgtgaactatcattagaccatccttaaataatagtgaataataagttatcccagttgtgtgctaatgtttctaagcatggctaagcaatcatatctaatatctagctgaaccaatatatatagcaaacaggccataacaaaggaatagattcacaccacccagtgacattcgaaaataaatgcacagttgaaataaatagagaatttaaatataggatcaacatgctcaaaggattgtgtttaagatctgtgtgacttgccttacaatattcggtcttcaattaatcttcttgaatacttccggcgcactcgcgaaccttcgcaacgacggaaacgacaagctaacacgcaaaacgaaggaaaagactaataaaaaccaaataaaccatacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttaaggacaattttaagatgtagatctttattttacacaacttttgcaacttgaagcacattaaactgagttcaaatgaattagttatgaatttttaaagattaaatcggattaaaacctttatattgattttaattgaattatgacgcaataatgaattatttttgaaaaggaaaagaaggattattgcgtcagcgggctagggtttcggtggaccgggcgcacggtggcggttcacgggaacggacggccgagatcaaccctatccaaaacggacggccgagatcgatcggtccacgaccggctcacggcgaacggctccga

SEQ ID NO: 43699 - DNA, 449 bp, Oryza sativa
ttgattactttattccttgataccttgggtaattataattggactagttgagctttatatatattggttcaactagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattatccgtgccaaccacaagccagcgtgggcaacggctttaccttttgtatagcatggttcattgcggagcaccagactgagaagtggcggagataagcccacgggggtcgctggggagtccatgccttgttttataagg

SEQ ID NO: 43700 - DNA, 994 bp, Oryza sativa
ttgattactttattccttgataccttgggtaattataattggactagttgagctttatatatattggttcaactagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattatccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctgataagagtaaaactattcgaatagccgtgcccgcggttatgggcgagttgagcaatgtttttcgtgattagtctcacacctctcacaatatttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactattttacttctcttaaatgttttgctaaatgctgcttttgcaaatgagcctatattatgccatcctttggtatctttgtgcacttgcatatttgctgtgtggcttgctgagtatgtcatatgctcaccttgcaataatcaatcaacctcagt

SEQ ID NO: 43701 - DNA, 803 bp, Oryza sativa
cataaccgcgggtacggctattcgaatagattaaactctgatcagaggtgtaccactgtacccacaagacacaaccccacatcatgttaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcactataatgaatcatgctatacaaaagataaagccgttgcccacgctggcttgtggttggcacgataaatgtttcacaacagtagctcgtgaaccggtccttaattgtcatgagcacaaccatcaaaaccatatgctcacaacccaccttatccagattttaattatcaattaattaacatcgcacgatttaccatcgtgagctaccattgattataaccctaattaatacataataattatgtaatataatttatacttaaccccttttaattagctaatgtttctaggcatggctaagcaaacctaaatatagcatttagctgaaccaatccaatatataaggttcatgctattcaaattataacccataggaaaataaagtcaacttcggccaataattaactgggaaaggctcaccacccgatgacattcgaaaacaatgcatagttgaaataaaataatagctttaaacgggatcaacatgctcaaagggttgtttgggatctgtgtgacttgccttgggcttccacaaacgcttcgg

SEQ ID NO: 43702 - DNA, 1501 bp, Oryza sativa
cgccgcctccgtcatcgtcatcgctgcggcgtgttccgcgtcgtccccgtctctgtgcagccactgccggctgccctcgtcgccccctcgccggtcccggtcgtcgtcgtcgtcgtcgtcctctcgtcgttcccggtcgtcgtggcgttcgcccctccgtcaagccgttcccgttcgtcgtcctcgcttcgtcaaggtcgctgcagcccccgtcatcgtcttcgtcctcgcctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatacgaactctgaatcgacccgttcaaagtctcctaatgtttgctataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccaagcctatttacctttgttatgacattattattgctattgttattattattaccttgttcaccctagattaaacaaaacctcaactagtgggtactctattcatggttccactagtataaatttaggtagatgcttcgctgaataattaggcaacattaggtggttttataactttagactttgggagttctcatatcatttggacactatggaattgttgaattatggtggaattggacacacacctctcttcctctttcaaaacccctaaaacctgttttcggtggggtttgggtgcatgccagttgtgggaagtagcaccccggccactataaggactaaa

SEQ ID NO: 43703 - DNA, 1501 bp, Oryza sativa
ctatccatctgtcacaaggtagaggttgagagggaaagcatacaagggaagaatagaccagaactagggacaagaccttaaaggaactaactcttcttattgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttccctccttcacagctggcttcactacttcctccatttcgctagcggatcctgcagtcttccggagcttcggcaaacaactgacgatgtcttcttcttcactgacctgaccatctagtactagttgaaaatccgaagaaggaagaacggagtaaaccttttgcaaatagcattaggggaaggagaaaaaggaactttcgcaaataatttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcagatgcatgattaatgcaagggaggtacaagggaataataatatagggattaagttttgcggtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaagttttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgtcctggaga

SEQ ID NO: 43704 - DNA, 1434 bp, Oryza sativa
cggcggcgatagggcacgggcgcggcggcgtacctggcgggagtaggaagataccaggtgggacccacccgtcagcgagagcggcgggcgggcccgcctgtcagcggcgcgcgcgcgcggggagccgatgggccgcgggagaggagagagagagggagggaatgggccgagccggcccaagagggaaaagggggggggaagcgaactttttttagggttttctttttataaaaccttttccactttgtttatttcttttctattattatttgtgctctgaaaattccactaaaatttatttaagcattttaggcttttaggaaatatacaaaaatcctccaagcctcatttgacttttatctttgcacattttaattgttggaggctttcacattgaattttaattattcttttgcacaatttcgaggatagattttagagtcgatttgggacgcgacaatggacgttgcttcggggttcgctgctggaagccgagcagcaccttaactagcaaggaggtgttcacctaggccaagagcaataaccggcgactgctccatgtcggcgacattggcagaataagaaagtaacgaaatgacactccaatttgcatctgcatactctccttcaccttcatgcgtgaagccccaaattcattttgcaaatcaaattaacatgcaatctccaatattacctgatctaaattgatgggctgcacatgtcctacatttggacatcatgctccatgtggtttgccgcagaggatagggtgaagtccgccggtgatggaggttgtttcctatttttcttttactcgtcatttgtatgacatgaacgagaatgttttttgcatttttttcgtgctttctagatgacgaataactgctactgcgcaacatcgagatcgtctctataccacgcagctacatccttccatcattccatcatctactaccgcacgcactagcacaaaaaggctttttccgctgccggccggcaacactgccagaaacctaaggccagtgaaaaaataaattttcactagtggtccaccaactgctagcgaaaattgacttccacaggcagcaaagttaggacagctgctagagaaaaggtgattttcactaatggtggctagtgagagccgccaatgaaaatgattttaggataaaaaaataaaaatcaagatccccaattactatccaaaatccataattctccgacccacaatcactgtcctaaatcccccaaatccacaataaccacaatcacaatcacaatcatcacaaccacaataatcacaatcacagtaatcacaaccatagaaaatctaggtccaaaatagttttgagaaattccaaatcattgtcccaatccccaatcacaatcccaaatcgttgtcccaaatccccaaccacaatcacacttcctaga

SEQ ID NO: 43705 - DNA, 1501 bp, Oryza sativa
ctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagttaagcttaatgaactggtgagttcaggtggtggtttgggcctgttgcaacgtggtgtaacgttggacagagattggttaatattgcttaattactacaactgttttactgctttcaactgctgcttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaactggaaaacctaagagctctcttaaaccttttcatctgcatatgctttttgcacttggatttgtttcgggaaaaatttggggttttgcctctttggtttgtgggaaaaatcttggtcgttcattcgggtcggatccttaaaatttgctcggtctagggttttagaaaaattttatccggaatttatttgatagtgagtcgggaatttattaggtgatatgcgctaagtcgtgtctaggtacgatggggagattttatgcgtatcattatagctatgcatctattttgtgcattgattcattgattagtttgttgcatgggtatctttatccgggttcataaaaaaaaaatgttctatgcataaaaatcatcatgcttggctagttgtttgagtcatttgtggcttcatttaatttggttttgagcatgcgttgattcctatcccttgcctaccttagatgtcagacctgttgttcgatcgcaagcgccgctccaagcttcagagtcgccacccatagctttatcgtcttcttagttttgtttgcttgctagtttctgtgcttaggtttgttgcttgtgggttagtcggcggtcgatatcatgtgtcagtggtatggctgcttttattaggagttgcgtgcctcttttttcagtgttttaatcaagattaagataatggcacttaattttataagaaagattagcttccaagccatctgttttcttcctttctcttatttctacctatcctcgtccagatga

SEQ ID NO: 43706 - DNA, 1501 bp, Oryza sativa
gagcttttccaaccctcatattctttttcagctcagctatttcaggatcatttacttgagctgctctgacttgatccacgagtgtaggccgtgcctctagggcagctacgaacccgtgttccacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcatgtggacgcaactgtcgcgaagcatatgcgaccactctgccttcttgcatcaacacacatcccaatccttggcgagatgcatcacagtatacctggaagtcttttgtctgatctggcagaattagaactggtgcagagactaacttcttcttgagttcttcaaaactttggttgcactcagccgaccacttgaatttttcatctttctttagcaactgtgtcatgggcctggcaatcttggagaaattttcgatgaaccgacggtaatagcccgcaagtccaagaaaactccggatttgagaaactgtctttggtggggtccacttggtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgttgctcatgttgtttttcagacttggaatagataagtatgtcgtcaatgaacaccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactggtgatagcctgatcgcaggtctatcttggagaacaccttagctccttttagctgatcaaacaggtcatcaattcttggcaacggatatttgttcttgattgtgacctcattaagggcccgataatcaacgcacatcctcttagtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgag

SEQ ID NO: 43707 - DNA, 808 bp, Oryza sativa
ggacccagggtcaggttgccagttcggtctgaatcatcataggccttgggttaaggcaggttcgtgtgggttcacggccttgattaataacattgtataactctaggatcgcgtttacaaaatagctttgagcaactaaacgtctttaaatgctgtttactgcaacgctaaccctttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacatcataactatgggcacggctattcgaatagattatactttgatcagaggtgtacaattttacccacaagacacgttttcctcacgtgaaaccacgtgccacataccaccatggcatacggacggaagacgtgacataccatcctagccataaacaagagtaccgacccaaccctgtctacggccggaatcccgggacaggtaaccaaggttgagcccctagcagcagaacaccggccctgtgccatgacatctcgactactgggccgc

SEQ ID NO: 43708 - DNA, 868 bp, Oryza sativa
tataccccagttgagcgcctgtgaagatggagccgtaggcccgctagtccgctgctgtttatttttgattgtcaggcttgaagtgcctttgtaatcatgtaaatattatcgatataataaagatgtgccgtttgtatcatgtttgtgtggtgtaccccggcttttcctgggacagggattaatacactagcgttcgggaaaatgcaaattttctcggtcgcgacaattgccgccactgcaccgcctccagccgccccggtcgccgcgccaaagcgccgactgtcacgcccggaatttctatccaaaattccaaacgcttacatgtgtgttaaaccctcgtccaggaatcaaccgaggcacacaatgacaatattgataatagagtacaaataattattaaatattcgcaaaataaaattattacagaggtagatagttcctctcaaacaaaaacaacattctacgcagcggaaaacaaaactaaaacaaactacggaacagcgacggcaactccactccacaggcaacttaaccagaacaagcctattcctccagatcatcaccttcactgaagtactcctcctctgatgaatgaatattgcaagaatgagcatatgacatactcaacaagccacacagcaaatatgcaagtgcacaggatagcaaaggatggcataatatagctcatttgcagaaaacagcatttaacaaatatttaagagagaagtaaaacagttgaataattaatcaatattaaataaacaccatacaacacacccgtgttgcataggcccaaccacatttgatcaaccaaccccagttgaacaaattaaccctccataccaggaattaaccattccaaaccagg

SEQ ID NO: 43709 - DNA, 174 bp, Oryza sativa
cggccaacctccagccacgccgctccgccacgtccgccgtcgccgccgcttgccgccgtcgccaagaggtgcgccaaggggtggagaagcccggccgcctgtccttcctcgccgccggcgacctgagagtcgccgccgccgttcaaccgagccgccgccgtcgcccttctcgtc

SEQ ID NO: 43710 - DNA, 731 bp, Oryza sativa
ttttaattaaaatttaaatgaagaaattcgcaaatatccatctaaagagcatataaacttcaaatggccataacttggccatttgaactcggaattggaccgttcaagtctctaattttttcttaagaagtcaagaacccatttttgtgctttgtttctgctgttatatggagtttattagagtaaaagccttttcttttccgttggtcgtgtagacgctgcagcttcggaagacccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttaccactgttttatttagccatgcctatttacctttgttatgaccttattattgttattgttattattaccttgttcaccctagaataaacaaaacctcaactagtggacaccctactcatggcaccactagttttatcttaggtagatgcttcgcaatttaattaggtaacattaggtggtttttcaactatagactttgggaaatattcatatcacctggacaccttggaatggtctggatattgtggaattggattcacaccgctccttctattcaaaatccccaaaatggttttaggctgggctcggggtgcatggttttgatagtagcacctcggccatataaggaccggt

SEQ ID NO: 43711 - DNA, 1501 bp, Oryza sativa
gctttcaggtttgggccaaatatgaaaaaatccagattccctccttttgttttgtctcttctctgtttctggcatgtttcctttcttcggtaaatcttgcttgcgtcctcctcaattgggtctagtaaaataagtcctaacagaagtctaatttatgtccctattgctacagtagtttcttcaagttccagtcgagcccggcctacgggggctcctggttagaacagacgcgctagataattttgtagcgcgcacttccataacttcctcctgtttcatcgttttgtatatttttcctgttccgcaccgcgtccggggaggttaagcgcgtgggtccactacggccacgcgtcattagcgctaataacagcgctagccatatggattaatctagttatagtttttattatcaaaataatacataaatagttaagttgaaagtttcgaaaatatgatgaaaaatttcaaaatctgagttgaaagtttcaaaaaaaaatcttgagagtttcaatttcgagttgacagtttttaaatttgagttggaagctttcaaactcgagttggaagttttcaaacttaggttgaaagttttcaaatttgggttgaaagtttttaaatttgacttgaaacttttcaaattttgagtcgaaagtcttcaaattcgggtcgaaagttttcaaaactcgagatgaaagttttcaaaattgatttaaaagtttaaattttgagttgaaagtttttaaattttaaattgaaagtttaaattttgagttgtgacttttaatttttcatctatagaaagtttcaaatttcacgtatagatttttaaatctttagttaaaaaaataggacctcatgaaaaaaaggaaagattaattaaagaaacataattatcggaaactaattccgtcaactaatctaatcttgattattttctccgaatctggcgcacttgcgcacgcttcccagcgatccctcgcgcaaaaaaacagaaacaaaagtggaccggaagagaaatcacgtacgaggacatgggcctaaaacgcgcgctagatggctagttagcgcgtctgcgctaattaggaaattcgccggcctacacctgacgccaccctaatcccgcgtccgattcaaccaaacccgtggagttaatctcaaattagtcgagggcttttgatctatcttttctctcaggaaattgaagtcaatcccatgaaaattgcttccgtatcgagctcagactcgagtttatctctccagtgaaccctagtttttatctctccggcgaagtcaagtctgattcaaccaaattagcacgttgacggacaaaaatgcagaaaaaaaagtgacgaacggaaggttacagatttttcttttctaattagttaagataaaatatgatatagatagtccggcgacgactacctcctcttctgatattctcacatacacccgtcgccgccatgcacacacactctcgagctgcgtgtacatttatagt

SEQ ID NO: 43712 - DNA, 1501 bp, Oryza sativa
acaaataccaataacaatgttatatacctcaatttctgacaaattcgaatgagttgtacctcgctcactcttactattaaagcttttcctaacacttatgttaacccgaggaatctccaatgacccatgtaaaccatcttgcacgaattctttagccacatcagaaatggttatacacttttgagcatggtatttttatttacttttaattgtttaccaatgtacgtgcagtatacacgcataagaattattacaggtggtacatagccaccgacatcataaaagtacatagacatatggccacattgctggtagctgataaactatggtctatatgggaatgggagtaacaaagagacattcaacaatcttatgaagatatttagaggatgtgtatgcatcgctcctcttgttgtaaaagaagggcacagaaatagctaaattcataactcgttgcaccgcagggagtagctgaggatgctcacaccgaacttcatttagggttttccattcatcttctattattgaatcgattctggctatggcttcctcgcctgttaccttgtgctcattcatgtagcactccacggtgcttgtggcatctcccttgttctttcttccagactgcatgtttgtgaaagagaaatatgattcagttacattatacatatctaggttttcttggaattccttgtttcaatgttctgcaggtagctagcattatgtgacaaattaaactatccaccattaaattaatattggtgaagagataattaagtagtatgatatcaatatcctttactaggtaggctgcattttgctagtgtgtatatgatggatatggaaaaattcagccgcaagagaaatcagggaagtacaaggcatgtactcaaattaagcccagttgagttactcatttgtaccttgaatgcagcgatgtcgttcatgaagcgtaatatctttccacaagctaatactgcactattatgttgtgttgccaactcaaatgcttcccgcgttactacatcatcctggccaactgtagtaattgcacaaagtagtggcattgatgatgataaagtagacaaagccacctgctccttaaagcttggcttgtaattttgatgagaccattcagcttcttggagataatatgcagataacttttggaactacacgcatgtgaataaaattaattagtcatacaaattttgcaatattgttgttcggctgcactacgaaagtactcaacacaaaggtacatgatccaggcatgctaattgtcgatttggacaagccatagtcaaaatacttatacaatcaaaaaaaaaattagtttgatggaaactacaagtcaaaacgtaggtacttcagtactttaactatctgttatataaatgtgtgctaagaattataatgaactagtactccatccaaccacccacttatgtacagtgtgcatctacattaaaaaaatcaaacatcacaaatttcggccatt

SEQ ID NO: 43713 - DNA, 1501 bp, Oryza sativa
atgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgctgcttttctctttgtttttgtttgtagatggccggcagcgttacccgtcgtggtttgagcatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgctagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaacctgcagctcaagaaggacctcgacgcgttggaggcgcagccgcaccagctcaaggtcgcccagggagagatcagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggctcgcgtgtgtttttcctcgtttgtctttttgagttgtgtggggcatggttacgccggtgtgtggtgtaactatgtcggagcctgtcttattttatttgcctaagcaacttgaaccttaatgaaccaatttaatagcagtgataaatttaagaataatagtagtcgtgggtggttagttttaatcgtcagctctctctctctgtttgctggttctgtgtggggttttcaga

SEQ ID NO: 43714 - DNA, 1501 bp, Oryza sativa
cagtttgtaaaattatgttgatttaaattattgcattatcgctctatttaaattcccgcgttatcactgttttatttagccatgcctatttacctttgttatgaccttattattattgctattgttattatttccttgttcaccctagattaaacaaaaccccaactagtggacactctactcatggtaccactagtatgattataggtagatgcttcgctttttaattaggtaacattaggtggttttacaactctagactttgggaatattcatatcacctggacaccatggaatggtttggttattgtggaattggattcacaccgccccctctattcaaaatccccaaaaatggttttaggctgggctcggggtgcatggttttgatagtagcacctcggccatataagaaccggtcttcgggcctctgttgcaaagcactaccgtacttccacatgtctagtgggtaaggcttagtttgtggctcagtctggttataaacaaaagtacacggatggagatggatgaagtcgggggtcgatggacattctccagggcaaatgaaggctacacgagctgtggcccggtagtcgagatgtcatggcacagggccggtgtcctgctgctaggggctcagtcctacctgcctgtcccgggggttccggccgtaggtgggattgggtcggtactcttgtctatggctaggatgggttggaaactatgtcacgtcttccgtctgtatatcgtggtggtatgtggcacgtggttacacgtgaggaagatgtgtcttgtgggtaaagatgtacacctctgatcagagtacaacctattcgaatagccgcgccctcggttatgggcaagccgagcaatgtacccaagttagtgttttaaattcttaaaacctgctaaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtattagattcgtgtttgcaaaatagccctgagcaactaaatgtctttaaatgctgtttactgcaaccctaaccctttatagtataactcccttgtactcccttgcatttattctgcatttgtgggtgtgtcttgttgagtacggtggttgtactcagtcttgctcaattttccccaaccccagaagaggagttcctggaggatgaaggcttcggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcg

SEQ ID NO: 43715 - DNA, 1501 bp, Oryza sativa
attagcatccgcaagtctatttatattcaagtctattttcgtaggtggaccacttaagcggcgcctgcaaaaatgagcccccccacgtcgggaaaaatgctttttctagtagtataattcatctagttttaagagtttaaggtttaaaatgtgtagttttgttgtttaagatatttgtgaactatcgctatagataggggagtaatttggatttttttttcttcgtaaaccatcatgttaccaatctatagcattgacatacgtatggtagcacgactcaactaccgcagcagagatcgatcgttgttccttccgcaatttggtcgacggcaggtttttccttcgcacggctgtcaaaacaacagtgcggttgcagctagcgacgatgacaactctaggttgacaatgagggccacttgaaactattaagactatatatatgtatatatatgattggagtataaaacaaaaaatgaagtacaagatgattatgagagggaagaaaatcgaaggatatgtatataaaaaagatgattaaaacgacacaatatttgtaattaagaaaacaaatttttacactttgttttatattttaagacaatttaattttttcaagtcaaacttatttaagtttgaccatatggtaacatgtacaacaccaaactagtttcattaaatatagcataaaatgtattttaataatgtttttgttttgggttgaaaatgctaatatgattcatataatgtattaaaaagtcataagcaaacatctacatactcctccgttaaataatatatctcacgctatagtaccgtgtttttttctttttttttttgcctgcgatgttgacacgttcgtccggtgcatatattctagtgctgtaccttttttttctaattatatttttgctgacagatctactaatgtttattttgacaaacgaaatcttattatattttatgcatgtacttactcccatttttttctattgtttgaagcgacatctatgatctatctctatatttattaacaagccaagcaactacccaacgtcgttgtttccacagtgcgtatgagcgagcgagcgagcgatgagagagatgcggcgttggtgcagcaggatgagcggtctcgtgtgggtggtgcttgtgtgctcatggacatggaggatcgcagctgctcaggctccgcaaccaccaaaaactgatccactcgagggtaagttgtactactacatcgatcttaccagattttttgatgtatcattttttttttgttttgtaataaagactctgtaagtttgtttggctcaatttctacatatataccaaaggctgagtcaatatggatctgatttgtccgaaagatcatctcataccatgtgcaaatcgtcgtcttgatcttggttttcctccatcgattgcaggcctctagcttgcctcagaaaaagaactagagggaacttgattcattttatagttctgcatggacatatataca

SEQ ID NO: 43716 - DNA, 1501 bp, Oryza sativa
catcctcacgccccaacttcttgaataatgaatacggcatcaagttcattgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagcggaagactagggcgacgaccacaggcacttgacggcaggcacgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggttcttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcggg

SEQ ID NO: 43717 - DNA, 1501 bp, Oryza sativa
cggggcaccagactgagaagtggcggagataagcccacgggggtcgctggggagtccatgccttgttttataagggggtgattatgatccaggaatggtgcactgtggtgagttgtgttatgcagagggtattgtcatagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcatcattgtaaaagatgcttaaactggtaataatttgattagctcctggtttggagttagatctgttcagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgcaagtgtgtaacgttattattatgatggatttgtatattaaattgtcagtttgtgtacctcggctgattcctggacgaggattttatgcacaaatgagttcggaaattactagtgaatttccgggcgtgacacaatcccacctacggccggaacccccgggacaggcaggtaggactgagcccctagcagcaggactccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcggg

SEQ ID NO: 43718 - DNA, 697 bp, Oryza sativa
attcctgcagcccggtccatgtgaaccaaggccaaagaacacacaaacaagactaatcctgctaatttaagtgttgattaggatgttacattaacatgtaagtgaggagagagccgcatagacatacattgttcagaaaaatgtttaataaggcctaagagtgcacggagaaaaataaaaaaaaagaaattatgcaagaggtagaactgacaataataaagcgaaaatcaagtttacaaatatagcatgtctcatgcctgtatacatcgtgtcctaaccaacttctaacttggtaagcttggccattttgtgttttttcatcttggttcgcacacatcaaacatgtacatacactaaaataagtgttttacaagtttgagtactaaattatacctacttgatatatgtactgcttgttaaatatgtgatccgaattttgggcccataatatattcggattagttatctaataggacactactttataggattagtttcctattagggctcctagatttctgctatatatatcccttgtaaaccgcacggggagggtgcgacagtccaatgtatcccctgtgtttgtatccaattcctctatagtgatcattgccggtcggcgcccgtggttttttcccgcaaggattttccacgtaaaaattcgtatctccgttgtgcatctattttcataacaagt

SEQ ID NO: 43719 - DNA, 1501 bp, Oryza sativa
acgatgacaggaacgattaattgttataacttgtgtagaatatacgtataaattcagtacagatttaaacagatataagttcagctgaacctcgctaagaaatatatatcatgaatctctctttgtcgtcaccaagtttgggtcttatccagtgattttccgtggttggataccgaacactggtttttacaacattaatcctagtagggaattttcatgcattacaaatgtggccttaccctagacttgcatattattgtacctagcatggactctattattgtgttcacctttctatcatacttgtttgttaataacatagtcttgattttctctttacaataaggttttgtggaatactccacacttgagatatttatttgctcgctattcatactcttagctaaaatgttaaacaaaatatggtaagcgaacatatctctactactttaaaagtgtaatcgtctgccttccgttcccttctcaccatgcaccagaggttgtgcgtccctttatgtgtacgtaatcaatatagaattcaatacttttccctcaatccacccacctagcctatccctaattatataggttagtctatgttttattctcaatccatccacccagccaatccctaattatatgagatgacccattggaaagcacagaatcttactagtttgaattaaatgtcatggttacccaaagaatctcaagtgatctatgaatgaaaagattgtagcaaattccaaagaaaaacctaggtcaaaaaaatccttcgaatggaaattgttgcttttacgcatcgcaaaactgaattttgaatatattataacagtcagtctcattactggagttgcatgcctgcaatcaatcgaggattttgttccttgcacacatattgatatactgactcttcagagagtgataacacaaaatggatctgcaggctagctgctgagccattgatcaaccaattttgtcttttcctggatcaatgcaaaaaaaatattcagtgacaggcatacaacctgaagaaccaattaagtgagagttgatctgattaattaactgatcagacgggtcgacgggacggccgtttacatccctagaggctctaacacaccttcatcatgcatgcatatgtgctattttgtatagttatgtgtgctataagtatataatattaatctatgtagcaacatctctagatcaggtcctagctatgatatgatcttccaggtatatattggaattggagtgagagagcccaaacatgcactgttgtacagaaccaaaatacaattgcaagtagctacatcatctataattcattcatccatatatctgaaactgcaaggaggctgctggctagcttcctcctctatttatacacacacccctctcacaggcctccacttgcatctctctctctctctctcccaattatatttgtagagagagggaagaaaagaagagaggggaggagcaatggcagggtctg

SEQ ID NO: 43720 - DNA, 1501 bp, Oryza sativa
aattatttattttttcagctctaccgtgtacctaccttactatgcaacccagaccagtcccgtgcctgcctgagttggtcgtgcgagactgaggctcgcctcagttgcggaggtgaacctaggtgggggagcggatagctgacctcagcccaccctgtgccatcaccgccgccaccatcaccttggcgtcgctggcacttagtattcgttcttaggtgattgggtgagattgcacatcgtattctgcgcgcacactttccaaactactaaacggtgtattttttacaaaaattttatatatgaaagttgctttaaaaaatcatattaatctattttttaaatttaaaatagttaatacttaattaatcacgcactaattgctcacctcgttttacgtatcttcccaatctacttctcctcaaacacagccttagtgcacatgggcacccgactaggtagacatgatatcaattcgtggcacaccgccagcttgacctccgtcggagccatgcgtggcctaagcccgctgcgcaagagcacacagtcgccgccgctctaccaaatcgccgccaccatcacctccctcctcacgctggagaaatcgggggaaagggtagaaatggcttatggttaggtttttcaggaatggggtgttttgtcctaagctcatgaaatctcagttgtccgatcaatatcctaccgacgccgtcaatcgtgccgactcacaccacgacttttttttatttttaatttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctaggacgattttgtactgtgcggggggtcgcctgcaaatgggcggccagggggcatgaaattttgcaggcggcccccttgctgccctgggggagggcgatttttgcctccccctataaagcccagtcccccctctctgaaatttcattatattcactaaaaatccaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgtttttatcaggcacaa

SEQ ID NO: 43721 - DNA, 1251 bp, Oryza sativa
ctgctgagggttttaatgcaacaactgtgagctaacctgtttgagtgaaatgaggacgaaatcccatgtgagttgctctctgtccgcaggcttatcttgcatgcgggctgtgcacttgtgaatttgagccctagtgtgctaaaacttaattatttctttataatcaaccaaaatcacattcttattttgcatacttgtgaaaatctattttcatatacatattctagataaaccttagaactgtacttgtggtagaattacacaatttcattcatttcttacaagtcctaacgtgtcatctcagcatactgttcaaacggtgagcaaataattgctttctattagtagtttgtatgcactattaattttttttctcaattttcaaccacttgaacatgttgaaacatgctctgggattgtaaaggtctttctagcaattgcattggaatatactctttaaatgatgatggttaaaatatttatattacagtggcaatgcgataagtgatgaagagatactaaaggtagcttggatgattgtcccatttggcatcttagtttcctttatcagcagcttatttgtgttgagggtaaagaaattgcggttatccgatacctatgctaaagctacattaattatcggtaagctttgtattaaccaagtttctgtacaagctttgtgtatttgtcctgaatatggtgactgatatttcatttagtataaattcgtcagagtgaatgagtcagttgattgaggataagctctttggaatgaatgaatcagttgattaagttagaatattccacatattaactcgttagtggtgctgaaatattatatcttccatgcaattgttgaacacctggctcttgatcaataaaatggagatgagcattcatgcaagcatacagttatttgtagcatttcaagatggtccttttagacatttatctatttgtttttctatttggatatgatctataaaagcacggctatgaatggctttgtctttcctgtttgtatgatatcactccacatgttttgccttatttttttcatattgtgtgacttctgtccactttcctcacgttgagagctaatgtatttagttgattcaatatgacagcatttgcttgcgtactggagctactggcagaacctctgtatattctctcccagaggaagaaatactatcaaataagagtgtatactgaacctgtggctactctgctgcgttgtttaacaacttt

SEQ ID NO: 43722 - DNA, 1501 bp, Oryza sativa
taggaatcgtgattttatgggacggagggagtataagactacatcatcctagcaaatagcatactgctagctgataagatttgtatgttaagccaaaaaatgctgctacaagcatgacgtcactacggaacacatctctccccaccaaaaatttgtggaaaaccctaagcacagctgtttgcagttctcactataagcttgaatcagctctatctaaatatatcaaagttcacaccgatgcaaaccgatcaacaaatgaaacgatttccacaatgaattaaactacagtgcacttttttttttttacaggaatgaccaaaggaggccatccaaatgacattaagattgaggggaaaaagttacaagacagcaaattatgcatactaagtgcccagctaatagaataaacaataacaaaatagaacgattaaacctctacaaaaacaaacaacgagatttaccaactctaatagcacaaatgaactgattggttccagtaagggctaagagtagtttcagtcaatctaaatgtaaacaatcacataatcacaaagtcacaacatacgtagaaacaggataaaatcagatgcagagttgcgcttggcaacttatcatatctctaatttttttttgggagggggggggggggggaatcacaactctcgtctaacaatccagccctctctctcagcaaccacagcaacttaggccccctttgattaaaggaaattcataggaattttagaggattttatttttataggaatttttcctatatagctctttgaatcaaaggaatggatcttatggaatcctatgaaattcctatgaatgcctaatgccatgcaagttttggaggaatatcatgaggtagaacctcatagaaactttccttcgagtctttatctctcctctaattcatgtatttttcctgtggtctaatcaaacggtcattcctgtgttttgtaatcctctgttttatacttatattcctatcaaaatcctacgattttcctattcgtacgttttctcaatcctgcgattaaaggggcccttattgaggattgcttttgaatttctgttcagaagggagcaaacttagcgaagggagggccgccggtaaggggcgggtgactggggatgcgcccgccgccggcgagagaggagggtttcctcggcggccgctttgctggggctggacgccggagcttggaggcggcggctgttggtaaggcaacgcaaggcaaaggcaagcagagagagagagagagaggatgggccagatattattgggcttccaaaagaggcctgaggtgggcccacgtgacagtctcacagcccactcccctcaactccgctcttcccaaatgggcccaggcccaagcctgggtataaaagcagagctctcgccatcttctggcgcaagcctcactctcctcctccccgcttcggattccaccgtcgcggagctcggcgcgggcggagatggagggcgacgccg

SEQ ID NO: 43723 - DNA, 1019 bp, Oryza sativa
cttccgccgtccctaaatgtttaacgccgttgccttttttcaccatgtttgaccgttcaccttattcaaaaagtttaagtaattattaattcttttcctatcgtttgatttattgttaaatatacttttatgtttatatatagttttacgtatttcacaagagtttttgaataagacgaacagtcaaacatgtttaaaaaagtcaacggcgtcaaatatttagagacggagggagtattatatatagtgaagtagtatatattccctccatacttataaaggaagttgtttaggataatgtttaagtcaaaccttgaaatataaatcatgaataactctcaagttgttgagtttaaaaatataaaaattatatgaatagatttgtcttgaaaaatacatttataaaagtatacatatatcaatttttcaataaatattcttatagaaaaaagaagtcaaagttgtgttttagagaccgtgtcgctgtcctaaacgacttcctttacgagtacggaaggagtatactagttaacacatcaaattaaaccatgaatgatgaatatgcaaattgatcaacactagcgcttgcctaggctagcggtgaaccggccaccaccacctcgcaatcagcataattaaaaaaaaacgagctttgaaaggagagacgttttccaaatattttttaagaagaaattatgagtgtattggagattgaatgggggatcttagggttgaacactaccacacacacctttactattgcactatcaagcaaatctcaattccataaccagcatcactatcgttccttattatccggtagcgagcaatcagtagtgattgatcgtatcactgttgatacataccggtttagactttagaaaaaggagaaaaaaaacattatgaggtgaactggcaatgatgagtcatgcatgttaatgtttgttttattagtgtaaggaataaggatgctacgggtgactattgatggatggatcatggaggcgtatgtatgcagg

SEQ ID NO: 43724 - DNA, 1501 bp, Oryza sativa
ctatgaagaagtatatcatttagtaatttgagaaccgtgctaacggaaatcgaggaaaaacggtatcttcatcaagtttttagtatgcgatgtacatcagtagcataagatttccttctataaacatatcaacaaaatgttaaggtctacagcttgacactgaatctatgtacttcctttacttattatagcactgaatctatgttaaggtccacgttgactttctctaggaggagcatgtattaacgtctgcgccggcatgagagggagggagtggggggatgtcagcgtgggacatggagggagggatggaatgggggagtaggggatctgagaggtgtggactgtggagtggtgcggggcgggggcatatatatcgaccccattcacaccgctggtcacaaaccaccacctcccacgaagtacggacgtttgggaaatcccattggtttcgcttccattccatcattctttttgcaatattctcggtaaccgcacaatatttacgtgagttccaatgaacggccaggccattcgtggttaacgaagcaacgtagtacgtacatgaccatttacgcccgcaagggaaaattaaattctgatgtgaaacaatacgttgtgcaaattaaaatgtggttaacaaagcgtcgcacaccgcgtgaattttccgaatcgccgtgattgggttatacttatatcatttacatccatcaacaatagaaccacaaggtttcacaaccgtaagttcccatcgctcgctcagcaaccacttcttcttcttcttcttcttctttttcttcttcttcaaccttgttccatgagccaacacggggctatctccatggctacctccttcaaggacaaggacgaagcggccgagaatgcgcttgcccaggccgcggtcacattgcatgtgggcgagtcgaacgtgacaaacaccaacgtggccacgtctttcacagagacatgtcatgtgctttgttgccatgatatactcgtctaaatcgcgggcctcgttctcgttgcggccaccgtgatggagtccattgccgacctcctcagcctatgcgccatgtatgttatgttgtgtattgtcctgccgtacattgcttttgtactgtggctcgtacgtactctagtatataccgaacataacatttcgtacacacactgctgactcacgtacattttgttaatttgaagctgcaaggcaatgcatctagcggccaaggaggcctgtcgtcgggaagcggatgcattcggataatctggagagcatgaaatggccaggacaaagagagttaccacgccgtcctcaaacaccttgccttcaatggaaacaaggtgtcgtccgagtgaacgcggaaggattcggcatcgattatctctagggaagacgagggatatgagaaagaagacgatgtcattgtcgtgtttgtatcagtgtgtaggtaccgctcaccttgccgccggcaggtcaccttatagccgacctgttggc

SEQ ID NO: 43725 - DNA, 1501 bp, Oryza sativa
agttcattgaaccattctctacagttgattaaagcatagctcgagttggagttttccggctatttggtctagttggtctaagtggtgggctagttggcctaatttcgagcctcacgtacacctcaataaaatggcaatggcaagaaccagacgccctattttttttaagtattgggtgctttccaatggcattagaaatctaggagcgccaatcttttacactattgtattctcaaataacataatttttacatttgcaatataatggttgtacaaagaaaattcactctctttcaaagcgttggagttggagcacatgcttcttttttttttcttagcgtgacatcttaacattaagcaaatccttttcctgtcttgccgtgacctgcactcaaaaataagggagcacctgtattaaatcctaataaattctattggcccacattaagtgctatggataataatatcactttggaaatctaagtgaagaggtctcaacttaaatacggagctagtggagagtttctgttgaccggttaagatggtgcgcggacaaccaagtggggcgaggcgaggagaggcgaggcagacaactgctgcgctatctcgttttgtaacggatggtaataagcacggagaattgatttcgtatcaatgaactttatggaattaaacgtcgtgaattgattccgtcggttacggaattaaatgtcatgaattgattccgtattaacgagtgcgtcggttacgaaattaaacaccgtggttgatgactccgaacgttactctcgcgctcgcatatatatactccgcagtgatccaaaggacggaagaagttcttcacgactcttgcacttcgagttcctcctcctttgttcctgagctgcagaatccttccccggttctgttcacctgtgcgcacaggtgtacgggacgagcaggtgcctccggaactccgtccgcttgagaacttgcacgggtaggcgggcgatcaagtttttgggtagcgcttcaagcgtgactgctattgttcttcgcggctactgctgctgcatcggcaccttcaccaagatgtcaacggagattggagacaagaagatgaacgacatcaatggaggcaatactacctcaaaatccagcggtgggacgttctcggggtatactttcattctcccgattttattagatgtttctttgttaatactcttcgcaatggcagcattgcgttactttgtaaatgttgatgcttatttcatattaagcatactcaagttgtatacatctagcactgtcactagatctactcatattgtaaatgtcatgtttattatcttaatattttggattaaaatatgccgaattatgaccaaatttccaacaatccaaaaacttgttaggtctttttcggtagttggctttgctgcatcactaaaaccacatgctttcgatggttcaaattataaaagatggaaagcacgtgcacttttgtggttgacggtga

SEQ ID NO: 43726 - DNA, 1501 bp, Oryza sativa
actatgagggctgcagatttgtttatggtactctgagttgaggaagggagatgaaatttcagttcctataaaaccgtccaaagttcaaccaaggaggcacaaaaatgtgaaaacagatcctattttctctgttgagatctccaatttaatttcatttggtccttgctccatctatttaatgaagtgcctgaacttcctagagaatagagactatcacatgaataaacatgattttgatatctgatgtatgtatggatggatgcaacatcatggagcacttcacttaactccaatggtgacaccctcccccatctcttagccatcacctgccaaccttttccaataaaggtgcaagaaatggtccatgctccatggtgtccatccatcaaagtttctcttacttttttttctccattctgagctcatgcccatttgtgcttttaattgaacaattcaaatgctacctttcagacctgagaatcctgtttcttcatttatgtcatctgaccacatatcactgttaatcaaagcgttttccaggaagctaattaggctgtagtaatagtaaacaggcatcgtattcataccggcttatgcttcttattttcttgttttaataaaaattgatgtttctgttatgttataataatatttttgatcaattgtttatgtggttacaatggatgtcccaatcagaaaagagggtggccggtggcctctcactttccctacccctcacatctggtctaccaaatgctgctgagggtttacttgtaacttattatttcagcacattttatacgcatgcatgcagctatctgtggattgaatttaatatgtgtttagagtctaaatgttgattgatgactatgtgtgcatcaacatgtcatcatctgggtataattgaattttttaaagatacttctattgtagtaaagatacttgtaggatgtaattaatagagatttcaagcgtacacgtatgtagcaaccctccaaagatttgaaattgaggcagaatactcctatcatgatagatagcttccatctgtaaagatgtaaattccagacagggagttaaaaactgatatccagctgatgtgaatacaaagatctgcagaaaggagacatactttttcttctttatcctttcatgttgttgtcaacacttttcttgttgaacattctgtgcgggatatgcttcaaacaacctgatgattcctactaccaatcttatgattccttgggaaaaagtaaatcttgtgggcattcgatatcccaacaaaactttcccaaccaactttagctggcacaactttcttctgcaataaccttcttttgttttttcatctcttgttgcaaccaagaacatttgtcaaagtggtagttacgctgccagctacctctctggtttcagcaatggcaggtttctaaatacatgttcttgttctaatttcaggataaagaaaatctgctgcagaggtacaagatctagtggcaga

SEQ ID NO: 43727 - DNA, 1501 bp, Oryza sativa
ccgatcctggccgcatgcttggagggaatttcctccatcgccgtcaccagctccgcaagagaagacgtcagcgagaactcatcgggattcgccgggatggtggacttgataccgcactccccggcaagctggtgcagaccagtataggtgacctgcaacgagccacggatttccgacaagctgttctcaagctccgacatgcggtgctcgagcccctgccgttgtcgctcgttgccggccaccagttctctcatcttctggaggtcctcgcgaacctctgccagatcacgcgccagccgatcggcgcgctcattcgccgacgacgccaccgccgccctcgcctccgcgatctcacaactaatgccgcgagcaccagccccgaggaggcgccccatctcgacctggagctcctcccaggtgaggacggcagccggcggaccccgaccagccgcaagatcactggccggtccactaggcgtcgcttcgcagctcctgggcacggccacgacgtctgtcgaggccacagcaggagacgcgctggaggttcctccagacccgtcttgcgccgcctttgcctgcgccgctctgcgaaaggttgcaattgagacaggctaaatgagtttggcaaagtgacaaaacctcaaattcatccgcttacttctcgccaagcatcacaacccgccgctgtcgcggaggcgggggagacgcgtctgaggcctggagcataacgggtatgatgtaagttggaagtttgccgatcacgcgatgaaggaccaggaagcttatcgagggagtgggtgtcttccgacgatttccgatcacggaggagaatttcctccccctcttcggaacgttgccgccactcgttgtggcagcagcggcggcaacatcggacacctccttggcgatgttctccttcagtgacgccgccgccaggtgatccacgagcggtccgatgatgtcagtcagagagagatcctacgctttatgaagtcacgatgcgatcttgggaaaaaagtgcaaaagagctgtcgagtacacttacattgatggtagcttcgcgttcggctgcccccttctcgcaaaggggaacagggacgttcttgccattgtcgggccactgatcatcatctggctgacacagcgctccacggcttcgctgctcagacctgtgaatcgagaaccaaaactcccttaaatagacgcacctttgacggtgcgaattccaaggaaaggggagagatggccgccggaaatttctgggtccgttacgcgcggcagtttctcggacttcaatttaaattcactcatgaccattgagcttcacccggcattgtcgatcacttcttgtctctcggtcatcacaccgagaacgacgacaacttcgacatcagaagtcgcgatcggtttcacgagtttattcaagcagaagtcgggggctactgtcagggttacgggaaagttataccctctaccctttgatatacgtcacatatcaaca

SEQ ID NO: 43728 - DNA, 1501 bp, Oryza sativa
gaagaaaatactaacacagcttaccttgggttcccatccaattctcctacatattccgcgaaatttccaatggagttctgaaatatttttcccagccacaaagtgtgtggcctggtcaagacagttttcaaacggaaaggaaaggaacatggcagatagaagatccctttcatgtctatattcataattaggtagactacttacaacagaatatttgctgcaaaatcttggttttaaactttaaactactactctgtactcgtgtagcagactactgcacttgtaggtgttaatactatatatgctgtttgcctgtcaggtggtaagcacctttcaccttctgtagagtccgagattgggaatttgggatgaatcgattgagggagtgcactgccacaaacagacgtccatgcactactgccacgaacaagttataggaaaatgacattttgtgacactgagtaaattatgtactgtagtgcaggttttttcctcttattagtttttttattccctttattagtttgaaaatcatggacaattttccctcttgccttttaattgaaaatcataaattatgtttttttatcacataaacgacgtcgccacatttttttcttttgcggtgtccatattttgtgtgcagtgaccacaggcgccaatcattttgctcctttccccaccttttcccttacggcctgtttagttagagggataaggctattaagtgttttgtttggttgggaaacatggaaattttggtaggatggagatggggaattgaggaaggaactctctccttttcaatacctgggtaggggcaggtaattgggagggaattccttttttactttgtctaagcaaatctcatccatccgttttttttaatgatccaatctccaactaaactccctatcaattttcatcgcctctaccaaacaagatattgggattaaaaatcaaattcccatcttaatctcatcatcaattccctcatgtaaactcccaatccctttccctcaggttaccaaacaggccgttaagaaaagatggtgcaagtattccgcatctatgcaatttcctttatacttcttcacaacttccatcttttgacgagtttggaatcgtagagttgcgctaattcagcttttgggcagtttgtgtattaaactgacaaagctgcactggtgtcaaatatttttggatggatgcagtatttgttagctttataatatactccatccattagtgttataaagtttaactcataaagtacagcatcttctcccccgtgtcgctctcccccaggggcgactcgcgagaccaacccggtcaccccctcctcccctcccccaccttcctcctccgcctcgccgctgcccgagtggccgccggcaaagccgcgtggccgcaaggacggcggcagcggggcttcacgcctctccttgcgcgagcagcaaggggagcctctagtgcggcggcgacggtgaccgccaagtcc

SEQ ID NO: 43729 - DNA, 1501 bp, Oryza sativa
acgcgtaactgcgtcagagactcagaaataacacaccagccgtgcccgtgccgtgtgtttccacccatagatcatgtgctccctccctatcttgaggtcgacgcgtcccgtacgttgtagatcgatgcacacgctgatacgcattgccatttcggttttacctcttcgggtgtacgttcatcgatcgatcgctgcaaatccttggagaggattgatgcggcaaaagctttcgtccggtgttaattcagccggtgaaagaaaaggtaatggccgctgtgtcggatgacagagatggccgcgtgcaattgttcagggtgaacttgacggggaggatcattaggccctgcccgctcggtcacggctaagccctgtcaacttatgtttagggctggtcttgggcttaggagtggatgtgttgagctcggttccaggttctaacctaatcacctatgctcttttgcatgctctaatctttcaaaagtgggtggcaaaaagcctatggaagtactaatactaaatgttcaaaaaaaagtactaatactatgttagtggggtatggggagaattaattgtgctttgcaatttatcactctaccaaaaaggatcatatagaataagatttcgaaatggcatgtctagaggtttctcgaagctcttttccaagctcgatacaatcaagcactgaaaagaacctagccatggataacgttgacttgctgcctaccactatgcgtctacggcggattgttgtttttgttttcgttttgtcgatgttctcgtctctcttatttttctttttcctttttttggcaaaagccggatttattgatttacctgagagcccttctccattttcttatgtttactttaacctgttaataaaaccataccatacgctaggtgagccattagcgcatgattaattgtgtattaactattttaaattttaaaaatagattaatatgattttttaaagtaactttcctatagaaaatttttgcaaaaaaaaacgtaccgtttaatagtttaaaaaacgtgcacgcgtaaaacgagtcacaatctcccctatctcccctaaagaacgcagccaagttggtttgaattatacctctcattatatgcttattacctgtaagtctaactaaaatttaaattttaaaactttattttctttctagtattggtttttaagatagctaataatatatatagaaatgctttatctataagttatttttagttgcttcgttaattgtagctgaaacaatcatgctctgaactaacagtaacaatgtacggtgacgatcatgggtggtcggcgtcagccacgccgtgactctcttgggctttattagctctccctgcagtctcggtgtgttatatatacatggctccatcccggtacatgtaggggcatgtgaaggacagtagcatctggccaccccgctcttcttgagctagcgactccgtgcttgagtagcaaaggagcgagtgagcattt

SEQ ID NO: 43730 - DNA, 1501 bp, Oryza sativa
gctcgaggaggggaagcggcgggctcgatgaggggaggtgacaaagggcttgctggcggggaggagccctcccatccgccagatctggtaggaggggaggcagcggcaggggcggcaggctcgcggaggagacacagcggcgggcgacatcgtgacggctcgaagacaaccgaccgtgcgatgacgacttcattcggcggccagatcttcttcaacaaggcaagccaccaagccaagcaaatccctctctctaccattcccctctcgcttctccggtggtggtgtgatttttttcattgaataaatttgtgttgtgggatgaatccatctttgaatgttgtgggatgaatgttgtagactgctcggctcgatgtgtcggctcgatcgagccggctttttttttattcgtcgaacctaaaaggtgtcggttctaaggaaccgacacctttttaattttcaaatcagtaccacctcccttgtgccggttggaaaaaccggcaccgaaagaggtttcccaaccagcactaaaacctttttctgtggtagtgtttttagaaaaaacatggagagtctagaaggctcatgagcctactaagaaaaaggtattaaggttgtggatactaatatcacttcagctatgtacctgtcaatggtgttctcatgattaattattattacaaaattaagcttagtgttatttaaacaacctataaatgtatctaaagtattgaaagcaaaatggtttcaaagcacctcattggtccatagtggcaaaaaaatatggatcatcagattgataaaaagacaaaacaagaaaagcaaatgtgggccatcagatcaaggaagtagaaaaccaggtcaactgataatgatgagcaatctaggtacttcatgcttgattattttttcgggtgcaatgctgaaagatggtgaatgctaaggaagaaaagatgaagtagaattaggggtgtttagatgggactaaaactttttaaactttttagtccctgttatattggatgtttagacgttaatttggagtattaaacatagactaataataaaactaattcataaatgagagctaattcacgaaacgaattttttaagcctaattaatccataattattaatggattaattagacttaaaaaattcatctcgcgaattagctctcatttatgaattaattttattattagtctatatttaatactctaaatatgtgtctaaatatccgatgtgacagtgactagtccctgtttcccaacaccatgcttgtctgagttaccagttaaacataatatcaataatatcaatggtgattttaatcattgctttttatatataaagcaaataggctcatatattactgattctaatggtcgggttaaagttgtgcgaatccacaactccactggctagaacaactggaaatttctttcctgatttaataagcatgtactccctctgtagcctaatataaggattatttatttta

SEQ ID NO: 43731 - DNA, 1501 bp, Oryza sativa
ggtggtacatgagccaggacgggtgggagatgcagaagccgccaccgtggagctgcacgacgacggggaggcgccgctcggcgagggcgacctcggggaggtacacgcggaggttgggctcgccggggaggtcgtgcagcgtgtggccgtcgcgcggctcggcgtaggcgggcaccggctgcatcagcgggagcacctcggggggacccgtccacgtgcggtcgacggtgccgtcgtcgaacacgcgcagccagccggacacctcgtccaccaccttgcgcccgaccgccgccgccgcgacggcgtcggtggcggcggcttgcacctgcgcctgctgcgactcggtggcgatggccattgctgccgtacgtacgtcaggctagtggcgttgcttccgccgtgtgtgcgatgcgattcgatgtgcgcggtgcgagagatggatgaagtggcgagggttttattgccggtgaccgagtggctccgtgttgcagttgccgattgtactactgggaagtttcgcacggaatatcacggcgattgccaagcaaaattttcccggattcgcaagcagagttgctgcagagtggtggagacttgacaggttaggagtagggtcgtgtgtggacttgtagagcgactagaccaaccgaatagcgagtgttctttttttattgcgaaaattatattgactttggtggttatagacgagattgcaagaaatgatcaggtcgtcctcaagtttcatactactacatgtggcctgtggccatgtggatacagcaagaagccaagaagtatatcactaatccgttcgtgaatctgaatcttaatccgtatgaactagggcgttcatgaccaaggacttcagtgttttgcaggttaggtcgatcggagaataacaacagggaacatttactatgctgagttataatcgaactccaaacaacaattttctcgttttctgtttaaacttaccgaactaaaaaaaaatgatgtctcttattaaaaaatgtctatatatatatatataataaatctattttttataataattattccctcgtcccgaaataaatgtaaccctcttgttacttattttattttagaatgaaagaggtaatacttaattaattatatgctaatgagttttcctgtatcatgtacctccaaatctcctccccaacctgttgtttgaaaagctatttttttttcagttcgtgcgaaagacaaagtaatttctgtagaattcgtacggtaagttccaaacaggacgcaagtacttacatctggagtacgaatttttctctccataaaaaataaaaaccaatcctaattacaaacctaggtttatctttttttaaggacgaaatagtaaagaatgaataaaaaatttgaaggtagagaatgaacaacatccttatatccgttggatctaatatggatgggtcggaccagatcgtttgttaccgttctaatgctacagtaccgttccacatttttg

SEQ ID NO: 43732 - DNA, 1501 bp, Oryza sativa
cggcttcgctatttgtggtggattggggaacagagagattgagggagggggagaaattttatactagtttttagattttagggtgtttagtgctaaattttatatgatatgtagtttgaaaacatgtgaggactagaatagaagatgacgggaaaaagctaaggggctgtttggatgctatactaagtttgccactattcaccatactatttgtgccacacttgcctaagttgtggcttacaaaaagtgagccacaccttagctagcaaaattggattgtgccacactttgttgagttgatgacacgtggggcccaaatagataagaaggaatcttgccacaagtgtggctatgaaccaaacaatatactaactttgtcaaacttgcctaacatgaggtgtggtaacctttggcaaactttaggagcaaaccaaacaaccccttaggggttgtctgggagaggaggtgtgaccttaacctgaggtttctcattttgggtagcttgcactatgagtgcccctagtatgattgtgatatgtgatgatgtcaaaagtaacaaaaggaaaataaatacatttacttaaagaaaaaaagaaaaaaacatctttgcctttggttgtagttgaacttgagagttgagccttttttttttaacgaaaagcggcaaaagacttgccgaatatattagaagcagtagaaacaaaattgttcacagtacaatcaaaagccaaaggccaagggccaaaagactgaggaagcaactaaaacagctattgctatggatataaactccacagatacattgactcgtaatccctttaaggctatcacatgggccttttggaaagagctattcacttataatttcctgtatcaagaaagccacctggttttcgtttagccaaatatgttggaaaattctaaggttacgttgaagccaaacattccaccaagttatgatcagatctccaaggatcctctattcctcttcctcttagttactggtgagatgtgacacaacatatcccaccacttgagagttgagactaatcttgagcaaatgattagacatgctgattgcgcatttcctgcaagatttgcaaagtgatattgacgataaatcagacaacatgtaatgagataatccatatggatcagaaataaaaaaccgttagtacttgcttatagtggagagatttgatgccgttcgattctgactactctgcagtggatgctgagcctcaatggcgtcgcatctcaatcatcaagtggtggtggagctgttctttcccagggacatttcagggcacggccatatctctgaagctccaaaatccaatagtctcaacctcgcgcgagtcctttataaaaagcatctccatttctcacacgctactgaaagctcattgctcctgggtagagagagagagagagagagagagaaagcagaggctgctgcaactgtgaagcttcacctgcagaggaggagggagaagaacaa

SEQ ID NO: 43733 - DNA, 1501 bp, Oryza sativa
gaagatgatgtggcccccgctgacgaagagttcttccaggagcaagtcggctacgatgagttttagggtttcggcctagttcccaagtcgcgcctgtgatgtttggtccaagtcttggcttccgctttcccttttgtaatgcagttgtgagctcaggatctgtccgcagcccaacatgactgtactcctactctataataaagagacctctgtcgctgtgatatactgtcttcctgtgttaccagcactgtttcctgggactggtatcgattaacaggttaatttggagcgtcacgggctagttccgctcggggctagttcggggcgtgacacgttgtccctgccctcgccttgccggatccgcaaacaccgtgaaccttgacgacaccagtttgactttgaccgaacatcttataacctaaaacggaggaagtatcttgttggaaacacactgttgattctgagctgttagcgaggtcgctgagccctaatttcttccataagtatgttcctggttgacatctggccagactgtgatctgctgtttcaaaggcagggcattgcggagggcataggtcacaatggggattgtcaatccattttttcttcatcatattgccatattggcattagtgtttaatatctgtctctcaaagctaaagcacataatgtctgatgaaaggttaacagcaccattctaaaaaaaaaaaggttaacagctgatatgcattcgaggtggagcgttgtttgcaaggggacagagctctttggtcaggtgaccgtgactctgaattggggcagaaatcattcagaaacagctgcatatcttgtagctctagctgtcttggtgagaagggtttggaaatttggatgcagttgtatgtgccaagacttaatgacaaattatcatgagtcactcggagaggagtcactgagggcatgtttggttgttgcctaatgttaccccttgccacaagcccacaactcaactcgtccttgtttaacattacacaacatgtttgccatgttggtggaccactgggcccctagcctgtactactactggacttcgatagaagacgaattgacttgctgctgccgactgctagtcgaagtctttcattaaacaagtaggatttgcgagatctattgctctgaactaggtcccgtataatttccttccccaccgggagctccgtcctgcactcacgcagtcacgccgcttggtctgttgtctttgtgcatctccgttccttcgtgcttcgctgttcccaaatcccaataccagccacgccgggttagttcactgacccacccgaagcttacactgttgcagtctaaatatgttgccacttgctgtcttgccatgtgccgaaagacaacatgggtcactccagtatctagtttacttatccatagaccacagctgttgaattgtgtgatcggctactagtacatcactgctcgtgattcagtacgtacaccgcggtaactggtaagg

SEQ ID NO: 43734 - DNA, 1501 bp, Oryza sativa
tcggtttttcactacctagggccgaattgatgaccaaatttctcggtctcgattttttcggtcttggtctcggtctttcggttcggtctttttctgcccacccatatctgctactcagctggtatgtccaaaatgggacaccgtgtaatgacagcccccatacgtataacgcatattagtttggacccgtagtatcagcaatacgtacgatgcaataccttggagggggagagttgactaccaaattaagtgacgaggccaataccagatttgacacgttttagcaaccactagactcaaccactacgagcctacgaccagtaggagcaactaacagcgagaacaagtgcgtttcccacaaccccggtgctctggaatgctggaaggtaacgattactggcttgctgtttcaaatgattctagcgcatttggttgcataggtatagctactacgtatagcaaaatcagaaggacctttctttttgttgttgttgtcagtcgcctgatcatgtaggtcatcaggaaagatgggttaagaagctccactttgttgaacatgtagctacatcataataggggatatatccggtgaaaacgagttaagtgttgaaaactcgtaaaaatcatatctaaaagttttataaattcatgaaaaaaatactacatataagtgtagatatgaaatacattctcaccaaatttcaagttcaaactcaactttatttaggagtaacaaaaaagataaattttgggtgaatagaacatgacactattcactcgaaatttgtctttttttttctcttaaacgaaattgagtttggagttgagatttgatgagaatgtatttcatatctacacctatatctagtattttttttcatgaatttacgaagcttctaggtatgattttcacgaatttgcaacacttagctcgttttcaccagatatgtcctctttctaatatactcccttcgtcttaaaaaagccaacctcatattaggatacgacacatttatttttttttatggatggagtatctctcagttttagtccgtgactttatgttgatggaagctactcccttcgctccaaaatataaaaaattttaggtggatgtgacatattatagtatgaatatgaacaaagagttagaacatataatatccaaaaaaatctcttatattttgaaatagagggagtatcaagtagtagcaacctacttggactgacagctaagaggtcaattatgatgctgatttcttgaaatttatctgcacccagagatgtgaatcgatgtagtactatctgccattcctgaaaccaaagcaactaacaataaacaaaagaactgaagaaaaaaaaaggaccaggcgtagagaaatgtgaccagaacgaacggaatcaggggaggcattaaccaaggaaatgttaaagcgtgatcttctcttagagaaaaaaaatccctgtttcatcgccgagggatctccactctccagagctt

SEQ ID NO: 43735 - DNA, 726 bp, Oryza sativa
ccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcggacgtgacgccacttcctaaggcctggtgacatggtggggccggtctaaaaatcgggacaagccggttcgtttttcctggagatatggtgatggcgctttggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagctgggcacagcgttggcaagggtataaagtcgccgaggaagagatttgcttccttcctctcgccattattccccttgtcttcgccgcttgcgccctaactccttgtttcctgtgccctaccttcgccacacgtgctcgctcttaaacatctcttcctccggcgtca

SEQ ID NO: 43736 - DNA, 1501 bp, Oryza sativa
cctcgcactattttgtgtgtgggggcctgtggggaggggttgatgatatcgaatgtcctgacgtgtcccccctccctccctgtccatatcgtggctacccttcatatcccaaaataaatcaatttaaataaaaataagatattatacggtataatgaatttatacatactcttatctagatttatggtaatatgttacgttatatcccaagtaagattagcttagaacgaaagaagtagatctttttttcccgtgtttgtgttagacactcttcatcataaaataaaccaacatgatgtgatattgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccttagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaaaggggattgattttcggatccagaaggatcagagagggagagagtaagagctctctggttctccagctcttttgtagcttcttcatacatagatccacaaaaacacaggagtagggtattacgcttctcagcggcctgaacctgtatacatcgcccgtgtcttgtgtgcttccattctcgcgaaccttccacacacagactaggagcttagaatctcacccagggcccccggccgaaccggcaaaggggggcctgcgcggtctcccggtgaggagccccacgctccgtcatctggcgcgccaagtagggggctctgcgagtgatcttctgagctctcgcactctttcgtgtgcgccaagcttttcctgttcagcccaa

SEQ ID NO: 43737 - DNA, 312 bp, Oryza sativa
cctcataattcagttataaaatgcatggcactgagctttgcttgcagggccagggcttgtatccaaaagtgatctatgacatagacaccataaaaattaccatttactgtgtggtaacaacgatatgttgtagtatgtgtaaaaacttatgtagagacctgtgcagctactgataccaggctcctttgatatatgtatctatcgatagtttaaccaaccatgtaagcacttgaatagttgccagtttggtacagctacaacatactgtatttcattttgtatattatatggtatgtgttatttgcattcaac

SEQ ID NO: 43738 - DNA, 1425 bp, Oryza sativa
aaaataatattagcgtgtagacaaagcaagtgcttccatttttgctcatgacatatatattcaataatagatcaggcatatgctccatgcatacatgagctgcacacatataattttgtcatagaacgtgcaacatataatacatgctggtgacatgtaatgagaggttgctagttagatcatgtctgtttgtgtgtgtgtctattccactttttaggtaattgtgtttcttaattactgacggttgcgtgttttaacctgcagttcgattaccaattaaactagaggaatcaaagcattccaaggagatactcccaatacatgttcattgatctgtgatctaatcattctggttacataaaaagtcacaagcttcaaatcaattataatatataaatggaagatcctctccatgcatgagctatatatcaaattaattaaatgctgacagtaacgttacatgatgcattatatttgcatgaccaacaaggcttagcatcacacaattaatcaaaactaaagttcacattgtggggataaatcagatgaaaattcaaggcatatatttgatgcattctttgatccttaacaattaaattagtactatattccgaggaggcaagggtggccatgcccatggctccttgttttactctcaagttagttattgcgtctgcatgtggccccaatataatcgatcaacatatatatatgtttttatgacacggttgtatgttgggctcagtgttcatggggtcactgataggtaaggctctccgacaccatcaatcatatttccacatcgatttgatcatgcatctcatcttctttttccagtttccactaatatcaatgtaagaccaggaagaaatctattcccttcgtttcattttatcgagtcaaattttttcatgtttgactaagtttgtaaaattaaaatttagtatcatttactgaaaaaaaaatataatattatattaaaatgtattcaatgctagatttaataaaaacttatttggtgttgtagttgcttctatattttctctaaacttgatcaataaattgcacttaggacaaactcaaacatcttataatatgaaacatgggaagtgctagctagataattaaggttagtttcacttacatggtctatacttttttatttgttatcattccaaagttaattagtaattaaatttgtctggttttcagttttctttcagaaaagttttcataatttttctatcatcatctactgctttccttcacatattaatatatgtagctagattgcacgccatatataccatacatgaaacaaaactcagggtcctcaactagctctgatgattcttaagaactagctaagctagctagcttcttcattctaatatatatgtcttgttcttcttggtaattttcaga

SEQ ID NO: 43739 - DNA, 219 bp, Oryza sativa
aacgcagccgagggggcacgttggacgcgagcgtggcttgtggacaccgttcccacaaaaaatttccccttccacccctcgcccctctcactcatcgccctcacggccgccggtgacgggagagagaggccagcggcggcggcgagggagagagagagagagggagggagagagaggtgagagttggcggcgagagggagagggagacgaagccggcga

SEQ ID NO: 43740 - DNA, 383 bp, Oryza sativa
aaccctagtatcaaactcgatcatggcaacatctgaatagggctagccggaccagatgaaacatgaggggacgaccagatgtaattaaacgtgaggaggcgacctagccaacataggcacggaggagtgtctcgcgcaggtagggcgtgcgcgcgcgtcctcacgtgaaggttcgagcgattaacttgggatccggctcaccgtttctcttaggtagtgtttggtttggggacgaagtgggatgggtcagacctatcctagttttgtgggatgggatggttccagttgtctgtttggtttatggtatgggatggttatagttttttgtttggtagaagagattgaggtgggatgggatggatggatttgtactcaccgttagt

SEQ ID NO: 43741 - DNA, 1501 bp, Oryza sativa
cgcatcagatcgaacagagatgaccacactgtcgtctcgatctgcaccttaattaattaaattcacaccctgcaacgcagaatcaaatagcaactgatagattaattgcagttcgatcataaagtcccaacagatgcatgcatatgcaatagtgccatggagggcacatactgtcccagattacttcgacgttttacgtacccccctaacatttgtctctgagcacttgacgttttgtacgttttgacagtaaagtagcactagtattacttggaataaggcagttcccacccttcatttagaatagggtttaatgccattaataccatgccaaaatagaactttaagctaatgtggtactatattaattaagagagagtgaagccaagaagaaactgggtctcatgcaagacacagcttcaacatgagaacctatgcactagatactatcaagttttacattaggatagaataatgtcttcataatagatgaagaataaatatgattggtagagaagagagatgatgtatttattaatggcccactttaagaaatcatgggctgtcgagtgtagtttctattatgatgtcttattgacatggcactatatagacactacttatggacactatgggttgggactgttctatgtgacactacttaattctatgcttaaaatatttcttgtgtggctagtgctgtttgtgttaattctcttgttgaaatgaccacatgcaactggtactagtaataatttgaggataacttagtaattttcatcttcagctaatagctcaccaatcctaaaacgacaattatattgaaatatgggagtagaaatttatactactctctccatttttaaatgtacgtatatctatatttaaattgtatatagtgcatgcgctgattttcaatgcacggaaatccgaacaattttaacaaataatgtgtttgggaggagaataattccgatgcatgaaaatccgaacatttttaatatttcctctaatgtattaacgtgcaattcttttacgtgttcgtgaaaaataaaacatttttaacaaatcatgtgtttgggaggagaattcatggccagcgctttgctcgagatttaccagtacgtgccagatccgcctagtgctgccgctccatcactccgctcaagtctctcaagggaaaagccctaattttgctatgtttggggattaagagttgagaccttaatctttgctacagaagatgactttttttttttttgcatcttctagttcaaacattatagatgctctgagaccggccaccccggctgccatggataggaagaattaatgggggaggggagagagaggagactgatcatcgtttgtttcttgtatattaattactaattgatcatcgtttgcttcatccttattgggaaaaaggaaagagcagaacgagtggataaaaaatcctcaaccaattttaagtgatcgagaaagattcgatcgaatttga

SEQ ID NO: 43742 - DNA, 1380 bp, Oryza sativa
atatacccttttttaaaaattgtcttcataaaactgcccacgcatctgcgcgggctttctttctagttaattaaataagtatattaattacaaattaattgagcttgtaattgattagtttttagttagctggccaaaatacagtgatatatataaatgggttaggtcatgtgcttagtctcgggtgtgtggcatatatttatgcaaacgacgtctttttgatcaaaactactaacgaccctatcgtttggctgattataagcataagcgaaataatatatttacaaattacaaataacttgtgattaaaatttttatatacgtgtaattaacgatattaaagcaaaggctgaaaaataaaatacgacgaaaaaaaatctcaaaataaacgtaactccaaattaaatttaaagttaaaaatttaaattttggctgataagcataatctaagcgaaaagatgggggccgtaagaccatagaagaggacctgcgagctagagcacaagaaatattaaacaaacaagagacaacacttcctctcttttctcttttctgatcatctcttttcaactttttcgatccaattccatcattcaaacagaaaggaatggctcacaaaggacgccttttatgaccgagatcgaaggaaaaagtgcttttaatttctatctgacgcttatatgttaaaaagaacaaataatgtcaccattatagtcagtgaggtgtgacttagaacatatataaaaggccagcatgttttcctcgagggcacatacatacgacagcgccagttaagtgcactaacgattaattatgcgctctaaattaaattaattaatcttgagaatatttttattttgcccttcttttatgaggcgatccatatatatatatcacagatctatagatggatgtgaatcgatgttcattgtgtctttcttttttgtgataatttttagtttattacctatagtgtcatcagggatatttcattatactagttattgccctgaaactcttgtgcaacagttgcaggttaactatgggccagtagccagcatttgaatttcttttttggaatgcgcaaaaggtttgcgaatccgtatattatatctgagttacacaacgcaaaaggctatacatgctcttgtcgggtacatggtagagatcttaggaagagtaagcggaaaaaaaaaagaaaaaaaaagctaaatagtccgtccacaaagaaatggttgatgttatcacctttttggctttttcacggtcttctgggtatgatttcgcccacaattttatattcaaataagtttataaaatctaataagtttatgagattaaaagggcattttccaagaaaaatatatacacatcaatttt

SEQ ID NO: 43743 - DNA, 1501 bp, Oryza sativa
tcaaacactatttatattgaactttgaccatttgtctttttctataaattttcttttataatacttagaaaattcagtattaccaaaatgttaatcctaaatataagtattaaactttcattcatgtatctttgtttaacaagctaactagaaactgtaggtttggtaatctactaaatttaaatcataatgtgctaagaatatagatcacccttatgcaggatttggggatcaccgaccgtctcttctagaaccggattggaagtagaatacaaagtccatcgaactgctccggtgatcatcggtgtagggaaagtagtcatggtagtggtgcggacgaagtggttgccgacttgatcccgaaggggtcactggcgatgaactgcaggatagcgtcgtgccatcgtccttcgaggcgccacctacactaacttagtcctttgaataccctccaacgcttaggtcaattttcccatccgaaactaaacaatgccaatcaaatcatcagtgacaagtattttgaaacggagaaagtattttatatgtctgtaaatatttttacaacattgacataaggtagcagagagtgaggaaaggagtcataaacagtgagaccatggacttattggaagtgccatacatgtgtggtggtacgtatgactacgaaagaaaaggaaagaaacaaaggaccggccagcctcatggtgaagcccaatctgagagtaacaatttttatttcaagtggattagagcagtttgtgtagatgggcttgcctagatttgcaggcaggcagccatacatatatgagtaaatttcactaaactacatatactctggtcaaattatcacaaaactacagatttaaggagatgtatcacaaaactacagatttagcactaaatttctcaaagaactacagatttaagatggagtatcacaaaactacagatttagtaacaaaattatcacaaaactacaggtttagtgtcaattcaatcacaaaacttatgcatttataactcaaatataacactagtgctaaggatttaaattccaatatatgtagttttgtgataactttgttattaaatctgtagttttgcgatactccaccttaaatctgtagttctctgagaaatttagtgttaaatctgtagttttgtgatacatctccttaaatctgtagttttgtgagaatttgactaaagtatttgtagttttgtgaaatttactctacatatattgattgggtcatagattttcagcccaaataatgaatgcttatcttggcaatttcattagtagtttggccagacaggttgggcttaagtttcagaaaacagaaagctgcttgggcttgcagcatctgggaatttttttagtgcagataaaggaaaaggtacaccgaaggtccctcaacttgtcatccagataaaaaaacgtcctcgaaccacaaaaccagatatgcggggtcccttaactatacaaaaccggtcaccc

SEQ ID NO: 43744 - DNA, 523 bp, Oryza sativa
tcctgcagcccaatttgaagcagtttattttgatcaaaattaaaacgacttataatttaaaacaaagatagtactatagatttgattttttggaggagactctcggtaagttacggacagatataaattctctcgcctgcaacaatcgctctctaagggaccatttaaggagccacattaatgctagtagtaatagatgattcgacccaatattttgaccacaaagcaacaggccaaacataagaatgataacttgacaagcttgagttttttcaagtgaaaacacttactcctctatttaaaataagttaacttttagctataaatttgtagctataaagttagttttaattgggacggaggatgtacgcgagatgttgatgatgtgtattgttatgtccaaacgccttcagttcttttctgtagagcattgagagtgcaatgaaggccaaacagattaccacaagattgatgagtgatgacccatttattggtgctcatctgcccgaatttatttgctagt

SEQ ID NO: 43745 - DNA, 1220 bp, Oryza sativa
atctcttttggcttacacgaatatggagtagacagaaagggaaacaaccgagcaattccttcactaatcaacccagcatggtttgtgtgggcttgtccttgctctgaccaaaatcagcatcttccgaccagcccagctgtgttcacacctaatcaaccctttaatacaaatatataatgccactctcacaaaacagcaagcgaaatcacccaagtaattaagcaggagttcatcatcattatataatgtttttcaaggcaaaaacataggacagcagagcagagcagagcagctaagtaaaacaaacagcgcacgttcgttaaaagtttcttggtaaacaagctcagaaagaaaaatgcagggactcgactctgcgcattgaccccaaactcgatcgaatctgccagctcactcatgagcttaagagcgttcacacgcagtcgaacacgaacattcccacatttccgcgccaggtgcactccatcatccatgagctgcatgcatgcaattatgcaaattaagcgtggtactcctagattgtttagtagtagaacatcatttgccttgatcagctagccaacacataaaaaacaccatctttaagcccggtcagtgacaggtaggcagggtagtcactttttgccgtgcgaagcaagcactagagttaattaacccctggattaggataacgacaatgaacttttctttccaagatcatccagatggcttcctgatagaaatcgcagatgacactgtgcccaaacgtgatcgatccgtgcacgcacatgcaccacagattccgttcgtcacgcgcccgttcacaccgatggtgtcgagtggagtgacccagcaaccactcaaaaagtcgagtaccatccgaggaattttaactcgttttctaaactctttaaattttgatttaaaaaagacttttaaaattattttgaaatatttattcctttttatcacgttattcgtttgacgtggcaaaacaatactgtcggtctggccaacaaattcgaatttgaatataatttgggatgatatatttttaaattaaaaataaaagttgttaaaaaaaattgccgagtagataaagctcgggcttgggccccacctgacagcgaccggtccaaccgctaacctacaaatacccgcctcgcttcggacaaacacctcactcacctcacaggctcacacacaggcacacacacacttcc

SEQ ID NO: 43746 - DNA, 1501 bp, Oryza sativa
taaacttgtacaaagaagggtcgcattctatttggcttgcttgcttcgctgcgggcgcttgggctatttggctcatgagaaatgattgggtgttcaatgacaagatgatttcggatgcctctcacttgcctcataaagctatcttatttcttttacagcggagaaaaaaatggcgtcagcaaaggagaagagttctttgaatgctacaagggactcactgcttgccagtacccgaaggactgtaggagcaaacacctgaagctgaagaactgaagatctctatgcctatcagtttgttcgtagctttatcttcttcttgtctagtttcctggcttgttcctaagatgtgccagcagctaaagtgcctaacttatgtgtgctggtttcattccagccttgtttttgttcttccgttttcatgtatgaactatttcgctttttaatgaaaaccgggcgtttaacgcctttcctccaaaaacaattctaatcagcaattttcttatctttcgtttttatctttgctgttgagggggagcggcagcgggcagcggcgtgcgtgaccggaggccggcggcggctggcgagcagcagctccgggcgcgggcggagcagagggaggggagcgggcgagtgcggccgcggagaggcggtggcgggatttttctcttttcacccgctgcgtcattcgcttgtcgccgcggcgctggcttgctaccgctccccctctgcggtgaagataaaaatgaaagagaagagaaaaaggaaaagacaagaagattactgggtaggattgttgaccgcgtaattttttcttctcagttacatgtgtgccccgcattttaattttattttttcttactaggatgccaggtcagcaaaaccaagcatctatactgtatcgggacttttttttggatggttttatatagttatgggatacacatttctagtattgtggttagggatctcagacagactcggcgtataattgaggaatgtcagatgaacttattccgctcagaaatggccgtggcgtgctgctctgctttccgtcccaccccagtcagttcgtcctgtcccctttggtcgacgaacgattccagttaagcccagtaagggtctgtttagtcggccaaatggaaattttttaatattatatcgaacgtttgaccagatattgaaaggagtttttagacataaataaaataactaattttgtaactcgcttgcaaaccgcgagacgaatcttttgagcataattaaactgttattaacacatttgggttactgtagtacttattgctaatcatgaactaattaggctcaaaagatttgtctcgtgatttacctgcaaactgtgcaattgattttttttaatttatatttaatactctatacatatgttaaagatttgatgtgatgttttttaaaaaagtttacggggaactaaacagggaataagtaaagctttggaccggcagttgtactgtactctgtatta

SEQ ID NO: 43747 - DNA, 1501 bp, Oryza sativa
cgaccaaaggggacaggacgaactgactggggtgggacggaaagcagagcagcacgccacggccatttctgagcggaataagttcatctgacattcctcaattatacgccgagtctgtctgagatccctaaccacaatactagaaatgtgtatcccataactatataaaaccatccaaaaaaaagtcccgatacagtatagatgcttggttttgctgacctggcatcctagtaagaaaaaataaaattaaaatgcggggcacacatgtaactgagaagaaaaaattacgcggtcaacaatcctacccagtaatcttcttgtcttttcctttttctcttctctttcatttttatcttcaccgcagagggggagcggtagcaagccagcgccgcggcgacaagcgaatgacgcagcgggtgaaaagagaaaaatcccgccaccgcctctccgcggccgcactcgcccgctcccctccctctgctccgcccgcgcccggagctgctgctcgccagccgccgccggcctccggtcacgcacgccgctgcccgctgccgctccccctcaacagcaaagataaaaacgaaagataagaaaattgctgattagaattgtttttggaggaaaggcgttaaacgcccggttttcattaaaaagcgaaatagttcatacatgaaaacggaagaacaaaaacaaggctggaatgaaaccagcacacataagttaggcactttagctgctggcacatcttaggaacaagccaggaaactagacaagaagaagataaagctacgaacaaactgataggcatagagatcttcagttcttcagcttcaggtgtttgctcctacagtccttcgggtactggcaagcagtgagtcccttgtagcattcaaagaactcttctcctttgctgacgccatttttttctccgctgtaaaagaaataagatagctttatgaggcaagtgagaggcatccgaaatcatcttgtcattgaacacccaatcatttctcatgagccaaatagcccaagcgcccgcagcgaagcaagcaagccaaatagaatgcgacccttctttgtacaagtttagtttatgtaccagttcgcctctagaattgagaatactatcccaacctagagcatctctataacagcaccacataaacctaggaatggcacatctaaacatcatgtggtccacgtcctcgacttccccacaaaatttacaatttggactaccttcccatttcattttcttcagctggctggcagcttgaattcttcccttcaacattaaccagaagaagattttgacttttaagggaatggaggacctccacaggtcctgcaaaaccctatctttaacccctccaaaacatagggcctggtaaagggatttggtagtataagagcctgtcgatgtttgatgtcgcgattccggtatttgcatagtatggggatcgttggtactatgatatacgtgaggctgaggtaaaagaga

SEQ ID NO: 43748 - DNA, 1501 bp, Oryza sativa
tgctagcctgcattgggcatgaattaagtacaattagattttataatcgtttatctgaaacctataatgtctatccacttgtcataattatcacatattctataaagttgtaaaagaccctagaaaatatgtgtttaaagatcagataaattatttgaaagctttttgcatttctagcatggaatttgtttggttactatacaattcacttgcaccttctaccgaatatgccatatgatgacaaaaagtaaggcctagctggacttaataggactcctcttatccttttttgatgcattattcttatctcattaagactggtctatcactctctccatggttggctttctctctaattatagtccgcgcaagaaaatttttgggttccaaagtctaaacaaatacagtgtaaaattcgtctatgtctagtagacgacaattgtttggtgataatggttttcttgcacctccaagtcatcatgttacatggttgtaaaacttgtatagatgttgagacatggaggttgccatatgatccattgcagtggtgtttacagtttcgatcaagtttagttaatctttcttttcatgtctcggtgtatcgtaacatataaatggattccaaacttaattcttcaagttaatatatgaacagcgacatgtttatagcaagttaatgtccatatatagggatgacaagatatttttaatggtttgtgcacagagaaaacatacatttgttttcttacccggaaggtatggaatagaagcacatagccaccggccgtatatctatgtaccatatactaaaagaccgttaaataccttctaataaagtcatttaaatggtaccatagaatatattatagagcacttacgtggaagatcgtttggcactcttagattatttattatttgagcacattttagaaaattcacgaagtaattggattgtttcctctaactgttagcgcttcatttttcaatcaatcacaaataaagagatagaattataattgttgtggtagctagagccaaaagctgacctaacccaaatatatcattctggatatgtattggcagtgaaaacataaattaaaccaaatatgttattctggatatgtattggtagtgaaaacatatattaaacaacgattgtgccaatataaagcccaaggactattgaatgtatgtacatacgtacaccatcgccaaaccatccaccccctccgccctcattcacgccctccccctcctattgtctctcatgttttcatcatcttttagttaggagcaataattttattataatcgtttaaaataaatagctattttttatcgccttatgtcgttggacccacattaacaatatttcaacttctaaaataaatatgttattttaggtttatattcttgtcgacatttgatgtcgcaattctggtatttgcatagtatgaggatcgtcggtgctaggatatacgtgagactgaggtaaaagaga

SEQ ID NO: 43749 - DNA, 1501 bp, Oryza sativa
tgtaagactgtgttggtgaactcaatacaaaccacatatgtactggaaactaccgttaaatccaaaaatgaacatctaagatttgttcacgtcacccagagtaaaattttacttctggtaaaagttttactaatggttgaacctgagagtttttttttttttactctgcatgacatggatccaacaatatgtgatttgcattccagattttcattccatatgtaatttgcactgtatattttccccccttaactaggccactagagtataatgggccgggatactgcacgaaggacttgctattgatgggctaacgtaatcgatagctctcttgtttcctccgacaaactagccaaatatttcatgccaatacagtaggggattgtctatatatttatcgataaattttcttctaaaagtttgtcagatgtaaatatagtataattacattgtatcttacatataattataatgtaattggtatgtaactttcgtgtaatttttaaactgttagatttactttcatgtaatttcatgcaaaaggggaagaaaaaagtcacaactcacacaaaagtgaggggatttggtctcgtgacctccgcttcatgaaaatagcatcttatcgtaagatttttcaaagttacatataagttgtattatagttacatgcaagttacgatgtaattacactacgattacactatatttatatctgtcaaatttatttttgagaaaaaatttgtcgacaaatgtatagcaaaactggcacagtagaaggattaattttcacacttgagtatactaaatcgctgatcactatgtcttaaagaattttggtgaaattcacgcgagcgtcaaccctgttcaacgtggtgcagtgcaggaagatgtacatatataggctgagatgtaacggaataggttgatgctagagttaatttgacaggaacagtagaagagactagaatttgttttgtttctattctatgcgacagagtttgcaagcataaaagagacgtgcctagtggaaactatgtatgcggccatgccatgcccaacaaaacaaagttctcgtgaataacatggagagagcaacactcgtaccatagcagaagtattctcatgcaaatgcaatgcatcgatctgcatacaactaattagctagcctagctatatatatcttctctgctcgatcttttatctaatcagttgagatctcacgaaatctacgatccaaggcaggccgcccaattgtagtttggctgaaatagtgtagtgttgttagttactggcttacccgttgggatagtgagtgagatttttggagggaaacgaaatggttaagcagaccggtggcagtgttgatgtgggtgtcatggtgctcggcagtgtaagagcaacccaataactctctgtttggctcttcaaattaaaatttaactaacacagagaaaaagggagttccaacagcctctccatccgaatgaccgagccatccgga

SEQ ID NO: 43750 - DNA, 1501 bp, Oryza sativa
gcgtagagcttcatcttctataaacatactgtattaccttaaaaataacatataggaaacattcgaagctatattctctctcgcagaaaaagaaaagaataacttgagaactaactagccgccggcagttagtccgaattacttgtcatatacgcgcgtttacctttcaagactttcatgttgcctcttactccctccgtcccaaaaaaaagacaaacactggtttccgtgcccaacgtttgaccgtccgtcttatttaaaaaaattatgaaaaaaattaaaaagacaagtcacacataaaatattaatcatgttttatcatctaacaacaataaaaatacgaattataaaaaaatttcatataagacggacagtcaaagttggacacagaaactcatggtttgtcttttgttgggacggagggagtacaaagtactatccatgttcctaaaataacttcatttttatgccatcttatttatctctaaataactttatctttaaagatttttttttacaacagtcaactttcattacccagcttggtaaccaagcccaaacgaacgcaacaaagtcttttacgggaaaaagaacaaacataaaataaaacacagtctactaaggcgaaaaaaaacaattattatattaggatcagataattaaagtggagatcgactatattaggatttgataaactggaggatatatattcttgtattttttttattatatgtatacatgggatgagtgaaaaataaagttatttttaaatggatcgatgtagcagtatactatttgaacttttgtcatctatcgattgttcaaagatgaagctatcaccgtatatccaccagcttgcaggtttctcttccaattcggacggagacttaattgctacttcctccgttttatattataagactttttagcattgtttatatttatatagatgttaatgaatctaaacagtattagcatatatatataaatatgggcagcgctagaatatcttatataatatgaaatgtagggagtaattgttttctaaacattattaccaaattgttatatatatggacaaacggcttaatttggccagtcacatacagctaatctcttatcccggccagaagtcaattgcaatgctgccttacaattagaagaaaacggccaacctactttatgtatgcatgctaagctaaaatatccaaattaaagggatatgcatgattacttgcacaatatatatcttctcgtcaactaattaggtctacgaatcagatcacgaccagctgagattaacataaaacgggatccatttttctctctctcaccggccgatacacgatcgcgggagagtcgttgatcatatcgattggtggattattctgcatgtatgttgtattttcaatatctctgacaaggcacttagccggtcggtcatcgagctaatataattaaattaagtctgaaccaattaaactagctagcgaagcaaccg

SEQ ID NO: 43751 - DNA, 1501 bp, Oryza sativa
gtctagtgttatgggttgggactgccctaaaataacagtctctctcctttgtccctcggttcacgtgccttccctagatctaaacagtagggaactaaactttttaatcgtggactaattttagtctagggactaaatgatccaaacagatccttaataatataccatcagtggagatcaaaatgcaattgggccttatttagtttttaatttttttcttcaaacttctaacttttctgtcacatcaaactttcctacacatataaacttctaacttttccgacacatcgttccaatttcttcaaatttttaattggaactaaacacaggcttgatatgaatattcatgcaactggaggcatcattgcagtgtggccttggttgaacacacgcatgagatgagaatggagaaaggaaggccatcggaatagatggagaaatggatggctggcttgaagattttaaagaaagaaaaaggaaaaagagagaaagacaggcagaggagtaccagtagcagtagctgaaggtgagcagagacggtcgtccatgtcgctgcatgcttttgctttggctttgcaaaaagccgaccagtcgccgaattccccagcctacgttctgctctgcaccggcctagtagctaacataccggacgctttggctttccagtttcgggtgtgttcagttcacaccgaaattggaagtatggttgaaattgaaattgaaataatatgacggaaaagttaaaaatttatatgtgtaaaaagttttaatgtgataaaaaaattagaagtttgaaaaaaaaaatagaactaaacacggtgttcattgctgagaattcagatgatactgtttgtgtgtgtgtgtgcatcaaattattttctcctgtgaatctcaaaggaacaggattgtcacaaggcagctgttttttttttgttcatcttcagatgaacaaatacgataattttggttttagaaatatacctggctatgtttagatctaaagtttggattcaaacttcagtcattttccatcacatcaacctgtcatacacataacttttcaatcccatatctttaatttctacccaaatataaactttgcgctgagctaaaaacagccccaaccacaaattgttgtgtgcttgtcacattgatagcttctgcaaactctgttgaattccagttagcaagtgctactggtatatttcattcattctttttggtatacaaatcccaaagccatgagacattgtcagtcaaaaaggaaaaaagaaatgctcacttggaaattggaatttcgatttcttttcctctcaactcctgcaaattgtccccccaacttcccggtttctcgcagcaaattgatatactactccagcaccggccaaattaactaacttaacggccactgcttttcacactatattaatgtgcagttggtcactctcgagccacactctcacttcgccggtgaggcaggcagcaatggagccaaagagca

SEQ ID NO: 43752 - DNA, 493 bp, Oryza sativa
gtggtgaaggggtatgtcttggtatagaattggtaataaacaagtgaaggataaaaaaatgttctaccagcagggtcaacatgaatgaaaaactcttattgatcttaaccaccaactagtaaacatcatgactagattttaaacaaaacagtcaacaaaagttccagaatcaggcaccaaacatagcttgcctgattactaggaagcagtagtccctctatttaaacattgaataccatcaacattgtttcgaaatgcaatgggagatcacataagcgtgaggaatttgatgaatttacaagtaattcgaccatccagcagcaattcatagtctgaatgaaaatctctactgacagagctgcgaaaaggataaatagtttgctccccaaaagtcacaactactcacagtttatctgagacgacgccggaaagcccaccgaggaagagcacggctgctgcggcggcggcaaggcgcgcggccatctgctccctt

SEQ ID NO: 43753 - DNA, 711 bp, Oryza sativa
aaatatagattttttaaaaaaactaattgcacgattagggaggaaatcgcgagacgaatattttgagtctaattagtccataattagccataagtgctacagtaacccacatgtactaatgacggattaattaggctcaaaaaattcgtctcgcggtttctaggtgagttatgaaattagttttttttattcgtgtccgaaaaccctttccgatatccggtcaaacgttcgatgtgacactcaaaaaatattttttcgtgaactaaacaggccctaagttggcgaaattggcccatacgacgaatacagtaacgcatgtttttttatgaagttcaattcggcgatacgtctacgcccaagagttggatcaataccgaaagtcgttgctcaatttcttacgtgcttacaataaatctagctaaacaaatactcaattataatgcggccggggagaagttatgatgctgaattataaagctgatcatgccacatcgtagcagggtcgatttgtctaccctagttggtaggaaaaaagtgtatcttagttgacagcaatgcaaattttatagtcgagataatatcatgcccatgccttagctactcgctggcaataaagaccttagctactcgctagctagcaatcgttttcgcgctcgaataatgcgtttgaacatcgcaattaagatccagttaatctcatttagttactga

SEQ ID NO: 43754 - DNA, 1501 bp, Oryza sativa
taatggagggaaaataccaaagtattgtagacagattcagcagaaatagctgaagaatatacgtgcttttattcctttgagaaattagctatagcacctgttggttcttcagagttgttggtactgaattctcagtcagtcacagtgtgaagaacgcagtccgctaagttcttcctcatgggttgccaactcacctccctcattttctgcgtgtatgtttttcaaaccactaaacggtacatattttgtaaaaaatttatattagaaagttacttaaaaaatcatattaatccattttttaattttttttatagctaatacttaattaatcacgtgttaatctatcgtcccgttttccgtgcggaggggaggggttcccaacctctccaaaagaacacacacttgtgattcagatcagagttcacacaaaatactacacaatacgggcagttttgctcatgatcgactcggactattggtcaatcaaacagcagcaaattcagaaccatttgcaccaatcaggactatttttacccaattacaactagcatttcaaacgaaatgcatttgtattgagaccaggacctaaccggggaaaaaatcgcaaattatagcaaagcaactccaagggaaacaagaggcgtctcggcctcacctcagacggcgattcaacaagaggtcgaacagcctcgcgccaccgtcgcctcaccccgtcgccgccaccgccgccggcgacgacgatcgccgggctccacctcggtgaacggcccaccatcgcacactattcatgatcgtgggccgtcggatgacgaaaacgggccagtctttttttgtagactttaagggttcgatgacgaaatctctgaacccacttctctgatcgtttaaccgctgaatcactgtaaaaatatttagtcgcgcgtaaccattaaggatttctaattcttatatgccaaataatctcaaactcaatgcaatacctgaaaacggtcaggatttgaactccagcagcagcatgcagcatgctctctctccgtctgaattttgggacaatttggcactgaggccgtcgacatgaggactgaaaaaagcataaacatcgagcaacatgtatctggaacaaaagtgcattgatcttgtatcgagtggatctttgcttcggttactgtacatgaccttttagctcctgaattgtaccaatgcttagtcagtaatcaaacaagcttcattcagcccatcaaaacaaaacaggttttgaagccatcaaagaacattatcatgcagcctgtcaaaacaagactgttttgaagcaaatttaggtaggaaaaaattaaaacatttaaaatcaggaaaaaaaataaagcattcaaatttgatttggatggggtgcaccagccaaggctgtagtgcaacgcctaggcgacacatgagggccctagtggcaagccactatggtggactctcccccacgaaaaataaatttaatatcaaagtagacaca

SEQ ID NO: 43755 - DNA, 1501 bp, Oryza sativa
aaaaaactcccatatactcccacacattagttattattaataaatttgaaaaaaataaatatattcttcgaattagtaaaggtgtctcatgtgattatcaacaataagtattgaaaataaaccaagcgctaaactatagatgtttgtcaaaatataaatgtttaacaccataaacacacatggtgtctactctataccaggaatctactcaaaacttaaaaaaaaaattcttttgatcacctccatcttctcttttagtaccgtcgaattacaacttcgctcattttcaaattgcataatgtttaacaccataaacacgtggtgtctactctataccatgaatctactctcaaaacataaaaaaacattcttttgatcacctccatcttctcttttttcttttatgaagggcataagcatgaataacatagtttgctacgttgctataagtataacagggacgtacatatgggagttaaggcggtcccagtggagaccacagtcaccaatagtgctcaacttactacttaccgatgcacaactcgataagggtgtgatagtaaattaggcattaaaattgtgttccaggttagtctggaggtgcacaactacatcgatatgggacccatgtttcaaggaaatagacaaagaaagtctcgccactacaatcggcttcacgcattagagaagcatttatatataacttgatgttattctattaatttgtacaagtggtatttttacaatatttatatatagttttgaaaattggtgaggcacgaaacacttacgtgtagtggatatttcaatgtattaatgatgtattaggcttattttattgatacattacgtagttcatctatgaataggtacttggcttttaaacagtgataataggttgaagtgacaacaagaaaatttatatgtaaccagaggcaaagtgattttatttaatctaggagataaccttattacttaaatatattaaagtatgcaatatatttctcggcttataaatggtgagatataacctttttaaaaaattgtcttcataaaactgctcgcgcatctgcgcgggctttcttcctagttcaaacaaaaagacaatatattcaaacaaaaagagatatgtcattgttttagttagatactgtactttgttctgaattgtcagtctgaatatattcaaacaaaaagagatatgtcagtatgtattttgaagaacagatttgtgctcctgacaataccagtggatgtgccaatgctattcagcaaaatcaaatagaccaccaaaagagactaaaaaagtttaaaggcaaatttcatcccctaaaacaaagagcttgaataaattggatttaataagttcaattggatttggttggggtgcgcctgccagggctatagtgcaacgtctaggcaacacacgagggccctagtggcaagccactatggtggaccctcccccacaaaaaataaatttaatatcaaagtgggcaca

SEQ ID NO: 43756 - DNA, 528 bp, Oryza sativa
ggggtattgatgaacagatattcaacttgtggctttgccatggctctcttcctcctccaactctacctcctatgattctatttctctaattccaatctcatgcttctgccttccctatattactcttcccaatccctgattctactctcttgattgtattcctgagcacttgtattcttgagtggatttgcaacatatcggtggcacttgtgtgagaaatttggtgtgattgtgttggttcgtgatagcgacctagaagtgcacttgctgagttttcatatatgagcaatcagaagttagatctattttttcctctcgctctctcttttttttttcaagtgaaacacgacgatacgatgtaaattgaacaaccttagcacatatggcttacaatgtttactccaaacacaaatataaccagagtgccccggtcgtgttaaacttcaacacattcttcaaagaaaaacagaacaaggcttgcattgaaatttcccctgaactcacgagtggtcgctactggtacatggc

SEQ ID NO: 43757 - DNA, 1353 bp, Oryza sativa
attatattgtaggagcacgatcgaggctcatggcgtaagcccagtagagaacagtgcgatcactgccattggcatgccataataagatgatccaacaccacatgcacgaaagacacagcaatgctaatgattcggcacaagccggtgatgccagccggcgactggaaggacgccatgcatgtcagcttggctataaccgtgctatactaccgtattacctcgccaaattagcccaaagcacacgccaaattcctcggagggcatggttaagatcagcaatgaattagttgttatgatataataggattaatttccatttatctttgtggagctgaatataatggtcggcaaaaatccgctttgttttggcatgccgcatgcattaagatcgactcgctctcatgactgagattccctgtaggttgcaatcccttttcttttcttgaaaggaagcattccattggttgcctcactgtcaaatttcaatgcatatatactagcccatacataatataataaaaaaaatagtattgatgttctctgtcagtgaaatcctgaagattgctaatctggttgccgatgaactgcgagccctgtaactgagctccaagcccaatttcagtgacatgcgtatggactggtgtcaggcgactttcagaaaaaaaaatatacttagactgtttatctatatattataacttataatctaaatatagttaacacactataacactgctaaacatgttacgataccaacgaactaattttctggatccaccaccgactatggacatcaacggcggcagccggctggcaagagagctcggggaggaggagagaaggccaggagggacagaagagagaagggggaggaggtgttgaagcgtcgttgttcgctggagatggagaggagtgtgggacctattgataggtgggttccactatttctttatctttatttggtgacatgtgagccctacattttaatttttcttctaatgccacgtcaccgccacataggacgaggatcaagtcaagccaaccacgtaagcgtcatgttagccgaaaccgtcatctaaaccaccttgaaactttatttgcatttgttttaaaaagttgagagacgcgtaatttcagaccggctacgaactaaggaatctaaagtagtttttttttttttgacgctgaagaatctaaagtagtgaacttattccttcagtacatcacggactttgtaaggtacaatctttgtaaggccgagaattttggcccattagttaaatgaactgtaccggaccactcttgatgggtttcatctcaaacgcccaacccatcacggacaaaacatattta

SEQ ID NO: 43758 - DNA, 427 bp, Oryza sativa
tacaagacatttgtcctatagccttctcctggcacctgtttgaacagtaaatgggtattgtacatgaagggcagactacgacatctgctggagcttcactaaagcaatagtggcagtgagtatcccggcaagatttcatgataatctgcatacaactgtacaagtaagaggcatatagaacttcagttcaagattacaatagttgactgattatttaacaatgctcatagagataagctactgccctggcataataaaacagtaaaaatatactataacttatcaaatttcatatttgactaggacaaagatctaatgaaactcagtatagctttaggtggcacgtaaaaaactcatttggcataaacaattgaggagatgattcttgatcataccacagcaagaggatcctcagcatgaatcagtg

SEQ ID NO: 43759 - DNA, 283 bp, Oryza sativa
tctgcatacaactgtacaagtaagaggcatatagaacttcagttcaagattacaatagttgactgattatttaacaatgctcatagagataagctactgccctggcataataaaacagtaaaaatatactataacttatcaaatttcatatttgactaggacaaagatctaatgaaactcagtatagctttaggtggcacgtaaaaaactcatttggcataaacaattgaggagatgattcttgatcataccacagcaagaggatcctcagcatgaatcagtg

SEQ ID NO: 43760 - DNA, 1501 bp, Oryza sativa
agcttgcgatttctggatcttctcctctctctcgagtctcgcctcgctcacctcgcccttcttcttcttctccctcttgcgggggtttatattccacctgggatgggggattagcggatatgtttaggaagaaaattaattaattaaaagcgtgatttataagtcaattgtgtcaccctggacggttacacactgcgccgcgctagctgtgcaaaaccgcgagtggttttatatccttattgggttgggttgggctgcaagagggtggcatatggcaggtttacatggtgctatatatgtcatctctccggcgtgcagttgcttcatttggcatgtaattaattgggcgtacgtaattcgtgcagtttaatctggctgattttgttgaatagatatttaggaaagcaatctttccatacacgtttcaaactaatcgtggaacatgttcacaccatgcccaagatgaatcatttaggctgtatttttgaatggtcgagaaatctttttctaaatactgtaaaatagagcgatagattagtacattattaaataaatattagctaaaagaactttaaaaaagtaatatgatttttaaaacagtttttgtaaattttttttcctaaaaacgtccttgtgggtgggtggatgatgaaaaagtagagttaataaaggagaaaagaacacactggaaaccgtagtttggtcatatgcttagtttttaacaaaacgtgttcgacacttgattattaattaatcattaatataaaaaagtcatcacgagtccaaaatcacattatttgtacgtaaaattaatatttaatactttgaaattatataaattaacattaaaattttaaccaatccaattgtgaatcatttacatacggatgtataattgtatatcgtgattggctagctagctggtacgtactagctctatcacctcgcgtagagtagtaccactaggttaggttagatactatgtgcttatttttctagttttcatcaaacatagttgctttcacacaagggcttattgttccaggcaaatttgttttctatctttatatatatattacaaggccagaaaggccggagatgcgccacatcactctcagttttctttaagtgatgatttaaacaaaaaaaaagtaatttacaaatatttggcaacacatggaaatcaatgttcaatttcccatttttacccatacatggaaagctttatgttcaccaacactaatctagaatatctttcataacatgctatccacttaccacccacattccaaacaaattaatactccacccattacaaaaaaagtgtggttttagtataagaatttttacctaaaactttttagttttagagcaaattcttagactaaaatactattggcgtactatattagtgtacctctaaaatactactatatattttccgtctcatttttagtcattgtacaccaatagtaaaacctcatcttcctcgttttctttc

SEQ ID NO: 43761 - DNA, 736 bp, Oryza sativa
ccagatttgccaaactgtaccaccagtactagaaagagtctaggattttgaaaattccgatgcaaatacgtacgtacgagtatacgaatctcacgtaactttctgctattagaccctgtttagatgagactaaaaccatatttagatgagattaaaacttttaagtccctatcatatcggatgtttggacactaattataaatattaaacgtagattattaataaaacccatccataatcttgaactaattcgcgagacgaatctattgagcctaattaatccatgattagcatatgtgatgctacagtaaacattctctaattatatattaattaggcttaaaaaaattatctcgcgaattagcttttatttatgtaattagttttgtaagtagtctatatttaatactctaaattagtgtctaaatatagggactaaagttaagtccctagatctaaacaccacctaaaacttttaagtctctatcttatcggatgtttggacactaattatatatattaaacgtagactattaataaaaactatccataatcttagactaattcgcgagacgattctattgagcctaattaacccatgattatcctatgtgatgctacattaaatattttctaattatggattaattaggcttaaaaaaaattatctcgcaaataagtttttatttatgtaattagttttgtaattagtctatatttaatactttaaattagt

SEQ ID NO: 43762 - DNA, 1501 bp, Oryza sativa
aggtttcttcaatctctatggcctgcctcgatcgaatgccctcttttaaaaaattttctcggtgaaggtacatatgggccggacagatcctaattagccagcaccaggcagatgcatcccgggatatgatgggattccacaaaataccagatataaatccagatggagaccataattctaattaactaaactgcatgcatgagatctggagctgtttaatttcatcattagctagagcaagccagtttagcatacatgattttcacattaatttatgcatactatagttatttcacacaaactcgatcactgtcgaaccgtcggtttcattaagtttgatccgccgtgcttaactgaaacatagaaaaacaataaattgaaatacgaatagaaacaaaacatgcccatgctcatcgaaatgaactgatcgatgactagctatagcttctcctttatttaattaattcggtaaaagtacagcaattctcatcatgcactgagctctactacatgtgatctgtacataattacacacgcacataatccatagaaagaaaagcagaaaaagatgagatcgatgaactccaagaactaaagaattaattattacatgcacgatcactatcaatatatattgtccgtgtaccgtaagttgctgctagctagctagctagctacttgtcgattaccaccatggacaatggcggcggcggcggcgggtggccggcggcgtgagatcctttgtgatcacttacagtagacggcggttgcaaggagagggcgaggtagacgatggccggagtgcaggcgaggacgaggccgacgggcaccatccacagccggctgttggacgggtggaacgccacggcccaccacgccagcagcgacgcccccgccatggccgccgccaccaggcacgcgtccacggcgacggcacccgctgccacctcgccgccgatggcgcccgccgccgccgccggcggcttctcgtcgtcgtccatgccgtatatactttggaatggtgacaggaagaaagaggaatgaattgaaggtggtcaatggcggcttattagctctgcttcctgtatggctgtatatagtctcgtactactggtgttggtgtgatgtggtggtttacgttattggaattggaagctgcacccaaccattcactgcctataacttactctttccttcctggtcttgcaccactcggtgtaggtgtgttctgggcatgacaacaacttaacatcgagagaccaaatagattgatcgatcgcccagttcgattatttattttattattgtataaaaataccttttttccttcacagaatttaaacttatttctactgtattgcttattattacacttatttgttcaaagctactgttagttaggagtaccgtttcttaaaataatttactgtataattagagaaaatccaagaaataccattaataaacactcaaaatacaagaaatatcatcgataagtgtg

SEQ ID NO: 43763 - DNA, 1501 bp, Oryza sativa
gagtaaacaccgagtttaatattcactattaaaataaacaactaaatcctactatttaaatcaggttacttcatgatcaccatggacccacttgttagtgagaccaatgataaaaaaaaaatcaaagtgacttaaaaccagaggatccacatcctcgacgttaaacttctgttgctgaactgcatgcttaccactgttttgctctcacacgcatcaaatgcacgcaaggcgcatgcatgcaaaagagcgttacgtgcgcgctcagcctttgtcgcgcgcgcgcggggatcggtcgtcagatcacatgatcagctagcaaaatctgccgccaattgcatgttggttgtggctaagctacctgttcttaattagacaagaacaaaatggagggacaaaaagggtgtcatgtgttcatctacagctagatcgagccaattatgcaaagcacgcccgatcgatgcatatggatcccagctagcttagctagtacgtgccgtgtgcgaccacactcctcattttctttgttggaattgctaagccatcaaattcgacggaaatatatgagcaaaatctggtaaattttcaaccttcggatctactttttgcgattcatcctccaagaagttttttctaagaaattgaacaggtttcgctaaaattcgaacaagttagtgccaaattcaatagaatatgaaattcaatagactatgggatttcttttgcctgtaaaaatatcctaccggaacccaaaatggtaaacgtggaaatttgtgaatctcgtaaatttagttacaaaattgtaaacccggttcgaaattgaagcgaaagttggagaaacaccagtgatgtggtggtgaagtcgtgagtgtatgactccacacccacccgaatttatattctagttcctaggaatcttacacatatgtagctgggcttctaatagaattttactaagatcagatatgtgccgcaggttttcatctcctagagtgtgtgttaggggagtgtattcgtgacggtgtaagtgtggtgttacgtgtacagtgatcaacagtgaaaacctagaaaaaacttatcgagggtccactacatactaattatgtagttgttggttggtatactaactaaactaatatagtataaaataaactaggattgaataatttacctggtgtcctgtgatccgggtagtagtgatatgtgtgcgtgtgcctttgttgtgtaatcgaaaaaactaaaagaaaaaaaattgaagcgaaagttagctagctaggagatcgatagatagtgcaaattatatatgtagtgaaaacttaaaaactatcgttaaattgaaaaatgatcgctttagactcgcgcattaatttttggatccaacggtattttcccacgttcgagagaggtacgttttcttaccgcgcggtagcgtacgtacagcgtgagagcgcgcggccgttcccctgagttgcgaggccctgactggtccacgtgaacgcattca

SEQ ID NO: 43764 - DNA, 1501 bp, Oryza sativa
ggctgccctctctgggtgatcactgttttctccttgcctttccctttgttactgttgcatataaaagatcatcaatgtttaaagaattggagctactgtagtcggttgatccggaaatctagaaattaccatgttacttcaaggacgaagaaaataaagacatgttcgacgatgggtttaaattacaatggtattagattagatcattttacccggaagatactccctttgtccttaaataatttagtcaaaaacatcttatgtatgaaagagtttaaaaaaactattatgtcctttatatatggaaagaaaacgaggaagatgaggttttactattggtgtacaatgactaaaaatgagacggaaaatatatagtagtattttagaggtacactaatatagtacgccaatagtattttagtctaagaatttgctctaaaactaaaaagttttaggtaaaaattcttatactaaaaccacactttttttgtaatgggtggagtattaatttgtttggaatgtgggtggtaagtggatagcatgttatgaaagatattctagattagtgttggtgaacataaagctttccatgtatgggtaaaaatgggaaattgaacattgatttccatgtgttgccaaatatttgtaaattactttttttttgtttaaatcatcacttaaagaaaactgagagtgatgtggcgcatctccggcctttctggccttgtaatatatatataaagatagaaaacaaatttgcctggaacaataagcccttgtgtgaaagcaactatgtttgatgaaaactagaaaaataagcacatagtatctaacctaacctagtggtactactctacgcgaggtgatagagctagtacgtaccagctagctagccaatcacgatatacaattatacatccgtatgtaaatgattcacaattggattggttaaaattttaatgttaatttatataatttcaaagtattaaatattaattttacgtacaaataatgtgattttggactcgtgatgacttttttatattaatgattaattaataatcaagtgtcgaacacgttttgttaaaaactaagcatatgaccaaactacggtttccagtgtgttcttttctcctttattaactctactttttcatcatccacccacccacaaggacgtttttaggaaaaaaaatttacaaaaactgttttaaaaatcatattacttttttaaagttcttttagctaatatttatttaataatgtactaatctatcgctctattttacagtatttagaaaaagatttctcgaccattcaaaaatacagcctaaatgattcatcttgggcatggtgtgaacatgttccacgattagtttgaaacgtgtatggaaagattgctttcctaaatatctattcaacaaaatcagccagattaaactgcacgaattacgtacgcccaattaattacatgccaaatgaagcaactgcacgccggaga

SEQ ID NO: 43765 - DNA, 365 bp, Oryza sativa
cataaacaccggttgacatagtcaaccacctcagtgaagctctgtcgtaaattaacctcattcaccatggatggatcaaggacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaaacctatagttatataggcaggcgacgataggaacggctggtggtcgtgatgtccaactatggatgactccctcattttccgcttggcatt

SEQ ID NO: 43766 - DNA, 1501 bp, Oryza sativa
cacttgttgatttatatacccttgttgtctatgaataggtgaattgcatgaattgttgtttatatacatgatttatatacccttgctgtctatgaataggtgaattgcatgaattgttgtttatatacatgatttatatacccttgctgctgctgccacataaattattgtgggctgttttattatctacacttgcctctgcttgataaattaatggtgggctgtgatgaatgctcaagaacagaaatacctctaaacttgatctttttttaatgcataagaacagattatctacacttgttctttttttctgcataagaacagattatctacacttgttgatttatatacccttgttgtctatgaataggtcaattgtatgaattgttgtttatatacatgatttatatacccttgctgctgctgccacaatgattgtgggctgtttattatctagacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctgcccaatgtgttccttgttaaatggccagtgatgaattgctcaataagaacagattatctacacttgttcatttttttgccccaccacttgttcacttgttccttattaaatggccagtgtagagtggttatatacctctacacttgttctttttttatgcataagaacagattttgtgcacttgctctctttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatcgccccctgctgttgctgcccctgtggcatatatacccctactgctgttatatggccctgctactgctcttattgctgctattatatggccatgctgttgctactgctctaatttcctggacttgctcttttctttatggataagaacagatgaactacacttgttctattttatggataagaacagatgaactacacttgttctattttctttgggttgctttttcctcctagtagctgatttcctctttttatcccttcatgcaaatgattgtaatttatgcatatttctcagcaaaactgaggccatatctttcatagtataccccgtattacattggatctaatgctatttagtctaatggtaggaaatttataatctttttcgcgaaagttaaacca

SEQ ID NO: 43767 - DNA, 1371 bp, Oryza sativa
cagtaacacttacacttttgtgcagtaacaaatatatggttagcatgtagacttttaactcatatatttttttttcgatttctagtttactacaatttcactacgatgttactatcaaaagtgcagtaacatcctatatgttttgcagtaacgtgacgtgttactatacttatacgataatgttactactaaaacatagtaacttgttatgagttttgtaataacatatatatttgtcttctaattagcttcttacaactatggaactttgtgtcctgtagagttgtaacagtttatgtgcttttacagtaatcgagtgtgttactactatttcttctcgaagattggtattttgaaatttatctctccataagtagtaatactaaatcattattgttactactttttattgtgtgttactaccattccatcatggcgttactgtatgtgtgcagtaacaactataacttttaaagtaacactgcatgttactgcaatttcttaatagcattactgcaataagaggtggtaacaaccaaacacaggtacaggacctatcacccactttgaactagtaaaatgtaaatgcaagtgatatcttttgaattcacatctttaaacaataatatctctcacaccacatattatatttttgaaccgtttgcaccgtaatgctttaaaaaaaaagctctacaaaactagatccgtcatgactatattttaactatattttattagtattactgcaagtaaggtacagtgttactgcatagtggtcgtcatgttactgcaccgttcgtacgagacaaggacaacaaataggtggatgtgggaggaagttagcacacgggtttgaccgacatggcagcgatttgaccgtcctttgaccatgctttgactggggtagcaggtgggttttgagcccaataaaaagagggggtagtgggttgggctcttgacggcgaccgggggtatagaatagtctccccatatatatatatatataatgattctatactcccaggagtaggtactcccggttccatccaccgtccatcagcgaacaccaccgaccaagtcagcaagcggatccagataccgagcccgttttgatttttagttacgaaaaaaatcctcataatctgaattattccgtaataaccggaacccttttgaatagctcgtattaaaatctcatgggtggttgtaaacagaatcgatagatcgatccgcaggtatctcgatcagcgattcgaaggcgacggcggcgcgacccatcggctattcgaaggtcgtggcatctgctgatgtctacgccggcgtcttccattaccaatgccttcggtatgactatccgcaggcgactggctg

SEQ ID NO: 43768 - DNA, 155 bp, Oryza sativa
gtgtgggctgtcccatcggagcgtcattcggacggcaaccgtgctgatctccgcccattcaagagaaaaagaacagtccagtttggaaagagaagggtgcatgtggtatccccttgaaatataaaaggaggaccttgcccatgaaggggggggtt

SEQ ID NO: 43769 - DNA, 635 bp, Oryza sativa
ttcaagtctcctaatgtttgttataacctaaagaaccgtgtgctttctttttatgtattgttattgcttctttatagggtttagctttgcttgtgtgcttcgcgtagcttctgtcgttccgaaggttctcgaagcatggttcgcggtcgtcgccgaaggttcggaaggccgttctctcttagcaaggcaagtcacatcatccttgagcatattgaatcccagtttataaaattattttgatttaaattaatgcattatcgctttatttaaattcccgcgttttcactgctttatttagccatgcctatttacctttgttatgacattattattgctattgttattattaccttgttcaccctagaataaataaaaccccaactagtgggtactctattcatggttccactagtatgaatttaggtagatgcttcgctgattaattaggcaacattaggtggttttataactctagactttgggaatattcatatcacttggacactatggaatggttggattattgtggaattgaatgcacacctccccctctattcaaaaccctcaaaatggttttaggctgggctcggggtgcatggttttgttagtagcacctcggccacataaggaccggt

SEQ ID NO: 43770 - DNA, 635 bp, Oryza sativa
acattgttcctacaaatcaaaggggccctaaagatttcaatattgaaatgatgttggtaagttatcaatggacctccacgaccccttgaacgacccctagcagtaattgtatctgacatatctgcagtggcgtagctagctatgtggcactgtggtccatggaccatctaaaaatttgatcgagattaaaactgtagtatatgtgtgagttaatataataaaaattatatagtaggccacccatttaattgatctattacatatagatagaccacttttactctaaattctagctacgccactgcatatctggtacaataatattattatactcagaggttggtttagtttaggaaatattcccttttccgccatctcctataaattaataagcatgcacaactcgagccccacatctcctataaattagtaagcatgcgcaactcgagctccacatcacagctaataaaagctgcagctaacacgtactgttttgcatgcgcgcgcttagcttaattctcacgagctgatcgatcacaggttattcaattagttaagttcagctacttaattagctagctccattacactgcaagctaggcccagatcgatggcagcttggtccatggcgtctc

SEQ ID NO: 43771 - DNA, 844 bp, Oryza sativa
tctctcacacggtgggggttagagacggtgggggagcggagaagaagagaaaagaaaggagcgccggccatggcgcggcggcgcgaaggtcgccggcgatggcgacgccgtccacgcggtcgcgtgagagagagaagagaagagaagctagggtttttcggcggccggccgggagaggggggttttgatcctccgatctcggcgcccggccgtccgatcgaaaccctagctgatcggacggtcgacgccggccgggccgaaatcggcccaagaaggcgcgcgcggggggcggttttcctggcccaggcccaggttgcggcttggggaaagggggcgcccgcccatgccaaaagggccgttggccgccggcaaaagttcaaattaggtccctcgggggccgaaaatgaataaaagagaacagtagcaattttccattttattttgtcaattttcatgcaaatttcaatagaattttgaatagttttttgcatgttttacctctgtttaaatttgaaccaacgggagaattttcacagagagagaattacagagattttgctactgttcatatgatttttatatagttttccgctgcaaatagatgtaattgatgaaaatcagtgtttctaaaattaaatttcgaaccaacgggagaatttaattttaggaacattaagtatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 43772 - DNA, 239 bp, Oryza sativa
cctgcaccccaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagc

SEQ ID NO: 43773 - DNA, 217 bp, Oryza sativa
tgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatc

SEQ ID NO: 43774 - DNA, 745 bp, Oryza sativa
cgacaagctggtatcagagccatctcgactgtaggataagccaagtggataaaacctaaggacatattttataaataaaactatttgcgaaagttcctctttttctccttcccctaatgctatttgcaaaaggtttacccttttcttccttcttcaaatttcaattagtactagttggtcagctttgtgaagaagaagacatcgtcagttgtttgccgaagctccggaagactgcaggatccgctagcgaagcaaaggaagcagtgaagccagctgtgaagcaggagtgaagatcttggagaacccgtcgtagaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcaaaacaaacaacacatcaacaaaaagagttagttcctttaaggtcctgtctctagttctggtctattctttcctggttggtttcctctctcacctcaatccctgtaacagatgtttaacagagaaaaaggaaagaatgtcagcgggtatgcctccagtaactcaagttttcaactcaatccgccactggcctcaagagagttaacaagggcacaccctcggtccattccaagcatgctgcttagttcacagctaccattagttggaagtcaagaccaaaatcagtatgtgtttgatcgag

SEQ ID NO: 43775 - DNA, 1128 bp, Oryza sativa
tttgcccttcttcacacaacatcttgcctgtaatggttaggatgaagcctggcatatatcgactggggctaacgtgtcatctctaagagataacacgcttaactccggcttgagacgagcgcctagaggctttcgtcttgacgggatggggcaaggagtgcgtcagaccgccagtcgccacctaacccgtgatctgaccggtctgtgactgatcacagaccggataaaagaacgcgccgtactgcgctgcatgcagcgtgacgcgcttgaccagactgcaataaatgctgctaggtgagcacagctgtgctcacttgccccatatatgtggcgcagatttctttaaggggtcggggtgcctcggccctcggggccggggcaagcacaacccgaccccccctcgggggaaatcaggaggagggcggacacctcaccctcgggcccgacgcccccgaaggtgccaggccacgtgggcgattgtgtctgcctcaagcctctggtcatgatactcccggtcccatattaccgacagtagcccccggcgttatgccagagcaatttcccttcccaagggaagcggtcaggtgtgacgccaccctgtgacaggtgggaccggtctccgtagttgggcaaaatacccaacggtctcaatccatgcacattggtattggtaactttggttgtccataatgggtggtctattcaagactgccacaccacttgagcagcgcgcgaatctgggtgagcagattcgtctcgcccggagatatggtaacgccgcttcggtcggcgagcgtaattaacgcgcgcacgatacaatccatttcgattgccacaaccgcatatccacttaatgcgccgtaagcgggcgaatgggattagtggatgcgtgggcacgggaaacgagggagcgagatagcgagatacgagggagcgaggtagtgggcgcgagaaacgaggagtcaggcctagcgatggcaagggtataaaagcatcgaggaaaggatttgctcccttcctttcgccattgttcctcttgccttcgccgcctgagctctaactctttctctgctacgccctactttcgccacacgcgctcgttcccaaccatctcttcctccaccgcca

SEQ ID NO: 43776 - DNA, 1501 bp, Oryza sativa
acaaattgataatagagtacaaataaataactatttaatattcacaaataataaatcattacagaggtagatagtttctctcaaagaataactttctacgcagcggaaaaataaaactaaaacaaactgcggaacagctatggcgactccactccacagacatcttaactagaacaaacttaatcctccagatcatcaccttcgctgagatactcctcttctgatgattgaatattgcaagaatgagcatatgacatactcaacaagccacacagcaaatatgcaagtgcacaggataacaaaggatggcataatatagctcatttgcataaacagcatttaacaaatatttaagagaatagtaaaacagttgagtaattaatcaaaactaaataacaccatacaacacacccatgttgtatagtcccaacctcatttgaacaaccaaccccggttgtacaaatcaaacctccataccaggaatataccattctaaaccaggagtcaaattaattatcacaattaccattaatgaataatatgggactaatcacgaaaaacattgctcaactcacccataaccgcgggtacggctattcgaatagttttactctgatcagaggtgtaccactgtacccacaagacacaatcccacaacatgtcaccacgcgccttagtaccaccacggtacctcggaaaggaactgtgacattacccctcgcacaacacaactcaccatagtgcaccgttcctggatcataatctccccctcaaaaccagaggcaatggactccccagcgacccccaccaacttctcgccgcttcacagtctggcacactataatgaatcatgctatacaaaagataaagccgttgcccacgctggcttgtggttggtacggtaaatgtttcacaacagtagctcgcgaaccggtccttaattgtcatgagcacaaccatgtcacgcccagaaattcactagtaatttccgaacttatttgtgcataaaaccctcgtccaggaatcagccgaggtacacaaactgacaatttaatatacaaatccatcataatattaacgttacatacttacaaaagaaaagaaaacagtagcgaaattaacgatctagcgatggcttcagctccactcccacaggcagctcaactggggtataagccaaacgtcttctccttctggatcctttttcttcaactgaggtttggttgattattgcaaggtgagcatatgacatactccgcaagccacacagcaaatatgcaagtgcacaaggataccaaaggatggcataatatagggttcatttgcgaaagcagcatttagcaaagatttaagagaagtaaaacagtaaagtaattaatcatcaattttaatcaacactgaacagcacacccatgctgctcaggcccaaccaaacctgaacaaccaaccccggtcgtacagatctaacttccaaaccaagaattatccactccaaaccagg

SEQ ID NO: 43777 - DNA, 1501 bp, Oryza sativa
tcctccatgttatgcctgcctatatatgcagcttgttcattttcaagatcatggatcctatttttacttcactagttcactgttgtttgcgtctacacaccaggatttacaaaaccgtacggttatcacgataatcatgtcagtaccttagtttttgaaaccacagtatatcttacggttttcatagtaataaccacatgtttaccacgataaccgccaatccatagagtaacggtaaccccaccaaaaacggtttgagaaaccttggtacacactgctagtgactatataaaacgagataattatgggtgatgatatttattttaattagaagtttaggtgttttttgtgttctaaaaatatttatgtttgtattcgtgtccggttatatttgatccttatttttatttgagataattcatatttgttttcgtatatgaattattcatatttatttttgtatgtgaaaaaaaatacaaaaataaatatgatattagcattccatccgtatttgttctttttcattcctagctgcgggcggcctaatcgttattctcagcttctaatgtattcatggcaaagcttttgcgtactcgaaaaataaccagcttgtaaaaaataaaaacaataaaacgagcaagcatgtgtgtccccgtcatacatgcatcagaaaaaaggatgttcatattttagcacgaaagatggaagtcatttaagtggaaaaaacattttttttttgggttatggtggttcattgggccaaaaacaagcccaatgatgtgctaatcgggccaaggcctttgattgcaggtgatgaatgaaatttctaatgtatagtctagccaggtgattccaagaaatagctgatgagttttcaattgatgagaatgcgaaccagacgagggtgtttttactattattattattcacattttacggctgctgagtttcagaatctggaaatcagctatctcgtttgcttgctagctcaattatcaaccatatctaaattatgaaatataaagcttatattttaagttgatttcgaggtttttctatcgcattatatatttttattagtctttatgtcgctaaaaatatatatacaagtagacatacacattacagatgggttgtgtcgtagctaaaacacaacccacccttaccccctacccacccaggtgcgctttagcgcttccttatgtacatactttatatacaaacgtacatatgaaaaaaaaaaaggacgcattgcgcggagagtggcgcgtgactaggcaccggttcgcgtgactcttacattcgcgccaatagtagctaaactgtttgctaccaaaaatacatttggacaagcaaataacgatttttcatgcttatttatatatatggcaaaattagatcaggcaaaatatgttcccaagagctgacttgaaaagcaaaaccgagagcaagaattcatcagtgcacgtggcagctgcatgacatatactgcaattagttc

SEQ ID NO: 43778 - DNA, 1501 bp, Oryza sativa
aggtatgtataacacaaattgttatacacacacacttcttactaattctgatgtggcgtattatgattaaatctagcttttacataacttccaactacttgaattaaatggtcgagagctttagttagtaagattttttttaataatttgctagtacacatagtattttccatcatttgtttcaatagttcttcgatcaacgaatgagtgttggtcatcctcatccatgaatgagttaggcagaaatcctaatatgcgtatgtttttgtgggctgtgtcacacacatccagctcacgagagtccacgtgggggcttaaccttgacgcggtgctagcgtaccatgtatgtccgtgtgtgacatccaattttttttaagaagcgtgcatgcttgtagttttgcatatatctgaaactcaatatttttcaaaaaaattaaactaaaattagaacttaaaattgaaaaactttcgttcaaacgtagaaaactttcaattgaaaaatttaaactttcaactcaaaatttaaaactttcaactcaaaattttgaagcagggcgatgaaccctcaataatgagaatatattgtaaagtcaaaaattggatccaagaagataactaatataatacaatcatgatcaaatgtgcgcacgtgtgtgggaaatggatgtgtatgcggaaaggtggaagatggggttatgattcatttctgtgtgatcctcttccttgcactttatatggagaacatggttatttttatattattttttctctcttttttacattatgcgcgagaatattttatccttctcttgtaagcatttttatgaacatcattttttagctcatatctcacttggcatggatagttggagggacaatcatagacatgtgaagtttttatttggtggacagataatgtatgctgacttccggcatgtaagtttatcatatggtggtgaatggaatattttgataatcctcaagtgtaagcaaaataatgtgggtagaaggtatattcgttgctaacctccactgtggaggaagaacaaacttggtgcgtgtacgtgattttgatcatgaaagcataaaaagaatgaaagaattaaaaagggtctcaacaatttgactacactcgaaataataacaaggaacatatgcataaggtttgcagtatgatcgacgtatggcttgggtaggaataagacattaatgaggagcatgcaaagttataccatttttttcatttcataaaaattccctagaactcaacaaataggagtaaagttcctttcattaggctatctctcattcatcaattacttagatgatatgtgttcctatagatatgtgttcacaagcagtagctaacatgcgaggaataaaaattatgcaacgcatttccaggaaaatcatatactctagttgaagcatccaactccattgtaatcttgagtttaatttttttcagatattttctatggtgagaacagattaaactcaa

SEQ ID NO: 43779 - DNA, 1501 bp, Oryza sativa
gaagctacaaagagccggagagtcagagagcttttactctagaaaccctctcctctggttcccaatccagcctcgatcgttctggatcccctttctcagtgcgcaaggtcctccttttatacctcaaggggataccacatgcaccatctctctcttttgtgtggggacttatcctatctttactcaaacttgacttctcttcataaatggacggagatttgtaatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcctgacgggatggggcgaggcgtgtgtcagaccgcctgtcgccacctaacccacgatttgatcggtctgtgactggtcacagaccggataaacgagcgcgctgcactgcgttacatacggcgtgacgcgctcgtccaaaccgcaataaatgcggttaggtgagccccgctgcgctcacctaacccatacacgcggcgcaaaacctacaaggggtcggggcgcctcagccctcggggccgaaacgggagcggtccgacccctcggggagacaaagaggggggcggccacatcaccctagggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctcctcagttgggcagaaacccaacggtcgccaatcacgcacatcggcaatggtaactcgactgtcaataatgagcggcctcttcaaggctgccacattactcgagtagcacatgaatcgggatgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacaacgttggcaagggtataaagacaccgaggaagagatttacttccttcctctcgccattattccccttgtcttcgccgcttgcgccctaactccttgtttcctgtgccctaccttcgccacacgcgctcgctctcaaacatctcttcttccggcgtca

SEQ ID NO: 43780 - DNA, 1501 bp, Oryza sativa
ccggccgaccaccctagctccggcgaggtcgccacccgtgccgtggctgccgtcgatgacgtcatcatgacgtcatcatctcctctttttcagtttttctttaatagattaaatagattaaaacttcggaaattcataactaaatcatcgtaactccgattcgagtggttcaagttgctaaattcatctaaaatcgagatctacatgttaaaaatatccacatatactgtttatgcttcttttttactgttttgtttattttgttctttcgctttagtttccgacgttccggaggagagcgttttcgttgaggaaggttcgtgagtgcgtcgaaagtgttcaacaagactaattgaagaccgattattgcaaggcaagtcacacagatcctaaacaaccctttgagcatgttgaacccgtttaaagctattattttatttcaactatgcattattttcgaatgtcatcgggtggtgaacctttcccaattatttaatggccgaagatgactttattttcctatgggttataatttgattagcatgaaccttatatattggattggttcagctaaatgctatatgtatgtttgcttagccatgcttagaaacattagctaactaaagggattaattataaattatattattattattaattatggttatgttaaatggtagttcacgatggttaatcgtgtgatgttaattaattgataattaaaacctagttaaggtgggttgtgagcatatggttttgatggttgtgctcatgacaattaaggaccggttcgcgagctactgttgtgaaacatttaccgtaccaaccacaagctagcgtgggcaacggctttaccttttgtatagcatgattcattgcggggcaccagactgtgaagcggcgagaagtccgtgggggtcgctggggagtccattgcctctggttttgagggggagattatgatctaggaatggtgcactgtagtgagttgtgttgtgcaaaaggtattgtcacagcctctattcgggtactttccagtatcgcgacgcatggtagacatgatgttgaggctgtgtcttgtgggtacagtggtacacctcttgccagagtaaaactattcgaatagccgtgcccgcggtcatgggcgagttgagcaatgtttttcgtgattagtctcacactactcgttaatgttaataatgtgataattaatttgactcctggtttggagtggataattcttggtttggaagttagatctgtacgaccggggttggttgttcaggtttggttgggcctgagcagcatgggtgtgctgttcagtgttgattaaaattgatgattaattactttactgttttacttctcttaaatctttgctaaatgctgctttcgcaaatgaaccctatattatgccatcctttggtatccttgtgcacttgcatatttgctgtgtggcttgcggagtatgtcatatgctcaccttgcaataatcaaccaa

SEQ ID NO: 43781 - DNA, 1501 bp, Oryza sativa
ttcgctcggaatcaagcccgaaatcctcgccggcgtattcaatggcggccgaatcttccgcgcgcgattcctccctccccggccgctctttccttcccccggcgctatttaaaccctccccgagctccgcccttccgtttccgccgctcaccgctcgctctcgccgtcggaatcgtgctcgcaccgtgctcctctctctccgccgtcgccgccgagctccgttccgtcgccgtcgtcgctccgctcttcctcccggctcggcgacccctccgtaggcttcgccgcatcgtcgccgaccccgtccgccgctccgcttcgcccgtcgactgccggagcaccgtcgtcatcgtcatcccgagccgcgccgccgtcttcctccgctccggccgccgctctcgtcgtcgtcgttgtcccggggtgagccgaagaccgccgttcgccttcccccttccctcctctctctcgggcgccgctccgccgcgccggtggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatgggatttttaattgaaaattaaatgaagaaattcgcaaatatccatttaaagagcatataagcttcaaatggccatatcttggccatttgaactcggaattggaccgttcaagtctctaatttttccttaagatgtaaagaacccatttttgtgctttgtttctgctgttatgtggagttattttgtgttaaggcctttttcttttccgttggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgttattgttattattattaccttgttcaccctagacaaacaaaaccccaactagtggacactctactcatggtatccctagtataattttaggtagatgcttcgcaatctaattaggtaaccttaggtggttttacaactatagactttgggaaatattcatatcacctggacaccatggaatggttggcttatgttggaattggacacacacctctcttcctctttcaaaacccctaaaacctgttttcggtggggtttgggtgcatgccagttgtgggaagtagcaccccggccactataaggactaaa

SEQ ID NO: 43782 - DNA, 246 bp, Oryza sativa
tcataataacggagtgtgattttttatcaattcaatttgcttccttggtttatcattgggttgtgtgattttttctacttagtctgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagt

SEQ ID NO: 43783 - DNA, 298 bp, Oryza sativa
acaaataattacattgtattatatttacatatatcaatttttttctaaaaaagttttatgacaaaatgtattagctggtcccttaaatgaaatgggccgtggaggtgggccggtccagtaagagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaaaaagaagagggcggcggcga

SEQ ID NO: 43784 - DNA, 1501 bp, Oryza sativa
cctaaacccagctacacaactctagttcattttatgagagagctccatccagctccactcccagttttgatggagctgaaactgtttggctgagctccaactctaggaggggtggagttggagttggagctgtaccagacaggccctgaactccattgcagctctgcctacaacccgccctcacccccgttgccatccttagtttttttcctgcaaatttcatgtccatactttcgtaacatgacaagcaaattagaatccatttaagacatgaaccaatataatatcactaaaaactatttcaattcttgccacaatggagtaattaacaaaaaagaacattccaaagtccaacacatactattcttggtcccataaggaacatgtaatgtatggttgccaaataataagttagttcctgatggaaccatttcagggattgttatttttcaaatgaatattcgatgttaaagagtggtgttcatttgattgataagatagacaagcgagagattaaggagtatagaaacttcggagaatgataggagtacgttacacgagtcttttcctgcctatcatcgatcatgcaggtctcgtattttgactgggaattcaaccggtttaatttgcctgctggcgatttggactaaaggaagaaaataacagaccggctaattagctcatttgctgggtcaagggtacttgtagttaccagttaatgacttgttacttgttgaaatggtgctcagagacaacaaggctttacattgcgaacgaaaaacaaatcaggagaaagggacataaatttttgaatgaagagttttaaactttaaacatgttttcactgatttcaaacattttaatttgttgaattcaaataaattctaaaattctggctagaggcggtgaacttgtttttcctacagtgagatagacctgacattttataaatttcattgcaaaacggtgaactttgttaagtttatgttaaatatatctactatataaagttggctatcaataggttttaaagttgtaataggtattaaagatataaatagagttaacttctaatattctaatatcctagccccttttaaaataaagagaaccacctgagataaccgccgcatttgctgtaacataggcgaggaagcgatcgatgaaactagtttgttgtgggtcattggtatattgtagttgtgcgtatattaagagagatgtagacataattagtacgccagatgtatagggtttggctaatcttattaacaaatatcgtacatttgtgtccattgatctattgtatttggaatgcggcgctcagaaagtggatcacttcagcaagcgaaagaaaagaaaatgctcagtcagtggtggagctatgtatgaggctttggggtcacttaaccctataactttttcacaaacatcattacaactcttggtttttacatgccaattcattaaaatttatgaaaatgatcccactaaattatga

SEQ ID NO: 43785 - DNA, 1501 bp, Oryza sativa
tactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcaataattatagttaaccaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcaggctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatggaatactccaaaatagatataaaaattgaatcccgactggcgcaagtattcggttgataacccttacggggaataataaatagtccagtctttaaacatagaaaatagacccatgatcatgaatccatattgcatgtatccagagcaagtccaaattgaaggtatgatacttgtgtttgagctagtaagcccctgagcacgtagtcacaattgttcattgatggtagctgacgcaattggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagatcagccagcaatgaatatgaaggcgctcagcgataaagttgtgtagctatggcagcgaaataatcagtcggtgacagacgaggcaaatcaaaggcgatgacgaaatccaccaatcat

SEQ ID NO: 43786 - DNA, 634 bp, Oryza sativa
  unsure (1)..(634): unsure at all n locations
attggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataag

SEQ ID NO: 43787 - DNA, 1501 bp, Oryza sativa
tcaaaaatttatgtccctttctcctgatttgtttttcgttcgcaatgtaaagccttgttgtctctgagcaccatttcaacaagtaacaagtcattaactggtaactacaagtacccttgacccagcaaatgagctaattagccggtctgttattttcttcctttagtccaaatcgccagcaggcaaattaaaccggttgaattcccagtcaaaatacgagacctgcatgatcgatgataggcaggaaaagactcgtgtaacgtactcctatcattctccgaagtttctatactccttaatctctcgcttgtctatcttatcaatcaaatgaacaccactctttaacatcgaatattcatttgaaaaataacaatccctgaaatggttccatcaggaactaacttattatttggcaaccatacattacatgttccttatgggaccaagaatagtatgtgttggactttggaatgttcttttttgttaattactccattgtggcaagaattgaaatagtttttagtgatattatattggttcatgtcttaaatggattctaatttgcttgtcatgttacgaaagtatggacatgaaatttgcaggaaaaaaactaaggatggcaacgggggtgagggcgggttgtaggcagagctgcaatggagttcagggcctgtctggtacagctccaactccaactccacccctcctagagttggagctcagccaaacagtttcagctccatcaaaactgggagtggagctggatggagctctctcataaaatgaactagagttgtgtagctgggtttaggcagctccacaactccactccagacccaactcctggagctaaatttaggagttagagctgtaccaaacaggcctagaatcttggtgtttgctagagctattgcagggcaaggataaacaaatatgggtgggaactcaccataaacaagcattggttcgaggtcaattggccaccttcactcgcaggagcaccttctccctatcgtgccatctatctcagctctgggacttctgtccgcccacgaatccatgatcaccatccacaggcacggtgagagtaggagttgatttggtgggagtcaaaatggaggtatactgtagcagaatggtctaaaaaaaatatttctactagcgtgaatggccgtatcaacacccgagctgcgtcatctacactttgaatcttgggtaatacaatagatcaaaattaagaactgtggagattatgggtaccccatacccacacggcatggttatccgactagttataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctatagggggca

SEQ ID NO: 43788 - DNA, 1501 bp, Oryza sativa
cacttttgattggtatcactatcttcactaccaccaatatttttgccacctctgctgggcaatattatctctgtattggtcgtcttgtctctatgccaattgcgtcagctaccatcaatgaacaattgtgactacgtgctcaggggcttactagctcaaacacaagtatcataccttcaatttggacttgctctggatacatgcaatatggattcatgatcatgggtctattttctatgtttaaagactggactatttattattccccgtaagggttatcaaccgaatacttgcgccagtcgggattcaatttttatatctattttggagtattccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttagcctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattattgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggtttgagagaagattatcttttcgactgtgaaggtctcaggggctactgtggagattatgggtaccccatacccacacggcatggttatccgactagttataggggataacttatatatatggaatatgtaacagatcatgacttgggtattacgtttcctt

SEQ ID NO: 43789 - DNA, 170 bp, Oryza sativa
aagcttttgaaaagttgatgaattcataccttgcagggctaaaacaactcttatgttgataagagtcaaccacaatttattttgcacatactatagttggctgataaatcaatagtccttcaaatgcccattttcagctcactgttgtttaagggcctgcgtttttttcc

SEQ ID NO: 43790 - DNA, 1501 bp, Oryza sativa
gcttaaaaatctcgacaccggcccatcgagtcaagcaacgtgacacaacacttttgcttttgcttttcagtctgagacatcgacgtgtttagctcccatccctaacttaaacccgtttatgtacgttaagttcgttatgggcaggcgagtgtgaactgtatggttgatggttcttgtcataatcaaactgctcattagaaagttgcgtgtttggcatgctacaagtagcagttatagatctagctgtgttatgcaacctatctgacctgcagctggcgcctgttgcttggttactcataattaactgtcgttgtacgtccgtatgacacgccactgaaatcattttattaggttgcatataaatagtaaataaacaattttgcctcccttattctaaggagagtttaacacattaataatggagatgagacgatttcagctgtagattttttttccctttcaataccggtccctttgtcagttataagctatacatatcgatcgaccctaggccatagctgaaagactgaaagcaccacgctagcaaaagctctcatttcggtcggtgaagtgaactttggcatgaaaaccgtgcacagtacactcgtgccagacatcgaataggcttatagccatgtgcaattttccaaacaagggatacctagcttcctctaaccaatccgcgcatctaaagaataccagttaggtcacagttttggcggttgagtgcaacacatgacattttctttgggggggccaatatgggagtgtgtagttgtgcacgcaccacgcagtgccgcgcgtgcaaatccttctctcgaggcgtctgcatcagtgtgcatcatcataacgtgcatatgcagcgcagatgcatatatatacacgtgggaatacggtgtaatcacgaaatcaaacacttcggatcagatcactaaaccaatcatcagctaacatcgcgggagcaggagtgtactggctttctttgcgttacgacaaacacatgggatctcaacaaggcacacgagattattgatttatctttcaattaattaagcaccttggtagcacgcgcggttcagtaaacttgcgccgttatgcaaccaaacaatagaggcgacgaagcgataaaaaactaagagcgtctgaacctgaaccgtaccgaaagccaatgccaatcggctactttttgcaatagtttttggttcagaaagcaaaatgattcgcattagttggcgatgaattagcgcaaaggcatttgatctaagctgagttaggggttaatctctccagcctgatcaatggaattattccttcccttccccgtcaaagctcaaagccgcatacttctctgtcacacaaagcggtgcagctccacacggcacctgcctacctagggcgcctatgggcaggatagcttggttgccccgctcgccgcgccagctcgctctcgcgccgtctcctataaatctctcgcctcgccgcaccagctgcggcgaaaggt

SEQ ID NO: 43791 - DNA, 215 bp, Oryza sativa
gtgcgctctgctttcggtctctcccgtttcttgcttgattcccctccttcaagcttggtttggtggggatttgtgtttggtttcatggtggttaaggtaggagcggggatattcctgctccctgattttggtttcttgctgttcttgattagagcagcaaatgcttcaaatttttgggggtgccatggagctccttttcgttactgttcacttgt

SEQ ID NO: 43792 - DNA, 568 bp, Oryza sativa
gcatcattttggtatttaaacatgttactgaagttagtgcatttggcttcattagctgctgccaaatatctcggtctacaaacacattctctataattgttcagttaaaagtaaatttatttgataggacagggatgaccaaacaagtcatgttgtttccctccccaaacaaataaatttttaaccttttgttaccaattgaacatttcttttcttaccttttttttttgcatgatgaacacttttgaacattggttttttgttaattttccagaaatatcaccactggagctccagaagtcatggttaattttgtcacatcatgttataagccagagctattggagcctcttgttaacaatatcacaaaaataccagaagtggtatgtaattggtgccttctcattttaagtgtactatgtcgaacagtgtaatgtttaaaatacttttcatgtactgactattatgtcactcagagttctactgtacagaaatcccgttgggttttaagccaaataaataattaattacttcttcctacaatattgatatgcctgtagtgttgatg

SEQ ID NO: 43793 - DNA, 677 bp, Oryza sativa
  unsure (1)..(677): unsure at all n locations
gagtgacattcataaccatcaaacctgcagacgataaattaaaacttaatatggtaacagagctatagtcataaatttttttcttagctggttttgttaagacgatgaagaggacgatgacgacgtgggcattagcctggattaaacaaagggttgggttaaaggagaagataaggcgtaacacctgtagacacgatcgcacgggcttgacggcttgagctgctgctgctgctgcatctgttgaatttcttcgatcagccggagaatggcgacaacggaagctgccttaatttgcagacgacgatctgaatttctgattacagctgtactacgctacactgtctgtattgctaacttcctcctttactgaaaggtcagtcanggagaaagagagagagagtgagcaatcaatcattgggcaaaaagaatcatcaagcttagtagttagtataggttggtcaagctcgagctccaattctttaatcctttgaaagctaaaaaagtcggtcatctcttaacagtgaacccttctatatgcatacagctatgagcagcgctctgacatcttaattacatgatcatgagtggttttcacataggtatatataacttcatttgcctatttataccccttccacacttggaaccttggatcatctcatctcacacacccaaaa

SEQ ID NO: 43794 - DNA, 535 bp, Oryza sativa
  unsure (1)..(535): unsure at all n locations
gccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtggaaggggtataaataggcaaatgaagttatatatacctatgtgaaaaccactcatgatcatgtaattaagatgtcagagcgctgctcatagctgtatgcatatagaagggttcactgttaagagatgaccgacttttttagctttcaaaggattaaagaattggagctcgagcttgaccaacctatactaactactaagcttgatgattctttttgcccaatgattgattgctcactctctctctctttctccntgactgacctttcagtaaaggaggaagttagcaatacagacagtgtagcgtagtacagctgtaatcagaaattcagatcgtcgtctgcaaattaagg

SEQ ID NO: 43795 - DNA, 1501 bp, Oryza sativa
aataagtactaccaccctcccatgaacagtaccgtgtctagatttattaatatctatataaatataaataaatgctaaaaagtcttataatctgaaacggagggagtaataattaaatcgtcttagtattctctcaccattaaacaaaagagtttcactgataagtgataacagagcacttagggccaagtagttgctaacttgctgatgtccttgtccatggctttgatgggccatggacaagggcaggaggcgtgggaactgggccactggacggacggtttgctttggtcttgtcattaccggcccaagcaaacgcccatcacagcccaagaaaaccaagaaagcagtttcgaactttggcagaacggttatgcaacgtgaatcttcaggaatggaacatgccggtgttttgttggttaatcctttccatccatgacaaactgttggccggcagggatacgcgcgcacacatgacgaagtttccgtgtatacgatgtcgcgcgcggctgaaattgtttgggttttgacctgcgttgcgtgcgtgcgtgtgtcgtggggcggcgatcgatgatagatgtaccgtgaggacgccatccatcaaacaaatcaagaagaagaaagacatccctttgcatgcaaattaaagtatccgcgccccttttatgctagctggagcaaaagcggaagcgaattcatcatgcgtgcatgatgaaccgtagctgcgttgctagatgccgtgcctgccgattttgtgctctaggtggttctctgatgtttaagcatcagcttgaattctgaacaaacaaatccgtgcggagttcaagaaatgacttaattagaaaacctctttggagcacccagattttttttaaagaagctagtctagatttattgcattgacatagatagcatgcatggcttctcctagcttgcttaattgcagtggttcactcaacattttattttttcgaacgaacgttcactcaacacttaatgttacgataatctgttacttgtatggggctcaaactgttctcattttgtcaaaagaaaaaaaaaactcttttgtttggtctgttcatgcatggttaatttgcaggctgcaaatttgcctggtaattaatttgtcgaaaatggttaatgcatcatgttccacaccacttgatgcatcggccaatcgatcgaccaggtcgtactaaccagtccacaacatgattaacctgggccggcctctagattatgctaacattttgaacaagtggatgtactctgtgcctatcaaaacaagtaattcgatcaacattatccattttaacgagtgcaagcggcgctacccggaatccggatgcgcgcaggtagcttgcaacaccgaaaaggccacgtacatgcacgtgatgagctccgtttcccccatataagcgatacacgcatcatcatcatcatcatcatcatccgtacaaaacggtatctagcctagctagctgatcggcccacctac

SEQ ID NO: 43796 - DNA, 1501 bp, Oryza sativa
ccggagggaatatgagcactcgtgacaggggacggggagaaaatgggcatggcgaaggccagtttgagcaggtcttggtggtgccgctagcataagtcggtgatcgggttagagtgtgacagtgcgagcgggtgtcacagggaagaagaggataaaatgttattgtatgatcatgactcatggtgtaatctgatcgtaaaaagtctctaaaaagaatgaatttgtaccaaggaatagataacccctagattttattattggcatgcattttcatagcgtgcgtacaaacgtacatttatttatatgcaccatcagacgttaatgcactctgatattgttatatgcattgtcaattatactttttttctttaaccacgtgagggggaaaagtttagtacgaaagtggaagggagataagagtgaagtgcattatcagtccgtaatctcccggtcgagtggtaatcacggtcggtctgtaatttggtctcctttcctggtgtgcgctacatgtggacaaggcaggcaacgcatgatcgctacctgcacggctgcacctgcaccgcactggatgcaaaatcccgttgcgctcctttgtcggtggaggcaaaacgcgaagctgcagagtttgagagttgtcaaatgtattttcccacgctgcatacagagtggctgcacgcagctggaacatctctggctctctgccgcggaagaccttctatcgctcagttctccggcgtcagactcagactgacaagtgacaagcagagggcatctcagtacgcgccgtgaaacggtcagcgccgcgatcgatggtgaggcctctcgtccgccgcagatccgatcggtagcaatagcacatatcacctgacgcagtaaaccggaatctgatgcagcaagttgcggcagattaaccccagctccccatacaggcaggatttcatattacctggactaatggtgcatttatcgcccgcgactaaacaatcggccgggacgcgaggctgccgccggtgtaaggcgcagtcatcattacccgtgaagtcaaaccaggtcgcgccccccgctcaaaaccacgtaaccgcgcgcatcctcacgaacgggtcgatctcgcttcaccgagaacgcgacacttgttcagaaaactcatcttgacacgcttcccaaatctaggaagggaagtgatgaagtgaacagagaagaacgtttatattacctgatgcaatttggagctctttgggcgtttcatttggaactttggatcacacgctgaggcctccaattgaacggaaacttttttacggtcctagtatgttgttgtacagctgccaagaaggcaggactgtaactttcccaatgcactcgtcccctgtaatacatcaccgggctccccaggctactctcgtagacgggaaacgcattaactgtgaacggaatctgatttagccgggctgtttgtttggtcaaactgcaaattagtaaaaggccaagtcgagacccagat

SEQ ID NO: 43797 - DNA, 1501 bp, Oryza sativa
aagctcccatgttatgctttgccttccattccatgcacaacggcacacaactctccgcaggacacgcacatgttacaaacttacagcagcgatcgatggcactacgatgcttgcacggttacaccggccatgcccaagcgtaaatgcgccgtgaaggaggttagttgggcggcctgtgtacctgcttacactcagctcattaaatacgatgggccggcgtggcgtcgagttacactgggcctgcacagtacgctgcaaatcccacgattgccagctagcagcgaaaatcgcgcacacaagcagaaatacagtaaccttttccttccaggtgcatgacgacacgaggctgcactgcactgcactctctttactgatcgatccggaggccggcgttgcgtgtcagctaggtagccatctcggggcgtcgtgtcggcacggcgctgcccatcgccgcgaagagcggagcgggacgctgggacgtggtgatgggctcatttttgctacgcgcagtgtgtgctcagtggtgttaatgttgtttcctcacctgcttcctcccttaaatgaacagcaacattgctttggtcttctccgatacatgtacaggctctcgtcttcaacacactcatgggtcatggctcgtgagttcatatctgctgagttcatatctgctatagttcatgcattctttgtttcacctaccattggtctgctctcataattcgcatacataggaatggcatgtacctggatcgaccacgcgtcgttcagcagtgccatgccacgcagacggcagacaccgacaatgtacttggctactggccattattcaagatttcaagttgtggtagaaatttatgatcgttgcgcagaggttgtttcccgaaagtatccattcttgtaccccataatatgtagtgtatatattatatagtatatatttgctcgacctggccggtggaccgatcttgtggacatgtacttcacttaatttccttcttaactgattggtagagtttccaattttccttttaaaaaaaatcgcatatcgtccgctacttgacttgagagcatcaccaacagtctacatatctgattcctaaaactgattttaagggattttagtctaaaaaactgctctaacaaatcccctaatcttctacccgagttttggagttcccttctctcgattcctcactccgtttatatgcgggcgtgcattctcgcgaaagtcgctcccaatctcgcactcccgcctctctctcctcccgttcctgcgcgtggaagatagcgatctttctgcgcgtggaagaaaaaaacttttaagttttagggaatgaatttaggctatctattggagggaggagttttttcccttccttttttcagtttaggaaaccaaaaacaattttttgaggaaagattatagataatctgttggtgatgctctcaggccagttggtatttcattgggtaacaaagttttttttccctgaaatacttg

SEQ ID NO: 43798 - DNA, 301 bp, Oryza sativa
cttgctgtaagtcttactgttacaagtttctttcctagttcatcacgaagcattgctttttcacttgtctgtgagagtatggagtgtatactaataatctatgccaggacgagtttaatgcatcctaattcatctgcatctaacgtccacattttcatcttaaaaacaatccctgtatacattttcatcatatagaacatcacagaattcggttgtatgtcactgttgagatgtttggtagtttgttgtacaatttctgagatcctcaattgtgaaacaattttcttgattgtcatgcagg

SEQ ID NO: 43799 - DNA, 607 bp, Oryza sativa
gagatgtatgttcaaattttcatatgaagaaatttggcttgcatgcaaacattttagtatcttctggcttctaaagttgctgaaagactggtgtttgtgtaaccttggtatgtcaaatgttgcattgcgttgcctgacagcatattttgttgtgcagactttccattttgatccttcatgtttgaggtgaaaagaaaagggagatcagactcacgtaccgacgttcctctcattaacggaagcaaactaatattgccgctgccttctgcacccccgggaagataggtgttgctttttttcattaatgttagtcatgttaatattgatggcgagcatttgaaccaccgggattcagatactttcttggagaaatgaatgctaatggttttttacgttgcatcaaaacagtgatgtgatgagatgtttctagatccactcttatcataggcgtccgttttttaatcctcggcgtgtgctgttatttggtggctaatatgttgatcctggtattctttgatagcctttgggtatttagctttcactgtggctgtcagatttccactgtaatgctttaagcaaagcatgattcccatgtttggctttcagc

SEQ ID NO: 43800 - DNA, 1501 bp, Oryza sativa
taccataatagatgtacagtgccgactaaccaatgaaattcagaaaattaaactatttaataccctgaacagtaaagttttttttctttcaaaataaaagaacaaatttctgttttggtaaagtagaatttaataaattttgtacataaccttgcatgtgctgccaacttaattaatttataagagaatagagaagggcagttctattttccaaaataattagaaggcaacttaaggtttaccatttggcttgtcctaaggtcaaggtggctctgataccaacttgtcacgtccggaatttctatccaaaattccaaacgcttacatgtgcgttaaaccctcgtctaggaatcagccgaggcacataataacaaattgataatagagtactatcaaataactaattaatatgcgcaaagtaaattattacagaggtggatagttcctctcaaagaataaagttctacgccgcggaaaaaaagcaaaagactaaacatctatggcgactccacttcacaagcaactcgacctgaacaaagcctaatcctcctgatcatcaccttcactgaagcactcctcctctaaagaatgaatattgcaagaatgagcatatgacatactcaacaagccacacagcaaatatgcaaatgcacaggataacaaaggatggcataattaagctcattcgcataaacaacatttaataaacatttgagagaatagcaaaacagttaagtaattaagcaatattaaataaacactatacaacacacccatgttgcataggcccaaccttatctgaacaaccaacccctggttgtacaaatcaaacctccaaaccaggaatataccattccaaaccaggagtcaatttagttatcatagtattttcatttatggtggtacgaaaaacattgttagacccacccataaccgcgggcacggctattcgaatagttttactctgatcagagatgtaccactgtacccacaagacacaactccacatgtcaccatgcgcctcagtaccaccacggtaccttggaaacgaactgtgacaatacctctcacacaacacaactcaccacagtgcaccgttcctggatcataatctccccctcataaccagaggcaatggactccccagcgacccccacggacttctcgccgcttcacagtctggcaccccataatgaatcatgctatacaaaaggtaaagccgttgcccacgctggcttgtggttggcacggtaaatgtttcacaacagtagctcgtgaaccggtccttaattgttgtaagcacgaccatcaaaaccatatactcacaacccacctttaatcaggtttatgtatcaattaattatcataacacaattaactatcgtgagctaccactaaatataaccataactaatatcgtaatatgattaaccccattaatgagctaatgtttctaagcatggctaagcaattatacctatatagcacttagctggagcaa

SEQ ID NO: 43801 - DNA, 1501 bp, Oryza sativa
atgattcaccaaggttgtttgtaggtatttggaaaacaaataggcccatatatagatgtttcctagaaggcttggagtggtagagtggcattttgggtggaaattcaatttaaacccttctctcaccttttgagaaataaaagaagatttaaatgagagaagagcagatgatgtgttggctagggttgtatgatgagtgggccccataaggacttggtcccacatttaagagagatgtagaaggagagaactagaagctctaaattttccatgtgttggcactatcacactaaactatattactctctttctctcatccatttaatttagaattaaggccgggggagggggggtgacagggagacagcaaggtagacaaggatttgatggttcaaggtgccaagttccaaagtttaattacttttgcttttaccatggtaatttagtaaagttgactagttaatctattgaccacagtccagaatactgtttacctaacttatggctctcattttatgaggttacatttcgaattagactaagccattgcaccagatgatagagtaaagtatgcttaacattttgacctagagattttgcaagatgagttatggtttaattttggtgaaggtgcaaagtaggctaattggtatgctgtttccagattttttagctgagttcaaggatttatttgggttaccaattgatgtgataaattattataactaaaatttctgggagcttagggtattgtttagtatttatgagaattttggtgggatttattgttgcctcatttatttttaggaattttctctttagacaaagcatgcatatgcaacctattatgagatgtaccaagaatatccaaaaacaatcttaaaagaataatatgcagatacaagcaagttctttttatctcaatttaggtttgcgtattttgatacctacctttcaatttgtttgatatttaacttaaatatatttttttagttaggttgaaaatgcaaaaccgagaagattaggtttctagtttatggtcaaagcaaaatttttgtttcaaaattttttaccacaagatttgtaaacttttacttttggacttagttttgatttggccagaaaaattatgtgttttattttattttagggagttatatgctctagtatgcttctatgttcaccaaaaacttttgaattcaaaatgttttaaattttccacaaaatttttccatggtgaaattccttgtatgttacaagttgatatgtgaaataaaattttaccttgtaaaatatgacttggaatagttttattaacttctcaataattaattatgctctcttaaattttcttgaaattttccgagctaaagaaataattttaataatactaacataatttcggtcattatttaaattgaaaaaacaatttaaaattctcttcatatcttttggctgaaaccaagccaactactatccctctccgtgcaggcccaagcca

SEQ ID NO: 43802 - DNA, 1501 bp, Oryza sativa
aggggggatgggatggggacgcgtagcgcggtggtatggtacaaatagggggcgcctattttgcaaggagcaccccgggttggctacacgacaattttctccgcgcaggttaggggaaaataaatcatatgcaggttactgtaatttactctctctgattcatattactttttattttattaaattttatagaataattagcaacagttataataccaaattagttttattaaatataacattgaatacattttgatagtatatttgttttgtgttgaaaatgttgctatattttttttttgcaaattcagtcaaatttaaatgaatttgaataagagaaaagtcaaagcaactttaatttatatggtctaacttgatatggatgatgtgattaattgtttctttttgcatttttttatgattttacagtgtatgcatacaattactgagttgcagaatatttatgaagttgggtattggacttttattttatgtccaatcctcactccccaattcccattgcatttttatagagttcaaatgtagtgacaacaataaggttatattatattaaactataattactcacataaatgtttggagacatttgttactttgtggggcatatgcaaagttattgtgcggtactgctacgtgttaagaagcattgaaatgtatgacactcacattggctggcgacgaagtacgcagtctacagaagatagatcgttgtgagaaagtcaaatgtgagttgttggaccaaagtctgcccgttccaatttacgtaggagggggagaagcattcaactgcgtgcatcatgcaaattgtcattaaatcatgtgtaagtacatactggtatctaacaagaagtacccatcaaataaggaagttcttttaaaactatggagatcgatcggaatattcaaatcgtcaaatgtaaaacaggaggatttttagccataatgagtactggattaaaactttctgatcctaactgcataaaattgtgtgataacaatagatggtccatagatatatatgacaacaataactggcaaattaaataatggatcacatcatgatggtagtaaaagatttaatcgttccaatcaagatgagatgattcattaccatctcgatcaatggcacttttccggcaacatgtaagaacttggagcaagacaatgtttgtgttcccatggaataaattaccaggtgccattcactatcttgatatggacacattatttgttctacaattcttaacatagtaaaggcatataaaaatatattgctgtaaatatatactattattgtatgccattctcataaatttattgtataatgcgctcccagagcggaacgttgataaccaaatattgaatcatactcatgcatttatatttttataaatccacccatataaccattgatcacatttatcaatggacgtgtctctcgtcaactctagttggaagtactcattatagtcatagtttc

SEQ ID NO: 43803 - DNA, 608 bp, Oryza sativa
tgctgaattaactaattgatggtgggcatctgctttttatgtatcttgtcgccctactaaactattattcatgcatgcacaattaaactttttcttcttataaacgcattacaaatgtaggcgctcacaacacacgtgcactcacctctatgaacatatacgtacaccctatctctataagcatttcttgaagactggaccggtaaatcttgagattaacgaagtcaccacgaccgtctcgctgtcgacggatacgtcacctaccattaaaataataattagttctaaatatgaacaattaagctaaacaggcacgtggtgaacaaattgatcgaccagtgtataataaaaggttacaacacataagatgccgaaaaatggacgaactaataaaaaataatttataagtttttgtatttgtgttattagtattttaaaagtaaatgctagaaaatagctagaatacagcgaaaagactctaaaattaaattaagttttaaaatttaaatttgtgtctgatatgctaataagtacagtaagggacttaatttgtatattcaaaatgcagtctcattttctttttcttgttccttcttcgaaatttcagc

SEQ ID NO: 43804 - DNA, 1501 bp, Oryza sativa; identical to SEQ ID NO: 31099

SEQ ID NO: 43805 - DNA, 353 bp, Oryza sativa
ctagccatgccctctgaaacacagatacattacagagatatgctagtcacagatacatcacccccccaattaacatcccagatccatcttaaacatcacagatccccaacaacacatatatgcagttcaaatgccacaattttgcacagcaaattcacaccccttgaaagccacaatttcggtcgttgctcatagaaccgcatatatacttaccaaatggattaaagccataatgtactcgacctccacaacctgtcaataagggaaaaaaaaggagaaaacagatgaatagtacaacataaatcgtagttgatcaaatgtgatgacaatttagtaaagtaccataaatattg

SEQ ID NO: 43806 - DNA, 1501 bp, Oryza sativa
aaaaaaatgaaaactataagtcatgagtaaagtactcctccttcctaaaatgatcatcatatatctttatacaccaagaccaatgataatttaaatcacatcaatcaagacaccatgcacacattctcctataatacatgcatcgattaaacactataccaattacaccttagcatgtacatattctcccatgttgcattaattgtattttgataaaatctgtatccatacggttatatgataatcaatttgagaaattttgaattccattatatgatgatcaatttggaaatgaaagagtactattcatgttttatcatctcataaaaacaaaaatactaatcacaaaaaaaataaaataaaacagacaatcaaagttggacacggaaattcatggttgcacttaaaataggacagaggaagtaagtttttgttattgattaatagtattattttttttctcttttgctatatgttaatttatttttttccttttgataaaatgcataattattgatctgccaccagggaagcataaagggtaacacttattcatactcaattttatccatcccataattgagtattactcatcaatgggtaagtgaagagacaatacaaattttaaatataaaaataaagtccaagtagaaatataatttttaaaaaatagaataaaaaataaaataaaataattgaccatgtagaaatggttcaaaatttatacaaagttgctcctctatataataaatcatctcccgaattttaatcagttttttttaatatgaacattagtttaaaaattttaggtctaaattttacacatagcaaatgggttcatataaaatggacaaaatgagtaataccctcactatatccaaaatttaaatggatatattttttttatctatcccctatccaaataaggttgtgttgcacaatggggttaggaacctctcccccacagcacgcaaaacaaaacggtgtattgttagcttaaaaaacttaaaatggattggcatgatgggcctgttcacttaaaaaaagtggctacatttagtttgctgccaaattttagtaactatataagaaatcctactaaaattttggcaagttgccaaaatggtaatgccaaaatttggtaaggttttttttggcatcaaagtgaacaggcccgatgtcttaagccaacttttctctctttttttgcaaaaaaaataactgcatttagcagcttgaaaattagcagcttgaaaatcatgtgcatgaaaacgagaaaatagaagttgtgaaaatggtgaaataaactcagtctaatatgaatatgaatatagggatacccaaggataggtctaggtagaaaaatgtggttgggatggatgaggaaaaaacttgtgagttggcatacccattttatgattatatcaaattcatagtcccatgaaccatccaaacatagtatgttactatgtttcaaatttatgtaggatttgtccatata

SEQ ID NO: 43807 - DNA, 820 bp, Oryza sativa
gccggactgtatatagcgagttatgggtaaggtatgaatgccggttttcattgaaatctcagtttacgtacacacggcccagaacggtaattggcatgttactgaatttttgtcagcagagctacagtttattcacctcttgtcttgtagtacctatatatatgccactttaaaattaaatgcttcttttaaggctatcttcaaatggttttcaactgttcatactggtagtatgtaaataaccatgcatatttaagaaggttaattggatttatgtcattataaaaaataccctattaaaatttatcattacaaaggatgaaattgggtgatataatgattattttgcaaagtttaaaccatatcattatgtagtacgcagtacatctaggatgtctttgttcaagtatttttcatatagactaaaatgcccctgccattcttttcatatgaaccgtattttcgtatatatggcactgatcgatttttttttcatcaattaattataagtctctgttcacatcaacatcatcattaagaaaagacccgtgcatacagtagctccgcatcacttcgttatgaatcgacgtacgttgcacgtttatattactactcttatcagatataattaagagcactgttttattcaggtgaatcaaatcgtattattcacccgacatgcatcctacatatttacttccgctgtcctaaaataacatcgtgtttaccctcctccagtttattccaaattaaatttacttttagcaatcattgtattagagtttgtaaaagtgaatagtaaatacattgaaactagata

SEQ ID NO: 43808 - DNA, 308 bp, Oryza sativa
tttgggatctatgtgactttccttgacctttttcaaccccttctgaaccttcctcaacgtaaacgctctcctccggaatgtcggaaactaaagcaaatgaacaaaatcaacaaaacagtacaaaaacaagcataaacagtacatttggatatttttgacatgtagatctcgattttagatgaatttagcaacttgaaccactcgaatccgagttacgatgatttagttatgaatttccgaagtttaatcgattttcaactaatacagaaaattattacgaattaaataaaggattgatgacgtcacga

SEQ ID NO: 43809 - DNA, 415 bp, Oryza sativa
cattgaacaaaatctcatccattccattgcatcattcattcatccattaactccaccattccattcatcggcatcagagagagaggggtacctggagaggagacgacgagcagaggaggcggcgcacggcgactacgagtcccggccggcgcactgtggaggtcccagtcgagaggaggaggtggcggagaggagatcccggtggcggcgatgatggtcctggcgtggcgactaagaggaggtcccggcggcggtcgagagagtgagtgaggcggcaccagtggagagggcggtggccaggagggcggtggagaggtcgaggcggagatggagagggcggtgtagagggtggcagatggcggcagagagggcggcggagatggcggcggagaggtcgagacggcgacggtggaga

SEQ ID NO: 43810 - DNA, 1501 bp, Oryza sativa
gtcgccgactactactcctctctcgttgccattcatcacgctgtcggctacagcgtctctctagcttgccgctgctgtttgggcaccgcagtccgccatcgtgcccggccatggccactcctggctgctctacaaattgcaggttcatcaacacttgtgcgtgcgtctggcttctgcaccaggcatgaagctgccgtcgattcgttccctgcataggtgtgtagctcaccaacatcaatggtggaaactacactttcttgccgaccatgttgaagagtgactagcatggtgtggttgttggacttggcaggcggcgtcctcggcgataagaccaagcaggcggaggcggcggcggcgacgacgactgaatggtcttctgggtcgaagatggagaacgaactggcgctacgaacgattggtgccgtcagatgcgctacgaacagtgatcccgtattggacgtccctctgacgtaggatctcgttccgtgttctatggtagtcttttcaccgtctctagccttgaaacctcaatcctaatatgaaggaagcctaccgaggcttgcagaagacatcgccgttacaagttctcacttttcaccgtctcctctcggatgttgatcatttgcagcacaggacagagctgatcctgtgtgaacggcattatgagtctgctacagtaactactgcatggcacagtagtacaattcctgtcaatacagagattttgtgtgtgtttagttcacgtcaaaattaaaagtttgattaaaattgaaacgatgtgatggaaaagttggaagtttgtgtgtgtaagaaagttttgatgtgatggaaaagttggaagtttaaaggaaaagttgggaactaggcccggtttaaatcccaccaaaaaatttttaccctgccacatcgaacgtttagacgtatgcatgtagtattaaatgtggacggaaaaaaccaattacatagtttacgtgtaaattacgagacgaatcttttaagtctaattacgccatgatttgacaatatggtgctacagtaaacatttgctaatgacgaattaatgaggcttaataaattcgtctcgcagtttacatgcggattatgtaatttattttattattagcctacgtttaatactttaaatgtgtgttggtgtatccgatgtgacacgccaaaaattttcacctctgaatctaaacacaccctaaacaaccaaactcttttggtagtgtagcgatgtaatctaaaccgttagattgtgatcatgtggttaggagttgctcaaatgcacataactgctcattctcaacattctctacatagtttcgagtattcaaatctcaatgcatatggtttcgagtattgaatcctatggaagagctgagtaaattgaaagatgccagtagttcatagaactagaaatactagaacacgtctgatgcttaacgccacaagtacatactgaattaaaaggccacagagaacactcctgtagtcattc

SEQ ID NO: 43811 - DNA, 1501 bp, Oryza sativa
ggctgaagcggagagagaaagaatgatgaaagtaccaaaatgccccctgcgccgatttgcttgtaaacgctggtcgacatgatttaacgtcacaactttcaggcaccaaatcggttcaatgatggatcaacaatcggctggcttgtatacacacagaagtacagaattggacagaatttatagcgttcatagctttcatataattggtgttaataaactgtcacgtatatgtacttaggcgttgtgtaattagtagccttttctcgcgcgcttcagcagcacggccgggacgaacggcgcggcgaaggcgtaggagtcaacggcgacgacggcgcacggtactggcgcgtcgggcgccgccgccgccccggccacgagcgggccagacagcgccacgacgcagagctccgcgagccgccacacagcgccacagcgcggcggagccaccggagcctgagcagacgtaggcacagcccgcggcctccaccgccgccgcccatcctcacgttgctgcatctgcctccgcggcctcgcctgtgactgggttacgcgttgacgatgagcccatgtacaatgattgatccatctcgcttcttgattcttcccctgctgctcgaatcaaccgctcgattccaccgcttccaccgctgctcccctccatcgtacttctctgctcgaatctgctagcggcccagctcgccggccacctcaatctgccaccgtagtcaccggagctcgccgccgttgccgcagatcgccgccgcacctaaccctagggtttggaggataggggatcatcagactgaatggggaatgggtctgttcaaaccaactacagcgggctaaacactattgacccaagggcaaagttgccttttacaaatatttccctctccgtttcaactagaaataataaaataataaaaggagtgtccagcagctaattaccacatttttacagtgtccatgaaaagattcacgttcttcgggtgtctcatagcaaagaccataatctttgaatgtcttatagcaaattttatctaaaaaatatcctgcgatgagctaatacgttgaatcagatgatacaacttctttttcagtattaccaccatcacttcaattatttggcaacatgccaacatttggtttgccatgtgatactagaatgcagaaagtatattctctaatattttgctatctcggccgttggagctaacatcaggaacttatttgtattttacctgttaaaacaatttatcttaacaggtaaaatacaagaatcatgtggcattattcagcaactcaaacagtcattttttttcctgctacatcaaccttacttgtgctactgattctaagaagtactccctccatttcagattataagtcattttaactttaatcaaagtcaaactgctctaagtttaattgagcttgtaaaaaaaggtagtaacatttttaatccaagacaactatattgttaaaatatatttaattagca

SEQ ID NO: 43812 - DNA, 439 bp, Oryza sativa
  unsure (1)..(439): unsure at all n locations
agagggacagctaatatgtantggtaatttaatttntactttcacatttattatatgttacgcagggatgagtaggggtaatttncctgttcactactcaccccccaggatgatgtcagtctgcatccagcacngacggaaacagnntaatngaaggaaacacaaagaaaaaacancaanccaattncggacggccgcgaacactctagaaatctttctttatgttgggcccataaaaacctgggcccaaatcttaataggccgggaggcctttgtgatgatcgggccggatccaggcccataaaaaacctgggccaaaagctgtttgacctcctcttcctttctatttctttcacacagttacctttcacctcgggggcgggcggcggccggcggctaggtcctgacagcggagggagcaagcggggaggaccaggca

SEQ ID NO: 43813 - DNA, 433 bp, Oryza sativa
ttggcaatccagctcggtacccttcgtactaattacaaaatacatgtgcatcataatttgtgatcattttcatggagactgatctgcctcggtgagctcgattgatgccatccagatcctaattctcctttttttttccaaattacatgatacatgtacaccataatttattatcataaattattagatcggtttttttcatagagagtaatctgagtgtgaacgtgcaaacgctaggaatttaatttacaatacaagtgatttggtgttgtaaataaacaattatttttatagacgatctacgcatacactttagcagctgtagattgttttaattaaatcaccaattccactgctatattagctatatttttactactatatcatattatatcttatgtgtcatttctaccaactcttgtaggccaccaag

SEQ ID NO: 43814 - DNA, 1501 bp, Oryza sativa
ggtcagaggctgcattatatagtccatttggcagagtaaccatttccctccaggctctagcaatgtgtgcaatcagaggcttacagatccatggacgacgacttgtaagattcctactttccagagttccagtggccagtgtttggaactttggatcgagtgaaccagatggcctagatttcaacgtcttaaaaaatttgcaaaatttgcaagcggacaaatcatacaagtttgaacagagaaccaatggagaaaccaccaatgctacactgacaacaagcgatcgaaacatcacagccgcgctacctctcaaactagaactgaacgtacacacacagtctcgctacctagtcgctactgcaagtggaacaccatgacacacgttgacaatacgtatgtctagttgcctactttaattattccttccttgatcgatcgatcgatcccgcgcagtcacgcacctcggcgcgcgtgccgcatgcccggtcgccggcgtaacggccggccatgagctgccggagtagctagagccagctggttagccggaggggcactggccggcgttggcggggccgtagaagaggacgctggtggggcagtagatggcctgcaggccgacgggcgggacggtcctggtctccttgaggagcgagaggccgatccacttgtttggcgggtagacgggcttgtcgcacagcgacgtcggcgacgagcccaggaacaccttgcaggtgcgcgggttgaagttgcgcaggtcgtagaacatcaccaggaagtagccgttcgcgtccgtcaccgtccccgtcacgttcaccaccttcttcccgtagcacaccagctgcgccgtcgcgcctgcaccgcaccacgacacggtcagaaaaaaagaaaagaaatgtgtagcaatgggggacagagggagaagaggatcctggatgcgcacctgggagaggtgacgcgtccatgtcgctgctgtagcccctcgacttgcacgttttgcagtagaccacgccctccacgatgatgaacggcagcggcggcggggccaccggctctacggccgtgtcgttggaggacgacggggccggcgccatggccgtgtcggtgtagggcgacggtgccggcgccgtggccgtagcagcggacggcgaagatgacggcgccctggccgtgttgtctctgctcgagacgacgtcctcggccatcgcatggtgcgctgggagcagcaatgcagcggcaagcacgagcagtgccgagcagactacggctgtgtggctcctcatctttgctgaactccttgactttcttttgcttggcgctaattttagttaagttgcagtgtgtgatcagcgttgctccggcaccggctaatttatagggcgatctgggtctcgacttggccttttactaatttgcagtttgaccaaacaaacagcccggctaaatcagattccgttcacagttaatgcgtttcccgtctacgagagtagcctggggagcccgg

SEQ ID NO: 43815 - DNA, 1501 bp, Oryza sativa
gtcaggcgccgcgtgcgtggcttttgcttcgctgcaggggtggtagggagcatggctgagagcctgagacggtaatatgtacgtgacatttgccaaagcgacggagacgcgtcgagggcacaggcacagtgggttgcagggggggagtctgttgctcccgcttacgttgtactactactgtactcctgcggggcagcacgtcgcgactatagctcgagagtacttctactgcattttgttggtttcgaaactatctatcggctcaaagcccctcaagcgcgctgaagagccatcccagtatggccttgtttaggcaccgtttagttttcaaaaacttttcacaaaaacatcacatcgaatttttggatacatgtatgaagcattaaaaatagataaaaaaaaactaaatgcacggtttgcatgtaaatcgtgagacgaatcttttgagcataattagtccatgattagccataagtgctacagtaacccatatgtgctaatgacagcttaattaggctcaaaagattcgtctcgcggtttccaggcgagttatgaaattactttttttattcgtgtccgaaaacccctttcaacatccgatcaaacgtctgatgtgacatccaaaagttttaattgaggaaaattttaagtttgtttgtcacatcaaacatacggacacacatttaaaatattaaatttagtctaataataaaataaattacggatttcgccagattacggatttcgccagaaaactgcgagatgaatttattaagcctaattaatccatcattaacaaatatttactgtagtaccacattttcaaatcatggcgcaagtaagcgtaaaaaattcatcttgcaattttacacgcaatctatgtaattggtttttttttctaaatttaatactatatgcatgtgtccaaacattcgatgtgacaacgtgaaaatttttattttggtaactaaacagagctatgccactgtacgtgtagaccgttacattttcacatagaacataaatacgtttttcagttcctaagcacactcagtattaagtatagtcgtatactatttgctatactccgtttcggtaggtctgagggggtgaataattgagcacacctgggtgcaaaattgataagagcatcctcaacagctcatctaaattccatcttctatactcttatttagatagtcatccaaaaagattcctactctatattacttttcactccaacagatcatccatattacatactatattttactaatttttacaactaccacatatgtatcaccactctaacaaaatttcccacctttatctcttcactccccacctttctctcttctccaccgctgatctccccgcctttctctcttctctaccgccggcgccgagaggacggggaggacgagggccgaccggaggggcggccggcgggtccatctccctcctcctcccgccgatggcccgtcgccaccaccacccagtc

SEQ ID NO: 43816 - DNA, 1501 bp, Oryza sativa
ttggtttcctaaactgaaaaaaggaagggaaaaaactcctccctccaatagatagcctaaattcattccctaaaacttaaaagtttttttcttccacgcgcagaaagatcgctatcttccacgcgcaggaacgggaggagagagaggcgggagtgcgagattgggagcgactttcgcgagaatgcacgcccgcatataaacggagtgaggaatcgagagaagggaactccaaaactcgggtagaagattaggggatttgttagagcagttttttagactaaaatcccttaaaatcagttttaggaatcagatatgtagactgttggtgatgctctcaagtcaagtagcggacgatatgcgattttttttaaaaggaaaattggaaactctaccaatcagttaagaaggaaattaagtgaagtacatgtccacaagatcggtccaccggccaggtcgagcaaatatatactatataatatatacactacatattatggggtacaagaatggatactttcgggaaacaacctctgcgcaacgatcataaatttctaccacaacttgaaatcttgaataatggccagtagccaagtacattgtcggtgtctgccgtctgcgtggcatggcactgctgaacgacgcgtggtcgatccaggtacatgccattcctatgtatgcgaattatgagagcagaccaatggtaggtgaaacaaagaatgcatgaactatagcagatatgaactcagcagatatgaactcacgagccatgacccatgagtgtgttgaagacgagagcctgtacatgtatcggagaagaccaaagcaatgttgctgttcatttaagggaggaagcaggtgaggaaacaacattaacaccactgagcacacactgcgcgtagcaaaaatgagcccatcaccacgtcccagcgtcccgctccgctcttcgcggcgatgggcagcgccgtgccgacacgacgccccgagatggctacctagctgacacgcaacgccggcctccggatcgatcagtaaagagagtgcagtgcagtgcagcctcgtgtcgtcatgcacctggaaggaaaaggttactgtatttctgcttgtgtgcgcgattttcgctgctagctggcaatcgtgggatttgcagcgtactgtgcaggcccagtgtaactcgacgccacgccggcccatcgtatttaatgagctgagtgtaagcaggtacacaggccgcccaactaacctccttcacggcgcatttacgcttgggcatggccggtgtaaccgtgcaagcatcgtagtgccatcgatcgctgctgtaagtttgtaacatgtgcgtgtcctgcggagagttgtgtgccgttgtgcatggaatggaaggcaaagcataacatgggagcttttcatataaaggccaccagcacgcgggctgccacttcaagcttcagctcgtgatcccatcagatcagcaagcagtcgcgaaatggtgccgatggctaaggct

SEQ ID NO: 43817 - DNA, 1501 bp, Oryza sativa
gcggtggtggtagccgccatgggtggatccgtcagcggtgacggcggccgagggcagatccaacgccggcgggagtgaagttcttggaagttctttgatgttgtgattccatgattccttttgtgattatgtgatgatgattgtggtttattttaggggtgcaaagtgtgattgattcgattccaagtggaatcggtatgtgactattgacttagtgttcttgaatgtttttggatttcttggattgatcggggtgaagggaagctactcggctcggtgcatcagctcgcgtcgagccgatgcatcgaaccagcttttttttattcgtggaacctcaaaggtgtcggttctaaactaacaccagatccggcacctatttgattttcacatcagtaccgccctcgtgatgccggttgggaaaaccgacacctaaggggatttctgtagtagtgaaaggggtagaggcctgttaaatatgtgatctgaattttagacttgcaatatattcaaataagtttcctaatagaacttgactattatgattagttccctagtatgacttttaagtctttcctcactaggacttctagatttctcctatatatatcctgagaaattgtaattattgaatttaaaaaataaattagaagctagctttctccgttttttagatttatagaaacttgttatcaaaccactggttcttaggctgcgttcaacaaatgcagtcagagattagttttcgtagcacgtgaaaagagacagaccattagcagataattaatcaataattattattataaacttaaaaaatgatttatttttatttttttaaagcaacttctataaaaaaatttcttgcaaaaaaacaacccctttggtagtttgggaagtctactaacgaaaaacgtggaagttataatttaaagttgaaagatagaatggggcttagaattttaagctattctaaaaagggcatgaagtcttttcctgctgaagcggaaggaataggtagcagcgctagcgaagatagagatgctaggccaggcctagctatagatggccaaatgggccgcccgacccggcacagcccaggcatgactgtgcctggccgaggccatttgggccggcacggcccaacatacacgtcgggtcatgccgcgctagcccacgggctgcacatacgatttaggcatggcccaataagactttggtcgtgccgggccaacccaaaggcacgacagcccatcgtgcttctccacagaataggtatattgttcatccctcaactatttgggctttgtctatattgctggaaaattagtctattttgtattcctcttctctttgggccttgccttatatggttgattaagtatattttgggtccctctattatttttcttccatcgtgccgggctatgccggcctatcgtgccgagggaacaggcccaggcacggcacgattgtcgggctaggccggcacgggcacaaccctagt

SEQ ID NO: 43818 - DNA, 232 bp, Oryza sativa
tgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctagg

SEQ ID NO: 43819 - DNA, 164 bp, Oryza sativa
catatgggaaaaaattagagcacaatatttcattataatgtaaagaatcctggtaaacataccttagaatcaagaaaagttgtactagctcttgttgcttattatgttataatgtctattctgttggctcctttgacaaatgtgtgctctgatgtttgttttgt

SEQ ID NO: 43820 - DNA, 1501 bp, Oryza sativa
caacgtcaaatgaaaaaaatagatacttcctccattctcatttatttgacaccggttaactaatccacgttaaaaataaaaagagatagagggagtagattgaaaaacacaatagccatttttcattcgcagagcgatactagaactaaccgagaagagacataaacacaaattatgtcagacaaatttacaaattcaaaactcaaaaattgttacatgaaaacatgctccactgagtccaaaaggttgcatcatgatgagatgcaatggcaaccaacatataatattacaaacgaacaaacacaattttacaaaccacatgctatgacaccacgtcaccattgatcgcctaataagaaaaagggatcatctttccagtcaaaacgcggtaaaatttatcgtaaagatatgtttttcttttaaattaaattaatggcgtcggtccgtgtcacaggccgacggactggagcacggcgtagttgacggcggtggtggcgccgtcgacgacgaggttgtggccgctgacgaaggcggcctggtcggaggcgaggaagagcatggcctccgcgacgtccgccgccttgagcaccttcccgcggagcacgttgtggggctccgccgccgcctccatctcctcggggctcatccccgtcagcccgcagctcagcggcgtcgccacgccgccgggggacacgcagttcacgcgcacgccgtgccgcccgagctcgccggccgccgcgcgcaccagccccagcaccgcgtgcttcgacgccgtgtacgccgccggcccgaacccgccctggcacgacgccacgctcgccgtgcacacgatggcgccgcgggtgccgcgcgacaccatggcgcgcgccgcgtgcttcacgcacgccgccgcgccgcggaagttcaccgacatcacccggtccagagccgcgaggtccatgtccacgacgggccccgtcgggagcagcacgccggcgttgctcaccatcacgtcgagccgcccgtgctccgccaccgcggcggccaccgccgcctccacctgcgcctcgtccgtcacgtcgcaccgcacgtaccggcacccgccccccgccaccgacgccgccaccgcctcgcccagctcgtcctggacgtcggcgatgaccaccgtcgcgccgcacgacgcgaacagccgcgccgccgcctcgccgatgccgctcgcgccgccggtcacgatggccaccttgccgtccatcctgcacgcccccgctcaaatccatcaaacgaattcgacccaaaccaatccaacatcctcaaatctaaaaaaaaatcaaacgaaaaaaactactagtagctgcgagtgactcaccttgtcttcgacatgatgcaatgcaaaagctgtttcgtgtctgccttctgcatcgggatgtggttgtttatatagtgctcaattcgcttttaaaagtcgtcaactatgccaatattttactcaaaagcaaaattctttttaaaattcagaggaatg

SEQ ID NO: 43821 - DNA, 863 bp, Oryza sativa
agggggatttattttctttagtttttcttttagtaaactttgttaattgtttttgttgcttaataattatttccggagctctgaaaattcaagtaaaatttgagggctccttttaaaccaaggagaatttaacaaaaattctccggaccacattcgaatttttctgatacgtattttagtgtttgccaatttcttttcgaattttaattaattctattattccttttagaaaataatttttaattttgggatgaatttatcaggatgtgacacttgccccataagtaaaccgagccaattcatctctctctctccatgttactgcacctttttttcttactatacatattcttgcagtaacgttatcaagtaatcgcggtaacacactatgttactatgaaacttataatcgttactacatcttgtagtaacggcgttacatgattgcagtaacgcatagcagatcagcagtaatacttatgatatagtatcgtggagagccaaatttttaaaaaaccaatctttgaagggtaatatctctcacatcatgtactacttttaaaaaccatttgcaccatgatgttagaaaaaaagtgcttatcaaaagtagatccgtcatgattatattatgactacatttcaatattgttactgcaagtaagacatgatgttactgcacgatgaacatcgcgttactacgttgttctgagacgagagctgataagagtggaggtggtggggaaagtgaagggcgggtttgaccgagatggggagctttgaccgaggtgtggggtgggttttgccccctggaggtaggggggtatagaatagttattctatacccgggtgtagaatagtttttc

SEQ ID NO: 43822 - DNA, 1501 bp, Oryza sativa
  unsure (1)..(1501): unsure at all n locations
gttagatcaggatcctctaaaatatataatatcttattgatgacttaattgtgcctaacttccacctaagctgcatatagctaggaaaggaacaacaaagctattcgtctagatataggtagttttcatctttacaatatatcctatactaatcgagtctctttctctcatacatcattacgcctttcatgtaggtgtaaacttgccttccatgtagatgaaaacttacccgataaagaattttggcgtctaaggctatgtttgagagaaaacagaatgataaaatgaaaataaacgtaaacgagtaagccattaacacatgactaattaagtattaattattttaaacttaaaaatagataatgtgaactttctaaagcaactttgtatagattttttttaccaaaaacatatcgtttaatagtttaagaaaagtggtggnngcgtggaaaggctagggactttctagctttatgtgtacgtcatctctcgaacgcaacctaaatattgttagttggatgatttgcagacacctggcactattaacttctctacctttttaccttgacattaatgtattttagggctcctcgttgacctgatcgaaggaatttaaagtattctaaaccttaggaatttttactctatatgttgtttggagcaaaggatgtgagtatgttatatagcacgtgcattgttggatttagaaagggttccataggagaaagaaggtgatagagccgactgtatacattgcaaaattctccttattgaattaagcgtagtgacaggcactagtggtagcatccggtttcagttaaggaaaagtatactgaacccacatgtcagatatcattgcgctcacaaagaaagtgatcaatctctatttcccttttttattcacgtgggtcccacccatggtagcttgtagtgtgattctatacgtggtagtacggtggtgtttgaatctactgaggatgaagatgaagataaaaattaagtgtttcatgcaaaacgatatggtaataatatataattaattgagttttaattattataaatttgaaaaatagattaatatgatattttagagcaactttcgtatataaagttttcgcacaaaatgcaccatttaacagtttgaaaagcgtgccacgagtatccaaaatttaatcctccccgtacagaagaaaccaatctctatatgaaatagattcatatagtaatatacattttattcttttcataaatatatgattgatttgataaaaacacaatgaccaaaagcatgccaattgcagagatagttactctcactggtctccctctcccctgcggtgcccctgcccggccgtctatatataatgttagtacaggtgcaacactagctcccaatacaactagctaacttaattagttgttaattagagtttgcccatgctgctttaatattcgcgctcgatcgaacgagttgtagcagccatgtcgtggaaggccttca

SEQ ID NO: 43823 - DNA, 1501 bp, Oryza sativa
gccagttcggtctgaatcatcgtaggccttgggttaaggcaggttcgtgtgggtccacggccttgattaataatactgtgtagctctaggatcatctttataaaatagctttgggcaactaaatgacttttaaatgctatttactacaaaactaaacccctattattatctccttgtactcccttgcattaatcatgcatctcccggtgtgacttgctgagtacggtggttatactcattcttgctctatctttccccccttcagtaggagaagctttggagaagaagtcttaggtggagtcctggcttataccccagttgagcgcctgtgaagatggagccgtaggcccgctagtccgctgctgtttatttttgtttgtcaggcctcaagtgcctttgtaataatgtaaatattatcgacataataaagatgtgccttttgtatcatgtttgtttggtgtaccccggcttttcctgggacggggattaatacactagcgttcgggaaaaggtaattttctcggtcgcgacataatgaatgcatgaaatagtaatttcatgttttagggtaagccctaaaccctatacaaaaaggtccccgggcattaggggaattgcttttaggtccataagcccacatggcaaacaaagcaattttacaaaaagaaccttacaagatttcaatttcaactaattaaagtccttagcacctaatgaagtggctaaacagccgggcccacatgtcggtgactcggcggcaagagaagcagaggcagcaggagagcaacggcgaccgacagcgttcgtggcggcgtattggcttgatcatatgtgggcgtcgttctcctgggaccaaggcgacgtcagtggcgcaatggtacagctggagatgattcgagtcgactggaatggcaaagtggggcgatggtggcactctggacaccgggaacaccgacgagcgcaccagcaagtgttcgatctatgccaaaaaagaaacaaagaaaatggatcgatcaagcagagaaggaacttcatgaatcactactacagaaacgattttcctggacagggaccttttagattccgtgcgggcggtatctcgttgcttctgggaaaaccagctcattttcgcgtgcggtccattaaagaggacggcacggaaaaatcaatttttccgtgcggtaactcatttcttctgggaaaaatcgatttttccgtgcggtcctcttaaatggacagcacgcgaaaataagccgattttcccgtgcggacctattaagagagccgcatgcaaaaaatactaactccctctttcctctctaacccactttaaaatttcccctctttctctcctctcccctcccctctatccctttttccactttaaaatttccacgcagagcttctcctctcagtcctttctctctcacgcctctcctctcctctctccactctcctctcctctcctcccgacggtggcagcggcggcggcgcgcggcga

SEQ ID NO: 43824 - DNA, 721 bp, Oryza sativa
ataggcatgcaaatcaaattaaactctgtatcatatcactaactactactcccccgttttatattataagtcgtttatttttttcatagtcaaagttactaaatttatagaaaaaatataataatattttaaatataaaataaatatcaaaatatattcaatgttaaattatatgaaaataatttagtgttgtaaattgctaatttttttttctataaatttaattaaatcaaaagaatttttttaaaaaaaaatcaaaagacttgtaatgtgaagtcagggagttctggctttgatcatcaacactagatacggagtagtagctacgaagagatatgcatgcataacgctgacgtggagtaaagtagtttgcatgtgacgacacatgcatgcatgtagagtgaattaggaagtagatttttttccctcgagggacatcactcgttttgcgtacctatagttttaaaaaatacttttaagatagatcactatataatatatcttttcgtaaacatattagttaaaattcaacttatataatataaaacaaaaataacaaatttgactatgaattacgtgttcacttcgtagttaaatttattatttttgtttttatctatataagttgaatttgaattgaagtggcaaatcatatactgacctatcttactaaatttttttaaaaattttgatgactttttaagtgatatcccctttaagg

SEQ ID NO: 43825 - DNA, 1501 bp, Oryza sativa
tcgttctcgtcgtcgacgtcccgtcgatcgcccggcttgtcgtctggctgcgctgccaccatcgtgggcatcgctgcggcgtgtcccacgccgtcctcacctccgtgcagctgctgccggctgccctcatcgcctccccgtcggtcgtcgtcttcctccttcctcctcgtcgtggcgttcgtccctccgtcaagccgatcgcgttcgccgcccgcgtttcgtcaagtgtgcagcagccccgtcatcgtcttcgtcctcggctccgcgtcgtcaagccttgtgccggccgcgtctcgccttcgtccaaggatcgctgccgaagtcgttccctcgccgttcgcctccgtcgtccccgagctgtctccgccgcgcccgtttgtcgttgtcgttcccacgcctcgtcgcgtggtggtaaggatctctctcctttcgctgccccgtcctcgtcctttcggtgtcgcccgtgcccgttgtgcggttgtcgaccccggtgcctgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttggcacacggggtccgcttccgtcgacccgtggaccgtctctgtgtactcggtctactgtggtcccttaggttgacatgtggggtccgcatgtcaacagcgcagccttcctgtcttttccaggctagcgcttccacatgttttatagttgcaaagcctaattataataatccgtaaatctccatgtaacagcattaaacttcggatgaccatgtcttggtcatacgaactctaaatcgacccgttcaagtctcctaatgtttgttataacctaaagaaccgtgtgctttctttttatgtattgttatttcttctttataggcttgtagctttgcttgtgtgcttcgcgtagcttctatcgttccggaggttccagaagcgtggttcgcgggtgtcgccgaaggttcggaaggccgttctctctgagcaaggcaagtcacatcatccttgagcatattgaatcccagtttataaaattattttgatttaaattaatgcattaccgctttatcactgttttatttagccatttatatttacctttgttaagacattattattgctattgttattattacctatttcaccctagaataaacaaaaccccaactagtgggtactctattcatggttccactagtatgaatttaggtagatgcttcgctgattaataggacaacattaggtggtttttataactttagactttgtgaatattcatatctcttggatactatggaatggttggcttatggtggaattggacatacccctctcttcctctttcaaaacccctaaaacctgttttctggtggggtttgggtgcatgccagttgtgggaagtagcaccccggccaatataaggattaa

SEQ ID NO: 43826 - DNA, 1501 bp, Oryza sativa
ttctggtctccagtagcaggtcaggccaccttttcgtcgagtgaaagtcacaggcttttagctgataataaattgggccacctttgataaccatccgaaaaactagtgttttaaaaaaaaaacccatcgcatgtgccaacatatggattatggcctatacatgttattttcatatttgatgatattttgcaactcacttgtctctaacatggcattttccatttttttctcaaataaatttcaatcatttttcgtcaagctttagtcgcgagaactgaaaaataaattcatcgatgtccaggtaatgctgcatatgcaccaatgtaaggatttcttttcccccaatgaatgtcaaattaattgaatgtactccctccgttttgaaacggaggaagtacattttaatttgcacacgtacttacacaagagtctctgaaaaaaacgtgatattaatttcaaataaatttatactattgtctagggcagaaactgaaaagagaggacaacaggaaggccacacatacttttcttgttacaggacacattgaagttgtattacaccggagcagcagaattgagacctaactacacgtggattttaaacatgacaaagtcagtcagaaaaataatcaataaaactcaccccttcccttaaaagaaaaagtcagtcaaggcaagcatcacccacgaaagagaaaaaactcaatccaatatttcccttcgccacaattttcttcttttttttttggcattgatatcgattaggctcatagtactgtaacttaagcaggcagtgcatgtcattggatgcaaatcagatggtacagattgcatgctgtactgtgcatagtactgtagcaaaatactgtagtgtgaagcactgtagctattactactgtagcgctcgctctgagccgttgatcgtaaaaatggatggccaaaattgtgtgcagttttatcttataattacaagtgtaactgagtgtaactgcacccgatctcaattctctaaggagtaacatgatatctttagggagaaattatatcctcacacggtgaacatgtcgatcatgtctgcacgtggataagcacgtaaccttaatcatgcaggcgtaaatgcaaattaggaacgcattaagagaaatgtttttgtattgtgtatgtattatctcgactcgatccatttctcaagttgtgataaaaattttccgatgcattcattgcaagcagcaaaaccacaatgacgaccaaaaaaaaaagatctgactggcgaacgaatttgcgatcatatgggaaatcaatgtcaaactacagttagttagtttcctttcatttatgcaaattaaacaggagagttagtttgcttatggtgaacagtgcctgtactaacaaacacgctgcaatggcataactgatgttagttaaaacataaccatagccttatggtgcacgagacgcctggaagaacatgacggtctctaggcacagcaaaatcaacagt

SEQ ID NO: 43827 - DNA, 1501 bp, Oryza sativa
atatatccggaatcgcattcagaacaaatttgattctaacaacgagcacaaggcacaaatagaaactgtaacagcttggagaaagagttgcatcctcgagatgtagtttgaattcaagtaaaaatgtctaacctggaagaggtcggagagcaggatggcggcggtgacgccgctggaataagcgcagcacgacttgagcacttgcgccaccgcccacccccacggcggccgcgcaggcgctggcccggcgccgggggactcgtcgccgtttcccccggaggaggaggaggagagcatggagatggcgtagtcgacgaactcgaggaacgcgcccccatcggcggaggcggcggcagaatccatggaaccctagacaggaggaaggcgggggagacggcgaaggcgaaggagacgggcgcgaaaaagaaaaaaaaaaacgagatggagaggagagtgaaggaaggagcgcgggaaaagagagatcacggatacgcgcgcggaagatactgctgctattttacagcgagtttttgggtcttgcaacgttggacaccgaaatcaacgtcttaaaaacaaaaacaaaacaagaacagaaagtacgaaataattcggagcagtttcttataaccgtgtaatattcacaagcacaaaacttaattctctctctcagtattttttaagctaggttttcctacctacaaaaacccatggtccgtaattacaatcattttgtttttgtttgagataaatataaaattttaaaccatttcaattcaggtcctgtttggcacagttctagatctcaaatccgcagtaaatttgaagtttctatattgaattatagtggctcaaaactttaaatttcatacaaaatgagaataaaatgatttatcctaatgttatcaatgtaatctatggatttgtggagcaagaaaaaaatcttggatccagaactgtgtcaaaaaaggcctcaatttacggactccaaatccagtgtgaatctgctaaacagagccaacccatctatgcctcctcttgtttcaagttatccaagtctcaacttaaaaaattcaagccgaagaggactgaaactaaggcagtcacctatgcatatgattatgagtgaaatgcaccactaataccacaacctgtaaggtgggtgcaatttagtcatccatcttataaaatgctcaaacaagtcactcatcatgttttaggggtgcaaataatataaaacatgcgtcttgtgggttgttcgcaatgaaattatgtgctatgttaatttattttgtaaacatggtcacacgattcataaataagccaacatgcaatactaccaatagtaaaatccaattaaaaataaattttgttattgactgccaagcacaatatggtcgtgtatatacatgaaaaatatgagcgttaatttgtaattttaacgcttgccctgcccacatggctaaaaaatgcatgatgttaggacaatacgatctccaatttg

SEQ ID NO: 43828 - DNA, 1501 bp, Oryza sativa
tggtttcagaaagagctggctgcccagaatgaacctgaggaggacatagaccctgatgttgctgccatgatgggtttcggaggcttccgttcctcaaagaaatgaatgatccatggcggcctttttttgtgacctgtggtttctttcaggtcgaagagtatatgcacctggattacaatatatatttgtttctaaggaaccaggacaagagttttgtgcacctcttgatccaaagctgcgtggaagtgattgaaaataacttttgtaatcgctaccagatagtattttatctgtaaggatgcatgagatgtcgaaacaagtttaatctgtgtatttcggtatccaagagtgaatggtgaccttgctgtaattcgattctcgcttatgtgaatgatttctgaagtgttaaaattactctgaactttcgaattaactcaggtttctggcaccaaattgtgtatgccattgcgttcgtggtagtcagattgcaatgtacaagcataagtgaacgggtgtactaatagatttacttcagttattgaaataataataaactaatactctttagttaaactcagttgcgactgtcaatgatggtaagctgatactctttcagtcttcactcgcaaagcgaacaaagccatctgcacaagttcataaacttgctaatttgatcaaaacagatcagcagctcttcccgcctaatttacaaatcgacaatagtaaaaatttacaataatatgactcttgatgtaaataactttttttccctttttctcttaactacttatacttactctttggtgtacgcgtacatcctcttcctcatccactccgtattaattgccttaaccttgtcttaaacaattacatcatgtaagagacctctttgccttaacctttttcacgaatgcgcaacacgtcaatatattagaagaaaatagttatagttacacaacgcaatcagccagaccagcttatgccagaggaagggagaaaaaacaaaatgaaaagatgaagcttagaaaaactacggtggctaaaacatagactctaagcaagtaggcagcgggaaggggccgagccacgttacactcccaacaagttcctaaaagcggcaacgccaactaaagaccatagatgaccctatgagtggatggactctagcaccattgagaccaaagagagcttatagtcaaaaaccttaaagttccgttacttccacagctgccaagagaccaggagtaccagggagtcgaaaccaacgcgaagatgcttaggcaagcaagacctggaagatggccactagttctaaaaccagctgccacggggtggagagagggtagcccagcctttgccttaaccttgttaattaacagcttgtgtgttccttattccccacgttacgtccaccctttgtttcccgccatattttcacaaatccgagtccgactccgagtgtaacaccgagttccaaaccttttggagaaaccaaaatcaa

SEQ ID NO: 43829 - DNA, 1501 bp, Oryza sativa
gccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatcaattaattatcataacacgattaaccatcgtaagctaccactaaatataaccataagtaatatcgtaatatgattaaccccattgatgagctaatgtttctaagcatggctaagcaattatacctatatagcacttagctgaaccaaaccaatatataaggtccaagctattcaatttattacccataggaaaataaagtcattgtcggccattaaataactgggaaaggctcaccacccgacgacattcgaaaataatgcataagttgaaataaaacattagctttaaacatgttcaacatgctaaaagcgctgtttgggatctgtgtgacttgccttgagcttcttcaaacacttctgaaccttcctcagcgtaaacgctctcctcgggaatgtcggaaactaaagcaaataaaccaaatcaacaaacagtacaaaaacaagcataaacagtacatgtggatatttttaacatgtagatcttgattttagatgaatttagcaacttgaaccacttgaatttgagttacgatgatttagttatgaatttccgaagtttaatcgatttttaactaatagaaaaaactaataaaaaggatttatgacatcatcgatgacaacatcgctggcca

SEQ ID NO: 43830 - DNA, 1501 bp, Oryza sativa
ggccaacccttctcgccatcgaggggagtgggaagggaggaggcagggaggctggcgagcgggcggaaaagaaatgaggccagcgagtggggcatggagggcgggagacgaggagaccggactaccccgcgaccgtcgccttcagacatcgatcttggcgagcaggcatcagggaagcccggaagggcacggggatcgtcgtcgggccaaaggtggtcgtcgcagcagcaggggaggttgggctcgttgtacttcggcgggagcggctcggacgactgtggcaacaacggggatgactccgatgactctcctggcctcgccgcctccttcctctccacacgctcgtctagttttgactcaccgaccattgcccttctccctctccgtttctccgtgtgctctcgcacgtggagatagagaggagagtgggacccactaacatgtgggtcctatttttatttttccttttgtctggctggcatgtgggcccatattttaaaaataatttatactcctactttatattttgcttacaatgccacatcacagccaccacgtaggataatgaccaagtcaaaccagctatgtagatgccacgtcagtcagaaccgccatccaaaccgccgagattgctcatccacaccggtttatctgtattgcagttaagggatgaaaattgaactcgcgtcaagtaaagggcccacggggatttcggcccgcccgaaatgaacaagccctcggcgtcggcgctctcctcctcctcgtgagttcgcccgccgcctgcgccgatccccatccatcccgtgagctagcagaggcgccgtcgtggtcgccgtcgttcgtcctgctgcttccgccgcatcccggtgagcatccatcagttacgcgcatcctcttgctcatctctccctacccacgcgctttttcctccaatttgaacaccctttgtttctcttctagacctggaagctcttctcttaatttgccttaaacctcaatactaatagcagtttgtttgttcccccagatccgccactgctgaacggggtgctttcgccatgtcgaggctgcgggcgctgtggcaagcctccgttaacgccaccaggcgaggtagctgcctgccgcaaacctaattttgccgcgctagtcgtatgctgggtttatttcctcaaacgaaactcctttacctgcgtttgctcatttttaaggccatttgaaatgtttactggaaaggccatatgagatcctcaaatgatgaataactatggcataaggattttagacacgggatgggaattcaagtgtgtaacagctcagtactagttatgttgatgtttattcagacagttggaggtttcttctagcattttgatttatttaaaatggatgctgctggatcgcaagttggcttcagttgttagctatgacattctaagatgcttttaatcttcatttagagtaataactcattatgtttgtctatgtcataattctttcatcc

SEQ ID NO: 43831 - DNA, 436 bp, Oryza sativa
actttccttggcgactgttaattgacctcaagttattgtcttgtatgttcatatttttatctgatttatgcagtacataaatttgcatcttgttatcctggacttggagatatgcgtacgtatggcccccatccatacacatcgttgaatcatgcggttctgacccctaagcagtttttgaaataaaaaagaatatcacttgatgttatttatccccataaaaaaagtaacgcttgctgttttgcatcatacatgattgacatggtatgttgtttccgatgaaaccgctttcatacagtatgatttagctaatgcctttaggatggttgacctaattgaacaaaggattttttttctcatactaaaaaaattcttttgtcatactaaaagaactagtctgattctgatccattttgtctttttatgattcagacac

SEQ ID NO: 43832 - DNA, 728 bp, Oryza sativa
acctccgccaccccgaacgccgtcgcgctccgcgccagcgtccccacgttgtgccgcttcgccacgttgtgcaccaccaccacgctctccaccgccgccgccgccgccgccgccatggccgccactcttttctcctttattttccttttttttttgcttttaattcgctctttttttctcgctgtgatgtgaagaagggtggaaatggactagggaaaatactacgcgtgagccattccactgacatgtggggttcacctggagggtccatggaaaggaagacaccgtgccttcgtcgtaggccagagatcgtctgaaaattgaagacaatgaagctcttgatgctgctgcgttgagtgtttatgatgcaaactctcatttgcaacgcaggaaatttcacagtatttcatataagaaatttcataggaatctgtttgtttatttaccaccaaaattgggagaagagctcttggaacacaatgaggtcaatggcgaatcagacaaagccacatagtacaaccagacttattaacatcatccatgaaccgaaacctcagttcagtgaggattccaggataaatggaatagctcagaagcatcaaaattcaaacacattttgatactcttacctgacaagaactagttctgattgcctgcaatgctcagcgaaaaaaagataaaccaaaaggaaaagcattcagaagacaacgctctgtacatcatgtata

SEQ ID NO: 43833 - DNA, 1501 bp, Oryza sativa
tggctaacatagcccatgtacaacccaattgagttcctaacattttgttacagtcaccaaccactggaaactaagctaatacagtcaccaacgacaggcagcaccaaccaagaagttcagggaatttcaccaaaataaaaggcgaaatcctaaatagaggcttgctgcttgggttcctaatcatgttctagttgagatcacgcgggagttgttactgtaacaaaatcggtgagcagataatactggtgcctagtggcgaatcgggtcagaacaaactcacattgttgtggctgttatcgagctccatggataatccagccttggtctgattcgcctccccgtgtgatggagtcgatgcggagcaggaggggatgggcgcagaaagagaaagcatcctcgagcgctcggcgacggcgagaccctgagggcgccttgaggctgataagagcggcggcgggtggtcggcaggcgccggtgttgaggagagcggcgccggcggccgccgcggcgagctctcgccggcaatggaggagaatccgaaaaggaaattggattagtgaccttacgttagatattaattacggatctgccactcggttttccggtgggccatagagaggcaagcttatatgggctgggctggctgtggatatatcacaacttcatgaaaagaaaaaagtctgatttgacttcctcaaccattggccgccgaatcttattcgtatccatggactgcaaattaggaataattaggctgtgtttgagggaggggggattgagaagattgggaagatacgtaaaacgaggtgaaccattatcgtatgattaattgagtattaactattttaaatttcaaaaatggactaatatgattttttaaagcaattttcatatagaatttttttttgtaaaatacacaccgtttagtagtttgggaagcgtgcgcacggaaaacgagtcacaatctcccccaatctcttttgaaagaacgcagccttagtattagtagcttctttggacttagctattggtttgtcggaaaagacatttaaaattgtgaagtgtaaatgatctacgaaatagtggtttaggttatcctgatttggcatactagaaaagcaaaactgcaactgctacgatgctgaaataatgattaagattgcaataattcattaaacaaacaatccgtgccgagaaggatgaactcatgcatactgagatgttcatcaaccaatcgcccaaattatgtcttcagcaagtacagcgtcacttgctctctgtccaaattatcatacaaactcatcaatcacgtcagggatccgcgatctacatttggtaaccgcggcttgtgattgattatctggcatcttcggcaccatctctgaattttctgtgtctatggaggttcagacatgacagtggccgtgtttagttggatcaaagtttggattttggttgaaatcagagatgatgtgactgaaaagttgtatgtgtataatag

SEQ ID NO: 43834 - DNA, 1501 bp, Oryza sativa
gagatttgcttagacattccctaaacatataggctgcgttcgatactccaacaagaattggatgaaattttgaatactcgtaacatgtttttcaaactgctaaacggtgtattttcgtgtgaaaactttacatatgaaagttgctctaaaatatcggattaatcaaattttcaagtttgtaataattaaaactcaattaatcacatgttattaccacctcattttacgtgaagcacttaatctttatctttatcttaatcttcatcttcatcttcaggagattcaaacagccattcccgtcgcatatgagattaagatcataggtttgcctcaagttacaaccgataaatctaacgcctctttgggggaaaaaactgcatatggtacatgaaaagatatatgttcttttatttattttgctcactccttcgctttccgaaatgccttcgtcagtaaaaaggggaaacaatgccttgagcgcccggcgtgcaacggtgtttgtgaacttcactctacggcttcaaatccggcgttttccacacaacaccctgtgtgatctgacggcatccaacgttttccattcggctggatgaaaacgaactggtcagttcatcctgacagatacatttgcaccaatcgatgcctgggtcactcaagtctctcttcagattaagtaccttcgaagattgccaactcggttgcttctcatatatcctttcgatgttgttcacacgtattccttgcccatgtcaccaaaatctcaaaacaattcgaattagtgtacataataactgcagtttatctaacaaaaaatgcaactagatttcataactgtacatgtacttcgctatcaacaaacagtgcacgcttcggttcttgtctgttggaatagagaaatcagaactgcagaaagccaatcggtttgcactaacctgggctacatgattttccaagtcagcacttagtatatactgttaatataaccgggtcaagatggcacgaggcggctgcattgatcagcaatacagtgaccgttgagatgattgttttttttaataaaaaaaacagatatagttattaagatgataatttcatccttacaagaaactgtctaaccaatcgggatttcgtgagctgagaagttgctgcactgatttaaacaaattgagtctacatcttcgagtcatgaacaagcaaacagcatagaccaaaaaactcacaggaaactataacccatatggatcactatcaaaatctccctgctaataaatttcatgcttatcatagggataatgtgccttcgtgttaagtagccaggcacgtacatgtgtgtcgatctccttaattaattgccacatttcaatcgaaacaagctactattctcttcaagcaactaacctccaaattcatcatggatttctttacacccaagtggcctataaaatcacgagaattcgatcagcttagaaccatttaaaaggaggaggtagccaatggaaga

SEQ ID NO: 43835 - DNA, 1501 bp, Oryza sativa
tatgacaccaatgacaagtttgaagaaaaaaaaatacatttttggagtttacagaattacatgacacatccacactagtttttaaataccgtctgtatactttaatctatttttttcatcagtggtcctgttcttttctccaataagagttggatgaagattaaaattttcgtggcacgcttttcaaactgctaaatggtgtgttttgtgcgaaaactttctatatgaaagttgctctaaaatatcatattaatctattttttaagtttgtaatacttaaaaaatcaatcaatcatacgctaataccatctcattttatgtaaaaaaacttaatcttcatctttagaagaaaagaacacaatatatattatcagaaaaactacctaatggcatcccgtggagacggaatagtagtactgccttatctcctcttcccctctctctgtgtctcttcccctccactcgctctctctctctctcttcccctccactcgatctctctgtgactatcacccatgagcacggaggcggcgacggcgacgatggcgacagcaacgacggtgatggcggcaacaacgacgacgatggcggcggtgccgtcaccactagcccccgcggatgacctggacgacagccggcggggctcccgaccaccacgggcgacggctgtcgtcgagaagcctccccatcaatctcctcaagccgctcctcctcttcgtcgttcttgtcgctggcttcctcgccgttgccgccctcctcttccttggcggtgctagcgcctcctacggtcggggagcggtggacgcggccaccgggggcgagcgcttgcacaacatgagcgacgaggagctgctctaggcggcgtcgatggagccacgatttcggcggtttggagcgaggcacgacgacgagcgacggaatggcacaaggtaggcaccagatctatcgcctcctcttcctcttcctcttcctccgccgccgccccgctgctcgacctccccgacccgcgactcctcctcctcctcctcctctctcttgggatatcacgctgatacccaggtaccaaggcatgatacctaggtaccagctcgatacccagggtaccaggtatcagtcgataccaaggtatcaaggcctgatacccaggtaccaagccctgatacctaggtatcagctcgatatccagggtaccaggtatcagtcaatacccaggtaccaaggcctgatacctaggtatcagctcgatacccaaggtactaggtatcagtcgataccagggtaccagctaataccagtgtattagataccacctcgataccttacccaaggtaccagggaggattggataaggtggaatcacatgatagcgtgggtctccccacgaaattgacgatgcatattaaatctctcaggattttagttgtcccgtgactaacaagagtaacggaatcccgtggggtagcagccctcatatattattctgtctggggaagctatgtga

SEQ ID NO: 43836 - DNA, 1501 bp, Oryza sativa
  unsure (1)..(1501): unsure at all n locations
aattaatttcattaaatctataaaatatattttgagtaacttgcatattgggtctatattttttacttggactagaggcaatctaacctttccactatgaaccacctaattttacaatcgatttcagtttggacctccgtttcctcaagcttcctctccctccccacttctccatgttgcaggaacatcaccggtgaaagaccctatccggcaccaccgctgcactcagcatcatccctcacaacctccattcttgacatcgagcctccgtagcaccgacgcggcgttcgacctcaagtcctattggtatcggcgctggcgcaataacatccgtcagccaagctagcaccacctgtgtgccccatggctttggtccttgtcttgagctcgagctccaccggtcggcaccatgctacacctcgagctccgccagcnnnnnnnnnnnnnnnnnnnnnnnctgtccctgcaatggccaaggccaatggagaatttcttttctgctttctttctgaccgcaagtgaaaatctaggtgggggagatatcgagatgccactcaagcttgcaatgctggggagctccggcgtgagtgctgcagcggcggtggactggtggttgctcaacctactcggcaaacctgctcatggtagggaaagctgaaggtagaagaacatgcccatggtgaaccatttggtaatttttcttggtccaagttgaaaatgtcagcttatctctggtccaaagtgcgatagtggtaaaacaatgtgaccctatgtacaatttactcatatatttttataatgtatttgtcttatgttaaatatattactactctttttataaacttggagtagcttaactttgaccaaagtcaaaacgacttatagagtttgtttgggggagtttctagctgctgcagcttctcccagaatcaaaagctcccccaaacggtgcagcttttggttcagattatgagaagctggagttacagaatctagaaaaataaattgaagccagaagttgagaaacctagttttttcagattctcggaagttggctaacaaacaagtgtttatcataatcttaagctccttcaaacaaccccataatctgaaaatagatagaatatatggctctgaattccattatattgttggaatctactactccactacacgcaaattttggattaactgagatcattatttgtgtattgccctttcactagaagctactgacaggtaggcctcgctcttccatggcctggccccacatgtcaaccacctgtaattcctcctctcctaatgaatcaacccaatggcccacttgtcagtgaccctgttcccatcctaaccgcagaaaccctaactccccacaaagccttcctcccaaaccctccgcctccgccttccccttcccgctctctctctctctcccacgtgagcgcgaggcggcggcggcggcggcgcgaggtgagcggggcaccagcggcggcggaggaga

SEQ ID NO: 43837 - DNA, 289 bp, Oryza sativa
taaaacatttctagcttttaacaatataccaaggacaataaaataatttctacaataactaacggtcaaactaatggtcaactaacggagtgggtatgtaagggatccaaataaaaaactcaggggtatataagagatcaaacaaatttcaggggcgtagaagggattaggtgaaattacatgggcatatagggaattggcccaaaaacttacgattaacgcctcctggcaaaacaaggcgaggcaagtcgagaacccgttcatcctcatttacggtgatctgccaaca

SEQ ID NO: 43838 - DNA, 168 bp, Oryza sativa
atatgtattttacaaatttacactgttttcagttaaacagaaaagtctttaaagtgttttctttatatttcccagattttatgtacatggggtccacaggtcataggcttggggaggagaatagcagcagcagaagcagagctcaccggccggcgggcttgacggcaa

SEQ ID NO: 43839 - DNA, 1501 bp, Oryza sativa
aaatacttcctatacatttataatgctccgaggtgattacttttattattatttttagttaatttcataatttgtactgattaatttaatttctacatagagtcatgtttttatctctataacgtatttacttcaaatgacatgccaaagttacctttgtttttgttctaagttacttctataatatatgtaaattacttttaggcttcactgaatttacttttatatatttaagaagtaacttagtgaaatctaaaaataatttagacatatcataaaagtaatttgtgatttttcatcaaaatataatcatgtgagatcttgttgtaaagatttaattattacgaacacaacggtgtaattagatcgtagatcagatgagtagtttaatagaaaattgtatttgaagtataggtaaatggtgtctcttatagatggagtggaaccagctaccactagctgtgtagttacgtccataaaaaaaaaaggtagtatagctagttttagggtgaaaaaaaattgagataaaaggtggggtcatcataaatattttttaagtgaaaattttgagataaaaggtggagtcatcataaagatttttaaagtgaaaacctcgagtatactatctcccccttcccttcccttggcgtagaagaaaatcacccatctcgtcgtctcctccgctccttgagccatctcgcggccgaacaggggagggggcgccgatctccatctggcgagaagagcaggggaggggatcctggtgaggtgagcatccccgcatcctctttctgattcatctctctgcttgcgttcgttaaccctagcttctcttctagatctggaagaagctcttcttcttcttcttaatttcagagccttattaaccttaatacaaagtaacagtttgtttgttcacccaaaagtttggctgaaccctcatgtcccaagttggatccgcccctgtgaatctctcttcttgtgatcctgcaagctgcaggcagcaagctaaggctgcaatgtgcaattaccagttgtgatccatggacatatcaaaaccgtcttaccccatatatgtagtgagcctgatacgtttttatgccagttttgttccttctgttgattatattgcagtaggtgttggctgaaaacaatcattgggaagctaatgtgtaatgaattgaactaatacgatggcattgatgcctctatgttctattgtccgtgctgttgtgcaaggtccttcttagatggatgcttttctctgcaattaaattgttccatctggtctgtgttggtgaattgacttagtcacttcatttctctgcaattaaattgttccatctggtctgtattggtgaattgacttgtcacttcatttctctgcaattaaattgttccatctggtctgtgttggtgaattgacttgtcacttcattttaatcacaatcaggactacaaaggagggattcaagtttgagtctggattaagttggcagca

SEQ ID NO: 43840 - DNA, 1501 bp, Oryza sativa
gccaattttccaagcttctaaacggtgtacgctttttttataaaaatgctttttatacaaacttttagaaaacaatttttatttatttttcaactttttaatgcttacttcattcatttgtactctcaaataattattacaaaatcattcaactatttagttattcattaaaaaaactgaataaagtaaaatgatataccagtaaggtcttttttggaacatatagatatttagaagatttttatgagaatcaaggtcttctttgagaggatgatttttcagaattttttttgtgggaattgaaccaatatctactgatttttcgcgaactcaatatctactgaaatttgtactattaaattcgtgcactgcaataatagcccaaaaccaatttatataattgtttttataattcgtgtgttggcaagaccttccatttcattgttaggtgtacttttatcactgtccatctcctctatgccgtggacatgaccatctggttgaaataaattttttggtacatatatgatctgttaactgtactggccactgggctcatcgtgtcctactcttaaacatgatctgtttcagcggatccaacacaccgaaaaaacccatttattttattttaccaggcgaaacacccccacacacaaagagccaaaatttgtgagcaaatgatccaaacccaaccgccaaatctcgttacatcacgaaaacgaccaaaccgatccccaaaattccccaaatttccttcctttttaataaacctttcgtcataaagacgagagagagagagagagaggagaagagcagcaagagaagaagagaggacaagtgagagaaaaaaaaggcttcttttctctccaatctctctctctctctctctcttctcctcctcctcgcccacctcaggcagccgcattaatggattccgcggccgcggcctcctcctcctcctcctcccacctccgccacctctccacctcgccggacctaatgtgacggcggcgcggatccctcaacggcggcggctgggtccaagaggtgtggttttgttgtgttgtgcacgagaaaaagtcgctggtttgggagcttaccggcgagggcgacgagctacggctcaatgcggctcgatccggagtggtgttcgcggcgatttggctccggttgggcgctgctttggtgaatccggcggcgttgactccagctgggaggagaaggccggatctttgcggtgttctacacgggcgagggctgccttgtggtttcttggggggtgttcttagttggggattacctgcatttcgggtaaattgatggaatgctgctgtatattgcaggcgttgttctctgagtttgagtagtattgtttcttgggttttgttttctaggtcacatttgggggggtaaagattgggttttgggggactcatcactgggctctttcttgattactagtttagctgcattaagctaagtattactttggttcattcgt

SEQ ID NO: 43841 - DNA, 548 bp, Oryza sativa
gcgagtttgtaaagatggggaaagaggcacaacaacgtgataagagatcatagagagatgcatataggcatattttggcaaaaggattatgagacatgggattgagaaagggaaatgggtaaatggctaagattgaggtgtaaaaaaaaggatggctaggtgttaatgccaaaatatggtaagattctttagtggatttggttagggaaagaacacaatcaaccgatggaaagtctgtccagaagagaccaagttcaagaaggagtcgtgaagaccatggcatggcagcttaatttatctattaattatgcagggtttagtattttttttctttttatctttaaaaagtttggttagtgtctgattaggacttgtgttttatctttaggaaacatgagtcatttatgatggggattcatattggctcgaggttataaatatgttataaatatgtacatctagggttcttctaatctatctctagatcaatacaactttcaacatatcgccaccctaatttactcctgtcgagttcttaatttcgagca

SEQ ID NO: 43842 - DNA, 1501 bp, Oryza sativa
tcgttccacttaactatatagaattctttttcgtaggaatctgattattcaaaatctaaaccatatttaagtagtatgtatgggaccatcgatttcaattgatgtttccaccttataagttaggattaaatttttttctacgactaactttttatgatatgttagttcgcaaaatatttttctactcccagtgaaatccatactttcgtactacttaagtggtgattattactattctacgagagatgtgaatgtgactaacatattacactttatagtgcttccccacatgaccactctgctcatgtttcatcactgttgctcctatcctaatgacatgccttagttcttaacgtctggcattggctatgctacacaagatgcttattgtacctccaacatctatctatgctatctttgttctttattaccgttggttgccgccttgtatgactttactattctgatttttgttgctgggatttttcaaaaaagatatgtgtcattctaatgtctttatcatgtcctacatattatctagccaatggcttcgatgatgtcacagctcttaccacagactttttcttatccctactccctagtattgttgtgttattcctcttctattatttgacaaaaacttgctttggttgcgattaccattgtcgaagaagatgggtttgtgaacaagacgcaaaaaaaatacaagtgctgatgtctagatagcagtggcacatgtacgtatgtttgatgtcacataaatacggtaaaatctatgacaattgagcacgttacaccatccacgcggcaagacaatcaagccaaatgttcaattgatggctacgtcgcttttgtcaactccttattttccgggctataccgctttgaaataacttagccaccacttttaaatatctctcttcttatttatatgggtcccacaaatcggtaacagtcgtcttcctcatcgcacccatcttcaatctcgataccgtcttgttaggtagccattactcgatattcaggtctgctaacgaaatcaaaagagaggaagctatgactccataaggtaccatgatattatccttgctgccacatcctcgtttcgtctcataggaatttctatgctaactcctaatatgattctctcatttctatcaccgtaatcagaagagcgtttataacaccattctttattcatccatggtagagctctgtattgccgttgcttttatttaaaagatatttttccctatgttttgtgacatgctacgaaaaatcccaagaaccaaaccactaggaagaacgcattagaaattcctttgatttcgacactatcacacggtatagagaaaaaaaaaacgggagaaacaatgctcccggaaaatggaagtagggccagcgacgggaggcgaagaagcaaacacaagacaggcagacagcacagtggagaggagtgtggctgcgtgcgtccgctccgctcttgcgttgcgcctccttc

SEQ ID NO: 43843 - DNA, 1501 bp, Oryza sativa
aattccgtttcctcttcttcttccttgactctgccatttcctgaccaatccacaccacaccaagttcagcgctaatgcctcgaacccatgctccagctccagagatgattaaaatttaccgagcggacgagcaacaacgataccttagcagccaggcgcttctccttggcagtaaccggctccttcttcaccttgacctcgccgccgccgccgccttgcgccatgttggcatctgagggcctcttccgcttcttcccgtcgtctccccccttcgccagcgtcttgggcttccccgccgcatcacgcttccgcttcttcgggctctggaggtcgccgccgccggccatggcgatctcggagacggcgacgcggtctcgatcggagtaggaagacgagggtttttgctcggagccggaggaattcggtggcacgagcggctagggtttatacccccgagatgttcttgctgcccatgggctgggcctagtaccatgtgctcctagttaggcccatcaaagagagagactttctagaaggtctcactgggccgagcccgagcagagattggccgggccgttctgaccggtcaaagagggtgagggcaaagcggtcatttcacctcccgcggcaatgcagacgacgcgcgcagaggcggggggaattcccgcggatgcgtccgggtcgggctcgtaaattttcgcaaagcagcaaacagcggcgcgggggtggggggaccacgtgggcgcgcgtgacggcgcgaggcgccggggcggttgggtgtccggtgcgcggagccgcgcagcggatggaggctttgctgctgctgctgccgcctttttgggttctagtgtcggcctgatgcggtgcggccgcgcgcgtgtgtgggcgtgccagcggcaacggtcgacgcctttacgccgcacacgcgcgcgccacgcctggaggggagtgaagtggagtgttggagtggactcgccgagacgagatgagaactgccgccgccgcggcctggttaggcctggtatagcctcgtacgagctatagatggcttgtcttgcttgcttgcgacacaagaagaagaagaaggatctgttttcaaacttttaacctctcacatcaaatttttctatactatgttttaatttttctcacatcgtttcaatctctttaaacttctaattttagcgtggaactaaacatagccgaagaagaagaagaaaaagaatcgtcagagtaactctcatactactactccagtagatggcatttgttttttactgtgaccattgtccataaaaaagttcatgatgaatttgattgatttatgttgattttagaaaaaagttatatgcatatttctattgtttgtactatattaagtatattttaaatagacgcttgtaaatcatatctgtatatgtataaatttataagtagcttatttctgttcatatcatgtcgctagccgttaaataatctatatcaatattaacaacttcac

SEQ ID NO: 43844 - DNA, 1501 bp, Oryza sativa; identical to SEQ ID NO: 18700

SEQ ID NO: 43845 - DNA, 1501 bp, Oryza sativa
tttttttttccttttttttttgtcgatgagtagtgtaaagtattgggagtggcctccacccgtatatgatacgatgatggcggggtcagcgtattgtacgtcgttgtacctatgcgctcacctgtctcttctgcagctcattaacaaattgtgatcttatttttattttagcattggcttctgtcgacatctggaatttattttagatattaggtccatcttttttctactcttgaataggatagtatgctgacagagttttagttcgtccccttctagatacaaaatcggaattcttatcattcaaagataagaaacagaaaaggtgatgcatatcgtttatctgatgaacttacgcacgttcctataaaaaaacaaattgtatgcataaaaatacaattagtattgcttgatatctttatttatttagtgagtgaattacactttaggcatgtcgaaattttactttagactacctttatatcatttttttctttttgtcagtttttagttgtttagccttcctcgcagcaaaaatatttgccttcgcatagatggagaagttcggcagtatgccgaagccaatatgcttacaatcattgatgtgcagtgaaaaaatgttcgcggtagcaataacaaaaatatctgatccaaagaaaaatattggtaaaatggtggtccaaaataaaatgttaccagcaaaagatgacctacattccaattcactcttacttatttaaacttttattatggattattgttgcatgcttacactagggtgaatttgagagaagaggaaaatagaaatttgagaagatatgcaagacgaaatagagtataaactattttaaacttaaaaaatggattaatatgattttttaagcaactttcgtatataaattttttttaaaaaatacacggtttagtagttcgagaagcgtgcgcgcagaaaataagacaaactttctcacaatctacttgggccgtacgctgctaagataatttgtgattgatgtcatagtagtagagaaaaccattaacatatgtcgcatgtgcactgaaattaatattaggtgcaagtaattccattctcgacatgaacaaactgtaatatataaagtgttatgttgatcgttgttgatgtttaaccatgctttgctatgacactaatcattttattccactaaaatttcatttcaattttcaaattattatatctaatcgacatgctatttagcctccttcaaaattcacagattacaaaatttgtattaagttcaattccatctgaaaatacaaagacccttcacgccctcgcacgaatctcaaagccgaagaagggtaacataccaacccacacactgccccgccgttcccagatcttctcctccgttggattgcgcacggcagaagggaatttctagggtttaggcagcgagcgtggtgggagcgatggctgcggcgggcgacgagtcggcggctgccgctgcggctgcggcgg

SEQ ID NO: 43846 - DNA, 1501 bp, Oryza sativa
atatcttgataataaacttgccgcaaacataatatccggtcgtgttgcggtcaaatataataaacttccaactaagcttctgtaaattgttggatctgccttatcagctccatctctagccttttgcttttcatttggcaacaagggggttgtaactgacttgcagttatccatcttaaatttcttcagaatattttcagcatatttcctttgtgatataaatattccttcatcactttgatgcacttccataccgagaaaatagtggagcaagcccagatcactcatttcatatgtatgcatcatatcttttttaaagtcttgcatcatcttctcactattgccagtatatatcaaatcgtcaacatagagtgagacgattaggatatccgtacctgttttgttgacatatagagtaggctcacttatgctcttggcaaatcctttctgaataaagtacttgtcaatttgactataccacgctctaggcgcttgctttaatccatataaagccttcttgagtctgaataccttattttctcccccttggactgaaaacccttcaggttgttcaacatagatttcttcatcaagataaccatttaagaaagccgatttaacatcaagttgatatatcttccacctcttttgagctgctagagcaattatggtacgaattgtctctagcctggcaacaggagcatatgtctcataataatcaatcccaggcttttgcttaaagccttttgccacaagtcttgccttgtatttctgaactgagccatctggatttaattttgtcttataaacccacttaactccaataacttctctgtccctaggacgatcaaccaactcccatgtattatttttctcaatcatatgaatctcatcttccatggcctttatccaattatcatgtttttctgcttcttggaaactttgtggctcaacaactgaataattgcaaaattcatgttgttctgaccctctttgttgagaagtagattctaataattcaaccatacttcttacccgtcttggagctgattccggtgtagaaatttgctcttcactgctcgggcttgaatctgaactagcacttgagcttgacattggacttgatggctgtggacttggagtatgatcttccacttcatgagtgccatgcatatgtggttggcctagtgtgatggtagtggttggcaataatggagtactagaggcttctggagacttccagttccatgtagcactctcatcaaaaatcgcatctctgctaatgataattttctttttctccaaattataaagtctatagcctttgataccatcagcatagccaacaaatatgcaccgatcacttttattatcaaattttactctcttttgtgctggcacttgagcatagcaaatgcaaccaaatactctcatatgaccaatgacaggctttttaccataccaagcttcaaaaggtgtacggtttgttactgccttggta

SEQ ID NO: 43847 - DNA, 1501 bp, Oryza sativa
ccatcctgctcttgttgtcttttgtcttctccacaagccaagcatccatacgagctagtgctggtacaggtcgcaattatgcaaagtgacaggagagattaatgcaaactaatcacactagcagcagtggtttcctttgcaagcagggcagagttaatgcgaggaggagttagctgctctgctcgagtttaagggtactgcaactctgcaagtcagcagctgcaagaacatcaccaagttcagctaagctcgtttggagatcagcatcagcttacactgacagagcttatgctgacaagtagtgacggattcgtctgcgttgatgtctcaacaacctgtaggccatcaattaccggtttttgcttaatctgcttgcgattttgtgagtgcttggatagaatagaatccaatgtaggacacgaatactttggcagtgtgtttgcttcgattcccttatctgacagacaacctgcaagattgtgcatatgtgtaggtgcttggtcgccattgcagatgcttttcttttcccccgggcaagcaaaggtccaagatttttatcttattattatcattttttaacaaaaaataatctgcaaagaggactgtactacatatatatcttcattgaaagaaataggagagaaatgagctaatttttgttttagagtgcactaaacagacattccaggatgagaaaattgtaccatttttgtttgttttgtgttacaattcctgaagtatactgaatattttggcacagcatcagcttcagtcagaagttgagattatcagatgtggtgggggaagttgttgtagctgaaaagcatacatagcagtggggtgattgtgtttttcactcttcccagtactttacaccagtagtacatcttttcatgaaaaataaacggaaaaattcgagcttttttgcagatttgagatctacagaacagaacataaccttttcacgttaacgaagtaacgcgaggtttagggggtgtttgggagagaggggctaacacccccttagtgcatatgcagtgcagcactctgaaaaaagatggcaggtagggtagtagtgctccttaagccgcgagagcacgcaacgagaaaactgacagcctcccatgtgattttacctgccaaacctcactttgatcagctatcagatgagatgaggaaagcctttgctgctgtgtgcttgtgtctggctcaagcgagtagcaaattcagattctatagtttttttttctctctctgaaacttttcttttagatggactgaatgctctgaaagactcaaaactattgcacgtttacatgaccaatggcatggtttttaaggccctgtaatctgaaactagtacacgttgacatagagacgattaagttgggaacacgttggtcagaagtacggagttgcaaacactactcctatgctgcataatatagcaacttgtaccatttaaaatctatcttaaaatataacaacctcgcgtctcaac

SEQ ID NO: 43848 - DNA, 1501 bp, Oryza sativa
tatctagacatcagcacttgtattttttttgcgtcttgttcacaaacccatcttcttcgacaatggtaatcgcaaccaaagcaagtttttgtcaaataatagaagaggaataacacaacaatactagggagtagggataagaaaaagtctgtggtaagagctgtgacatcatcgaagccattggctagataatatgtaggacatgataaagacattagaatgacacatatcttttttgaaaaatcccagcaacaaaaatcagaatagtaaagtcatacaaggcggcaaccaacggtaataaagaacaaagatagcatagatagatgttggaggtacaataagcatcttgtgtagcatagccaatgccagacgttaagaactaaggcatgtcattaggataggagcaacagtgatgaaacatgagcagagtggtcatgtggggaagcactataaagtgtaatatgttagtcacattcacatctctcgtagaatagtaataatcaccacttaagtagtacgaaagtatggatttcactgggagtagaaaaatattttgcgaactaacatatcataaaaagttagtcgtagaaaaaaatttaatcctaacttataaggtggaaacatcaattgaaatcgatggtcccatacatactacttaaatatggtttagattttgaataatcagattcctacgaaaaagaattctatatagttaagtggaacgaagaaacaactctccttattgtaatacataagaatcgcattcacttgttaaaattttgaaggatttttaacatgagattcaacatgttaaaagatatcttttgtttttccgtgctccaattaaacagttattcctgtattttttatgctttttttcattcacgggattcaagatgctaaggcactgaaattttacaatttttccatattcatgatttcctatgttccaaaaattccgtgtctccaagaaacggctaacgcatacttgtaatcagtagcaaatccttaacaatagttacataatttagctatattttgatactacccaaaaaaatcgatgaggatcacccgataccacaatgttagacatttacccaaaggtaaaagtatgttgtcaacataaatagtactccctccatcacataatgtttgacgcagttaactttttaaaacatgtttgaccgttcgtcttattaaaaaattaagtaattattaattcttttcctatcatttgatttattgttaaatatacttttatgtatacatatagttttacacatttcacaaaagtttttgaataagacgaacggtcaaacatattttaaaaagtcaacggcgtcaaacatttagggaaagagggagtattacaataccattatgtttttttttacattacaataccagtgtgttgtcaacataagagcaagtttaatagaatagctaactattagctctaattcatctatagccaatctaatagtttattcaaacaatattt

SEQ ID NO: 43849 - DNA, 1501 bp, Oryza sativa
tggatttagatctcaaaatggaggagggaagaggggagcgagtggagggaaacagaaaaccatggagggaaagctggtgaaattgggcgcgtttatgtatgcactacacacacactctactctagggttgtttctgttctgtctgaggggtttgtttggtttggttgagtgatgatgatctatggaaggttttagaacaaccaggatcatcgtccatcacctgaaggccacgtgtgttagtgtgtctaataattttcacttgtgctagcacatggtttatttgataggctcgtgttttactatgctgttgtagtgttttatttgaagatatttgttgggcctataaacgatagtgaagttgttaatattgatatagattatttaacggctagcgacatgatatgaacagaaataagctacttataaatttatacatatacagatatgatttacaagcgtctatttaaaatatacttaatatagtacaaacaatagaaatatgcatataacttttttctaaaatcaacataaatcaatcaaattcatcatgaacttttttatggacaatggtcacagtaaaaaacaaatgccatctactggagtagtagtatgagagttactctgacgattctttttcttcttcttcttcggctatgtttagttccacgctaaaattagaagtttaaagagattgaaacgatgtgagaaaaattaaaacatagtatagaaaaatttgatgtgagaggttaaaagtttgaaaacagatccttcttcttcttcttgtgtcgcaagcaagcaagacaagccatctatagctcgtacgaggctataccaggcctaaccaggccgcggcggcggcagttctcatctcgtctcggcgagtccactccaacactccacttcactcccctccaggcgtggcgcgcgcgtgtgcggcgtaaaggcgtcgaccgttgccgctggcacgcccacacacgcgcgcggccgcaccgcatcaggccgacactagaacccaaaaaggcggcagcagcagcagcaaagcctccatccgctgcgcggctccgcgcaccggacacccaaccgccccggcgcctcgcgccgtcacgcgcgcccacgtggtccccccacccccgcgccgctgtttgctgctttgcgaaaatttacgagcccgacccggacgcatccgcgggaattccccccgcctctgcgcgcgtcgtctgcattgccgcgggaggtgaaatgaccgctttgccctcaccctctttgaccggtcagaacggcccggccaatctctgctcgggctcggcccagtgagaccttctagaaagtctctctctttgatgggcctaactaggagcacatggtactaggcccagcccatgggcagcaagaacatctcgggggtataaaccctagccgctcgtgccaccgaattcctccggctccgagcaaaaaccctcgtcttcctactccgatcgagaccgcgtcgccgtctccgaga

SEQ ID NO: 43850 - DNA, 1501 bp, Oryza sativa
tgtctgatcttttattttgttcaaacaaaaaagcctgccactacttgtgtctagtctatgctgcaagtgattgtgtatcttttcgaagtaactacaaagtctacactagcagtttgaagaataagaattgcactacttcaacccaatccattgagtatttaacctttatcatgactatggcaggaaaacagtatagaagttatgctaatggttggtgttcagaaaatacacaagtgactgcaatgtacctttttgaagcatcaactgctgtgcttgctaattttgaattggatgcatggctgcttgctcgggatcgccttttcctgtttatcaaaaaagacatttataagacaattagacaaaagccaaaaaaaagaggcatcaataatgaggatggggtcactaagacaagaaaaaaaacacatgattcaacattgattacagaggcaatgcaatgccccttttaacagatcattgtgaagcacaaggaaacatgtcgtctagaacagcaatagtgttaagaaataattttaacatctttcttctgtatttctacagggaaagcgtcttgtgcgtgaagtgatgcagcagtctttagaattctgttgggagtattgatccagacatggaattattcattccaaccgcgaacaaatatgctatgcactattcatggccagttgaaacggtgtcaacatgtccagcagaccaaggaagatcttaatgcgacatctttgctaatacagctaaaagatgaccataggtgcctaacacagcttttatctaatggaaaacagcctgagtggcaaaattagaatcattggtctaccttacagtgctcaagagaacacggttaccacggagtttgcatatcactcaagtattaaacctcaatgaacaaatgaataagatgaatgagaaggtctacaaggagcatgatgcttcacagtattacctttcaaaatatggaactagatatgctgtcttgcaactgcttatttctcgtttagacatattgaatgccaagacaatcgaaagtaaatatctcatatcatctccatttccattgaagaggattctcctgttttgatctatggtaagggcagaaccatgggactggaaaaactccacaagaggatcagggatgacaagttgattttctggtagatactgctggggctcatccaattcaaactcatagatagataacttatcgtcagggatatatggttgactggccatgctgattggaagagctgataacttatcatcagggatgtatggttgagtacccaagttgattggcagagtttgatgccccgtaagttcagtcagtaaagatacatcaagttctttcacatcggaccctgaccttagaaatttcaggattttctcctgccttgagcattgctcggcaatcccaaggctaagttgaactgagtcagggtgagagtctgctgcacagatacatcgaggttagaatcagcataaaatgcaaaac

SEQ ID NO: 43851 - DNA, 1501 bp, Oryza sativa
ccactgccagggagcagtggcagattcaaaaaatcaatttgttggtgtcatgacgtatctatcggtgttataacatatggataaacagttttactataggttctgccgaaagttgtcggtgtcgcctgacactggccatggtactatagatccgcccctgccagggagtcaccttcccaaatctaaatgtcgtcggagttttggcgtcattactattagtggggagtttcacctctcctcccttcccaataccaatactagattgaaggtgactgaaattatcttaaatttagccattcccttttcatacaccggaacagaaatgcaaattacataattcacacacgctagtaatatacgatatttagacggctatatccgccttaaatttcgggggaaaaaattcaagttcctgcacgtaattaagctggattcaaacaaaacagagcacgacaattctctagtcaaacatgagtgtgtttaattatttgcaagtcggcgggttccatcatacttccgtgcatgcatgctctcgctcgatcattagctagtttagcctgcaggttggccatggcgatcacgaattaacccaaaagtgctgtgcatagcactagcttagctaacgagttgatccattggaagttgttaattaaggtcatgtttggctcagctatatccacactgattttgaattttatatgttaaattatagtgttttaaaattttatattttgtctgaaataatttatccagacattatcaacttaatcacaaattcaaattcatgcactatgtatctctatttcatattataaattgctttgactttttcttaagtttatttttttcaagtttgatcaaatttataaaaaaaacatattaatacttttgacataaaacaaacataccaaaatgtattcaatattaatttcaataaaactaatttggtgttataaatattgctacatttttcaatgaaacttatttagaaaaagtgaaaccaaattatactattttatccgtttcacaatgtaagactttctagcattgcccacatacatatagatgttaatgaatctatatctaaaagaatgtgggcaatgctagaaagaattacattgtgaaacgaatggagtataaaacaaagaacgtatttgagtacacaaaatcttggatataaaaataagtcaaacaggacccgcaacgatcgaggaagatttcaattgttggtgttggcagcatatgcacactactccaagtgtcggcccactcattgcatgcaggccaaaaggagtacattgaattgtatcataatccaatggggttgcaaattaatcttgttttgtttgcttcgttgttattaacttaaaccgtgcgccgattcatgatcacgcagagaggaaggggactgcatgtctgcataatatgcgcaggtcatttcttaatattattgcgaggttcactgtcaacttcattttgtcgtcttcgagcatcacaattt

SEQ ID NO: 43852 - DNA, 1501 bp, Oryza sativa
gataagaggtaataggtgagaatttgttatactccatatatgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtatgatttagagaaaatcaacatctgcccctagaggcgcccggaccccccttatatatgggaaggagtccgggttacaaaagataatcaatatccctaacggaatacacagatatagattaaatatagccgtgaccgactaagtctcaaggtgtttccttgttgtacaagttaagaaacaaacccgagatacaaataagatattctatacatattcggtatcctatatccagcccaaatagtatcgccatgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaatataataacacaatcatgcattagatggcaaaagcatacgcggcgcctaaagaggcattctagccgactgctttttagccataataaaaagaatccgagtggtttacactcgaaaaggttcacgaatgaacacactggacaggcatccgaatataaaactataaagattacccaccaaatattataaaaattatggtaacaaaaagactaatagcctaggctatgtcaagttaccacaataaaaataggtatataacataccaaggaaatgactatgataaaaacaagtcattccaagttaacccaaacagcttttgtagcctaaaaaagcttacaaaaacagcataacgcttttctgcagggcaccttttaatttgcattgcaataactccaaagaattatatgaccgcataaaaaggattttgtcagcattgggcaacactattgtgtgcataaatattgccaaagcaaaatatgcctaagtccctaaggaacacaatgggccacgctgttaaaagtattgggctgaggtactgttcaggcctaggcccacttgcacctccgatacccttaacaaaaaatccgagatccaagcgacgcttcgtcttccccgccggaacgctcgccattttccccactccttgctacagtaaatagctgcgccggcgaactagggttcatcaatccgtccaaatccaccttcgaaaagtgattaaaaatccttcccgtgatccaccgcctcaattcctcacctctcccaagccatccatcaaatcaaatcagcgcattcgggtaaaatcga

SEQ ID NO: 43853 - DNA, 1108 bp, Oryza sativa
ttggaaaaatgtcttaactccctcctttcacttgcctttagatgccgcgctacaagcctgagtacttgtttggtgttgagggatttgtccaagagttgcgtacgatgtcctttgccataggatttgggactgcccctttttatgcccagattcctcatgatcgtcacgaagaaaagtgccgagtcaaagtcaccttgaacagtaatagtgaagatatcccctcagagatgttcgaagctggaggaagaaactacatccatgcatgtcaggaggtggcaaggatcgccataggggagctccgcgatagctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactatgttagcagttcaagatcgtgaagatcggaatcgtggtaagatttgcaagctagaggacaaggtggatcgtttggagaaggaactagccgcgttgaagggagaagcaccaccgcagaaggccaggattcgtcttaccgcaaggaagagagctctatttgtccctcgctaccaattggcgccaaaggtccgtgtggtggaaaaagaagttaccccagccctagcggatcctccggtcgttaacgtaagtgatgatgaagaagaagaatccaagcacgcccattccaagatcgagtggggagcaactcaagatgatgaagacgaaccgaacgaaccttcaatcaactccgatgcccggaagaactagaatgccttgtcaagtcattgtcttagatcgttgtgttagttagtttgtttaagtttggttgtgtgtgtctcgcatgtgatttacatcagtggtgggatgtaagtgcatgcgtttgtttgctttcgagtgttaggtggttggtaagtttagtggtgtgagagtcttcagttttgtattaatgaaacacacttaagatcaataaaagttaaattaattctctgtcctaagtagttttccccggtttctcttcttgtgcttctgcccatgccaga

SEQ ID NO: 43854 - DNA, 1501 bp, Oryza sativa
tgcatttttcctgcggtccaatcaaagctattccgtgtttttcctatattttacaatcctctattttacacttacatttatattagaatcgtttgtttttcatgttcctgtattttttgcattcctatgatttaaagggatcctaagtaattttagtcctcgtatatagtagcgacaaaataaaaacactaaatttttatgtctttcctagttagactggataaacttgtatagtcggtcaaggattatccataggttgaccggtccgtgcggtgcctatatccttgataaagcagctttatatataggatcaaattgtgatgctcgaagacgacaaaatgaagttgacagtgaacctcgcaataatattaagaaatgacctgcgcatattatgcagacatgcagtccccttcctctctgcgtgatcatgaatcggcgcacggtttaagttaataacaacgaagcaaacaaaacaagattaatttgcaaccccattggattatgatacaattcaatgtactccttttggcctgcatgcaatgagtgggccgacacttggagtagtgtgcatatgctgccaacaccaacaattgaaatcttcctcgatcgttgcgggtcctgtttgacttatttttatatccaagattttgtgtactcaaatacgttctttgttttatactccattcgtttcacaatgtaattctttctagcattgcccacattcttttagatatagattcattaacatctatatgtatgtgggcaatgctagaaagtcttacattgtgaaacggataaaatagtataatttggtttcactttttctaaataagtttcattgaaaaatgtagcaatatttataacaccaaattagttttattgaaattaatattgaatacattttggtatgtttgttttatgtcaaaagtattaatatgttttttttataaatttgatcaaacttgaaaaaaataaacttaagaaaaagtcaaagcaatttataatatgaaatagagatacatagtgcatgaatttgaatttgtgattaagttgataatgtctggataaattatttcagacaaaatataaaattttaaaacactataatttaacatataaaattcaaaatcagtgtggatatagctgagccaaacatgaccttaattaacaacttccaatggatcaactcgttagctaagctagtgctatgcacagcacttttgggttaattcgtgatcgccatggccaacctgcaggctaaactagctaatgatcgagcgagagcatgcatgcacggaagtatgatggaacccgccgacttgcaaataattaaacacactcatgtttgactagagaattgtcgtgctctgttttgtttgaatccagcttaattacgtgcaggaacttgaattttttcccccgaaatttaaggcggatatagccgtctaaatatcgtatattactagcgtgtgtgaattatgtaatttgcatttctgttccg

SEQ ID NO: 43855 - DNA, 1501 bp, Oryza sativa
tgtacttgaccacatcggccttgcatatcacagtgcattcattgggcaataggtaatgccttaaccttgtacaaaaaaatataagtacaagcacaacttttccacaggagaatatcttgtttctgcatccaagagccgacgacttaggtaaaatacaactttttctttcccgtcaagctcctgaatcaagactgaaccgattgacttctcaccggccgatagatataatctaaatgtatccccttttgtggagaaatcaaaactggaggagagctaagatattccttaataatatccaaagccttctgttgctctgcccctgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcacgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagccccgatcgatatatgccaggcttcatcctaaccattacaagcaaaatgttgtgtgaagaagggcaaacatgcacgttgccaagattacacgcggtggacaagaatgaccgatttgcgaccggtctgacactgaccatatcgtcagcgcacagccatgctcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctgacacttgtagctcattcatacacagatccaccaaaacacaggagtagggtattacgcttctcagcggcccgaacctgtatagatcgtcggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaa

SEQ ID NO: 43856 - DNA, 854 bp, Oryza sativa
atgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgcca

SEQ ID NO: 43857 - DNA, 1501 bp, Oryza sativa
tggtggctgcagaatgcggctaagattttcgagcttcatgttgcgatgatactcgaaagatcatacggatatcctcccagcaccatctggccgtccgtagcttgatccaacggctcggagagaaggagatcttcttcttggaaaaaaaaaacattcacgtgccactgcatgtgggccccacagctcagggctccaaactctcggcatcttcccacgagggtgccagcatcatcactcaccagtcaccacggagtaaaacccacggcctcattgtccttggcgccctcttacatgtgggcccagtggtagaagcgggcccacatgtcggtgtgtgtggggagtaatgggtgagaaaaaacccgtggtttttttttcttcttggcagcaatcatttcggtggggccatgtcgagctgaccaattggcgcttccatgtgatccacgctgtcatcccgggcccaccagctctcccttgtcgataagcatccggagctcgctgctgttcttgtttctaattgctggtttctaccagggccttttagcaaaaggggacaaataattaatcctactagcattttgtgatcttgagatccactgttttgtttggatgattgaccgagcacgaacgtaaaaaagactgtgaggaaagcaaattgtactgtacttatattcaataaatccatttttagagatcgttttacaatgcgaaattgcgaaccgagagccagaacattccttgaaaattagtagacctatgaaacttagggaaaatgcttccctttttttgtttggggaaaagaaaatggatcaatccggtaaataacatcgcgcctgcaatggataatttatcgtggtgatgtcaaataaaaatggaatagcgtttggggttatgtcgaatttcctttcattcaatctctatcgtaattggaatagtagtgtttttctattcaaatgcaaatcacgtgctctgagccctactcatgaacaatgattggagcatactaacactacagtacaattattgccaagaaaaaaaatggtacttgatgcgcagccatgttttttttttatgcttaaccgatgaatatgcaagtacacacgctttcagttatgatttttgtaaaacagctttacgcacatactactaaatcttttagaaaaaatgtttagattgttttaaactttataatagttaatttatttatttatactattttataattatcataaattatgaaggtattcagccattgatgtaagaacattatgcaagtggagactatttcatctgaaaaatgtcagtatccagcgatgacatcaccctctcggcaaaccattttattttcgaaaacgacctccacaaaccaaacatatttggctcacaagcttcccaaaaattccaggacgaattcgaaaaccaaatttcttaggggctctttagttcgcaaaacaaaattttcacctatcacatcgaatgtttggatacacgcatggagtgtaag

SEQ ID NO: 43858 - DNA, 307 bp, Oryza sativa
cccatcacgtgctcatgaattatcatgttttacatgcgccagagaaaattcccaaccttctctcctaaacgcaccctagttattggggaatttaactattgccattattagatttggcaattatccaatgctcatcttaaaattgcttttatttttttccctctaaggtggtgtttttttcaactatttgtcacatttgcccatgtaacatgtcaacatggtagtccaaggtagaaactatatggaacttagtagtcagtctccccctcacatggcgacggcgacgggttcacatcctctaccataa

SEQ ID NO: 43859 - DNA, 760 bp, Oryza sativa
aaaaatatagacatgtaataatcgaataattaagctcttcctcttttcacttctctttatgtttttctttggcaaaaatagatgttaatgagaagttaaaacttccacaagaagaatacttcattcaagttgccagaagcatctcctttagaaaaggcaaaaaaaagagaagaaacgaactgtgtagtctcagtccgtccagcacaaaactgttcgatgcttccaacatcataacatcatatttgtcgaattgtcgatcaggccattcaggaagcttgttttctaacttcttatcctcttcctcctgtcatcttctaactaacacaagcttctacctagagaaggcaggccacaataacctcacacatattcacacgttttagtttgaccacctaaactagttgaacaccctggacttgatttataatatttgaagcattttgattgctgatattcaatattttaagtaggaaaaaaaaaactacacaccaatcagtacccagttacttggttatctgaagaagactgtcatatagagggtaggttgattcgtttttagtagcttgaaagcttcaaaatgtgttatgacagcagaagcaatcaagcaaagcctcttattatcttcttacccttaaagactaatgcttgcaatgcttcctccatctctagctagctgccatttggaacacacataggagctaatcaagctaagctagtttgccaccacttcatccaatgagtaattttgtggcgatgcaga

SEQ ID NO: 43860 - DNA, 1501 bp, Oryza sativa
gtgtaatcatatcacagatgagataagtaatttataagaaaaaaagtttagagcatgttaaataagttgtttattaatactaggagtgagagatatagttatgtactttgcatgcacagctattgagtgcctccatgcttgttgcatgtctctttgcatatgcgcatggctttgtgcatgcatccagtttagctgatgttttgtaggggtgggcacccgatttttagcgttaaatcgagcacccgatgcgtagttacgtccttaaaattatgatcgataggccaacattcgcggcctcgcccgataaatgcgcgcggacgaccagtccgcgattcggccggttaccctctactacttgtaccaccacaccgcgcgctcatcattagcctcgtcggagagaaagcctcaccctcgcgggccggagagtgagggatcgacgaaggcgccccgtacgtcgggccagcatatatatactcagaagccggaggaggacggtggaggcgccaccaccaccaccacccttcgccatgcaggaccaggccgcccccgtcccatggtccaccgacctctttgactgcttcgacgacagcagcaactgtaaaataagcaagccgggctacgattgtgtgttctctgcttggcgtggtacgtgtgtgctgatcgattgttgtcgggcgcaggttttatgacgtggttgtgcccgtgcatcacgttcgggcagatcgcggagatcgtcgaccgggggtcgtcgtcgtgcgggacgagcgggtcgctgtacgcgctggtgtttctcgtcacgggctgcagctgtatctactcctgcatctaccgctccaagctgcggtcccagtacggcctgcaggagacgccctgccccgactgcctcgtccacttgtggtgcgagccctgcgccctctgccaggagtaccgcgagctcaagaagcgcggcttcgacatgagcctcggtaacaggaagtttaacagtacagccaactaccaactccaaatcatttataattaatttaatagttaattgatacaatagttatctactgcactattaattcctggtcccacatgttatacacacattgcgtatttgagtctgtgctgcagctggctacaaatctgtagtccactgctcgtctctctactcttttatcttcttaaaatatgttaaaatatgtttatagcatagccatcgattttctaatggaatggttggctgtcgtgcgtgttgatgatcgtgacgatgacgatttcgttggttttgtgcaggatggcacgcaaacatggagaagcaagggcaaaacccggcggcgaccatggcgccggagatgtaccctgggatgacacgctgatcgatcggctaatcagtgggtgatgctggctgctgccctgctcggtcgttgtcttctctgctagagatgggcaggacagggcagggcagggcagcttactacgtgcctacatacgagcgagatttctcttgcgggtttgc

SEQ ID NO: 43861 - DNA, 1501 bp, Oryza sativa
tagaagaaatgcgagaagactacgatctcatgtgtatcaggggtcggaaaagcctcaccgcacgctggccgccacccgatgatctccttggctgggagaacgccgtgcgccaccatctccttcaagttctcttccgttacgtcggatggcgcccattggccttcaaagctttctttctcctccgccatcgattttacccgaatgcgctgatttgatttgatggatggcttgggagaggtgaggaattgaggcggtggatcacgggaaggatttttaatcacttttcgaaggtggatttggacggattgatgaaccctagttcgccggcgcagctatttactgtagcaaggagtggggaaaatggcgagcgttccggcggggaagacgaagcgtcgcttggatctcggattttttgttaagggtatcggaggtgcaagtgggcctaggcctgaacagtacctcagcccaatacttttaacagcgtggcccattgtgttccttagggacttaggcatattttgctttggcaatatttatgcacacaatagtgttgcccaatgctgacaaaatcctttttatgcggtcatataattctttggagttattgcaatgcaaattaaaaggtgccctgcagaaaagcgttatgctgtttttgtaagcttttttaggctacaaaagctgtttgggttaacttggaatgacttgtttttatcatagtcatttccttggtatgttatatacctatttttattgtggtaacttgacatagcctaggctattagtctttttgttaccataatttttataatatttggtgggtaatctttatagttttatattcggatgcctgtccagtgtgttcattcgtgaaccttttcgagtgtaaaccactcggattctttttattatggctaaaaagcagtcggctagaatgcctctttaggcgccgcgtatgcttttgccatctaatgcatgattgtgttattatattgttctcaactatatgtttagtttgttaactaatcacatagttgggggctacacctaattaggtgcatctattcgatgcaccatattctttatcttttcgccctttacagtcttcgtcttcgctactcggtgggccttggcatgaataatctgaagcactcggattgctatctttgagaaggctacgatggttgactgcaaaggtctcgggggctactgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacac

SEQ ID NO: 43862 - DNA, 1501 bp, Oryza sativa
ctattatgcaactagtccatttaaagaaaataacaaaagatacccatatgcatatggactaatatttttttatttttaaattttaaaaatagaccttccaaaataaatatttccaaatctgaaccttttggccagccaaataactttgtcacaccgtgcaactggtgtggcagccaatcgggccaaaagattcagtttttagaaatattttttgtaaaggtcttttttttaatttaaaaaaaggactaaaaagtaaaaaagaaaaccatataggctacccatataaaataaataatattatttgtctctacttctatcttctcttagtgctaccttttatctatatacattgtgaggattgttatagttaaagtttatttatgtggatcctatctatatgaatcacttttgctatatatattggtgatgccatgatacatgtaacgtgtacaattaagttcaccctctgtatccatatgctcctactacatacttatactttcttattccataacttcaaataatcttctttcacagattattatctaataatctgagatccgattacactgttgtatttgttataattaattcttcacaataaaatcttacttgattatattctgacaaaaatattttaaatgtttttttgttgcaatggattacttaaacggcgcgaagtttcactaggtcatttagaatgttgcacatagcgttctttgaatgtttgaagaagtattttttgtgatgttttagttgatgtttcactactttatttgaaatgttgcacttggtgttctttgagtttgaggaggtattttatgatgtttcattgtgtattttagaatgttgcacgtggtgtgttttttgggatgtttcggtaggtattttgtgatgtttcactaaattatttggaatgttgcatgtgatattctttttagatatttttcaaggagttttttgtgatgtttaaacaattgcaacttaatgtttcatatataatataaatgtgtttcaattagttatatatttatatattaatttttaatttaaaatatagtcgtgtgagatcttattttaaatatttaattgtaacaaatataacggtgtaatcatatcacagatgagataagtaatttataagaaaaaaagtttagagcatgttaaataagttgtttattaatactaggagtgagagatatagttatgtactttgcatgcacagctattgagtgcctccatgcttgttgcatgtctctttgcatatgcgcatggctttgtgcatgcatccagtttagctgatgttttgtaggggtgggcacccgatttttagcgttaaatcgagcacccgatgcgtagttacgtccttaaaattatgatcgataggccaacattcgcggcctcgcccgataaatgcgcgcggacgaccagtccgcgattcggccggttaccctctactacttgtaccaccacaccgcgcgctcatcattagcctcgtcgg

SEQ ID NO: 43863 - DNA, 1501 bp, Oryza sativa
accttagttaacatgtgaaaatgcaatattcaagaataaaatggttatttttgtacaaacaatcaatacctcacataattctccatatgcctaatatgggaaattatgtttccctaattgaaaaaggttatgcaaacaaaagctatttgcatcagctttccctctaaagcttggtaccggcgcaagaaggcacacagtccatactgctcttgggccagatatatcaagttgacacaatagctgataactagaatatcagcaacagcagaacgaattgcaaaccatttctcccttctcttgaagtaaatcacttgtcatcagcattcacgcaactgtcctcatagcactcaacgtccatcaatccatgtgacactatcacataaatcttacaagtgcggaacacaaccgaaccaattcagatcttgcaattccacttaatttctctcatgtcccaaatcaagcatgccgattttcctgttcgtctctccaacactctctagcatcaccagtgtgaacaatagggcaactgccatggtagcttaggatgatgcttgttggagtgaagcttattccacaaattcgactacccgcattggccccctccattcttatcactgtcatttcccttgtctttcttaggacaaggcatattctgaaagaacccaatggagaacagtgacagcgagagctgaacctggtcccggcccaacctcaccggcggctgccgcctcccctgttgcctgggcacgccggcgccacgccactgcagggggcggatgtagacagcgtggagccggcggaatccaccgagggagagcaccacggcccggagctgccgctcggagaagccgaggttcgcccactcccgcacgcacgcggcctcccagagccgctcgtcctccgcgagctgccgccaccccctgctcacgcacgccgcggccgccagcgtccgcgcctccgctcgccgcagcacctcgaacaccaggtcctccccgagatccggaaccctcggctgctcgccctctcccgcatcctccggaggctgctcctcctgctgctgctgcggtggcggctgcgaggaagaggaggcctcgccctggctcgaactggaggacggatcggtccgctgcctcttggccggctcgtcgccgccgccgccgccgtcgccggcagccggagcgcggggctcgtcgccgcctgacgaatcagagcggaacttcatggcggcggcggcggcggatcggtgaggctacagcaaaggcgtagccgccacttctggatcagaactaggacctatcaatatccaacggaatcatccacgaactcaaatcaactcaaacacacaccgaattcccccccaaaccaccacagattcgtccggatttactccccccacaaacccaaacaaaaccctcgaattctccacacacacagacgccagatctggccgaatcacgctacccgcggaccgaaccaacacaatttctcgagtaatttggta

SEQ ID NO: 43864 - DNA, 1501 bp, Oryza sativa
tgtttttagcccaagctcttcttacttaatggatgcaaaagtgtgtattacggtattacctcgtcatcttcaataaaaatttcctttttttagatttctcattgtacctttgaagttaccttattcgcggtcacggtgtgcataaaaagaatagaataatgttcttttgattaggtatgctagatgtggaatcatacaaacaaatgaacacattttcttccctttgtccttgctctaattatgaggtttgattgggctaatgtcaattgatttaagacaatcatatggggtgtttagatccaagggtttaaagttttagcgtgtcacatcaggtattatatatggtgtcgcatgggttttcggacactaataaaaaaaactaattacagaatccgtcagtaaaccgcgggacgaatttattaagtctaattaatccgtcattagcacatatttactgtagcaccacattgtcaaatcatggaacaattaggcttaaaagattcgtctcgcaaattagtcacaatctgtgcaattaattattttttagcctatatttaatactttatacatgtgttcaaacattcgatgtgacagggtataaaattttggggtgggatctaaacaccccatagttgtatttcttattctatcaagtaaaacggtaaacttaaagaaacgagataatcccattgagagcatttgtttggcaacaagtcattacttgcttcatgaaaaaaaataatactaaattccttctagaacttggattagtaacagttgtgaagatataaaacactattttgctattcagctattcattagttgctctatctagtgacatagtactactaaataaggaagatatcaaatcacttactcataccacaattgcaatatatctcataccacaattgcaatagatagcaagatgtagagctaatgtggctgttccgcctgatgtggtgatactcctagtgatgaggctgtgtgtattatctatgttggatgatgatgtgtaagctaagtttagttgttgtatgtttcgatgggagcatatgacttcaaaactttaccagcgcagagtttactatatggattaatggggtaaaagcaatgctagagtgatgtgtaactaatagtaacaaaatgatatttgaacatcacatattacatattgttgaataacaatttgcatggttcttccctgcaaaaaaaaaacatggttctaggataaaccttcactttcattaaagaggttgtctatatatcttgtgatagaaaatcccacctcctatcattcgaattttggaccactggatacgcttaaagattcgtgcagacccccctaaccctaactcctctcctccccgttcagaacgccgccaccactcccgtcctcgcgccgttgcgcgattccaccgtcaccaccaccccaccgcgccgctgcctgcctcgccggctggccggaaagagtcaacggcgtcggcgaggcccccccggc

SEQ ID NO: 43865 - DNA, 550 bp, Oryza sativa
aagattcgttatgctacatttcagtaacctcttgtctggatgttctacagaaatgaattagtaatggatttctcaaaggaacaaacagtacaaattttagcagaaataggaagagcaagtttctaagtttcttattaaggccccgtttgagaaaatagcatataaagatggggtgtggacacgaaaaaaatatattagcatacaattaattatgttttaattattttatacttgaaattttgatttagttgatattttaaagtaacttatatatagaaagttttttacgaaatatactgtctagcagctaggagtactcgaattaaaattaagataaaaatatgtatcttaataaaaaaaaggacctaagggcccatcaaattaaagcaaacacggggggcacatgacatgatttcttttagtgtggggcctcacaaaacgcggtgcaaaggtgcttcgaacttgcgataggatgcttagcgtatcgtacttacatcaccggcaccacccatgctgctgcttctgcttctgcttctcctctccgtgaagc

SEQ ID NO: 43866 - DNA, 507 bp, Oryza sativa
ttcctgcagcccgattatcaataaatatcaaaggaagtatgagagataggaagaaaagtattatgaagatgatggtggttttgatcctcattgggactgtgaattttttagattttgttggaatgaagggatgagattgccgtcaagagaagattgccgaggatgcagtgattctaataaaggtttcacggggagctcgagccgatcagaggaagctgcctgttcatcagagattgggtccgattcattaggattgttttcaggatgaaaatgagggcaggaattcacaatgttgtccttctggtattttcgccaagaatcaaaagagaagggtctagaggatgaggaacaaggagcgttttcaggaagtacagcaagagatcaatcatcggttgaaaaaggttggggcaaagcaagagtggcgtgttaagagtaaggtactaacggccgatgaagttgaagctgacaaggcaaagagactagctaaagggaaggctgttgcatctt

SEQ ID NO: 43867 - DNA, 1318 bp, Oryza sativa
gggggtcgtcggcggggatcgaagcggagtcgatcagaggagtggagaagagagagagagagtatggctagagagagagaggaggaggaggaagaagaagaagggggaaggaggaggaaggagatgaggagaaggaggcgcttgtctctcctcttctctaggcctgatggatggagagagagagagcacacacagcacagcagttacggttgaattttttttttaccatttcttttctctcgttttctgctgggtgctgaccccaccaatggttaggtgccacgtgtaccgtgttcttcgggtgagggctgacgtggccggtggcggtcgatgtggaataaaccagggaagggagatatgtgttgttcttggttatggaatgcgagatgtttggagatggttaggttggttttgctttgtttggtgaatggattgttgtttttatttagcatgggttttactagtgatagattagcattcagtgattacggtgtaaattggctaaaaaatggaaattgcccttcgatatggtgtttagagatggatgacgatcgagtaaatattgaatgaaatagcgggaaaatagaattgcacgaggcaaattctgtgaacaattgaattacctacataattcctaatgaacgggattgctatatattattcgactgaaatatgggatagccgtgggtggcggaggaccggcagtgggcggtggacttcggcgggcggcgaggcagcagcggcgccgccggagccgcggagatggaggagggcggtgggccggcgtcggtggcgggggcaaagcaagagtgaggttaggaggtggtgggcagtggttgcagatccggcggcggggagccaccggagatgggggaaaacggcggcgcgggggcacctcgccgtcgccgccatgaggagaaagagaggggggaaggggagggggaaagggaagggtgagggggctcgccgggggggcctcgccgacgccgttgactctttccggccagccggcgaggcaggcagcggcgcggtggggtggtggtgacggtggaatcgcgcaacggcgcgaggacgggagtggtggcggcgttctgaacggggaggagaggagttagggttaggggggtctgcacgaatctttaagcgtatccagtggtccaaaattcgaatgataggaggtgggattttctatcacaagatatatagacaacctctttaatgaaagtgaaggtttatcctagaaccatgttttttttttgcagggaagaaccatgcaaattgttattcaacaatatgtaatatgtgatgttcaaatatc

SEQ ID NO: 43868 - DNA, 1293 bp, Oryza sativa
aaaaaacccatgggaagcgccagttgctgcgtgccagttccgtttctggcgcatgcgctccaaatagcaaaggcaaattttgctacaggacactattattgtgtggttttagccgtgggacactgtccaaactcacttttgggggaaaacactccataaacgtggtaatttgccaatagacaccgtgccgattaaaataatgatttccggttgaggaggagagagaaatcgcgtgaaatgtcaaaaatacccttaggcccatatgtcagctctccatctctcctcctctctttcttttctttctcccttcttcttcttcctccctccgcgggtgagtagcaacgcacgccggggaagcggcggcgcaccgctagggacccatcgccaatgacgacgaagcgcagcggccacccggcgcacgagcacacgagcacagcggcggcaccgagcacacgagcacggcggcggcgacgcccgaaggtgtttggtcctaagcaaacgactgcagcttaaactgacaagaacaagcaggcacccaactcagctacacgattgattacttgctgcacgattgattacttaagcacggcgaaacatccaagtccggcgacgacaacgattgccatgacagaggcccaaacgaccaccttcccgacgcctcgccgccggtcgctcggggaagcagagacccagcagccgacagccacctccgccacgccgaacacggcaacggcgagcaggatcacgtaataggcgtagaagagtgccttgctgtggatagaacacgctgcccggcgacctgaaaagggcaaggacgagcgccacaatgaccttgctagctccgccgcccaccagtgcgcgccgcagcttcttgtcggcgtcggcatgtgagtccaaggcttgcgacaccttgattgatctcgatagatcaaatttgttgacgatgatgattccgatctcattgggggacgtactctggccaggttgtatctccctggttcgaagtcatcgagtagcttgttgttggagagtccgtctcttaaacccatctcgtcgaaatcttgaaacaccaaaatccccctacctggcacgctactgtcgacgtttgagatcacgactacggtatttggatggtatggggatcgtcggtaccagggtatatgcgagattgaggtaaaagagatagagacaaggatttttatataggttcgagccccttatctgataggtaatagcccaacatcctgttggtcgaagccggtattgctctttattcatatgaatcacacaaat

SEQ ID NO: 43869 - DNA, 1501 bp, Oryza sativa
aagccgccgtagaagaaatgcgagaagaccacaatctcatgagtatccggagacgggaaagcctcaccgtgcgctggtcgccacctgatgatctccttggcagggagaacgccgtgcgccaccatctccttaagattctcctccgttacgtcggatgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgtcggcgcagctttgcactgtagcagggagtggggaaaatggcgagagttccggcggggaagacgaagcgtcgcttggatatcggatttttcagttaagggtatcggaggtgctaatgggcctaggcctgaacagtactttagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtacgcttttgtcatataatgcacaattgtgttattattttgtctttcaactatatgtttagtttgttaactaatcacatagttgggggttacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatctcgggttttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaatcaataatacac

SEQ ID NO: 43870 - DNA, 451 bp, Oryza sativa
ttctttgttggtgagatcaatcagttagcgggggaatatgagtgcaagaatgatacattgataatctacaatgagaagttccgagaattgatgaatagttttcgggtggtgactttgaagcatgtctctcgggagcagaacattgaggctaatgatttggttcaaggggcataaggatacaaatagatgatgaaggatattgaggtcgaagttgctacgattatagccgatgattggacgtatgatgtgtttcagtatttaaaagatccttctcaatcggcttcaagaaaattacgatataaagctttgaaatatgccttgttggatgatgaattgtattatcggacgattgatggtgtgttgcttaaatgtttgagtgccgatcagggaaaggttgtaatgggagaagtacatgaaggcatctgtggtactcatcaatcggctcacaaga

SEQ ID NO: 43871 - DNA, 1249 bp, Oryza sativa
aaaattttcatacctctcaagactgtaaaatttatctctgtttttttaattgctttcgaggatggtggcgcgcgtgataaaattaagataaaatttggaaataatgcagtgttaaggcgtggtggcaagggcactatgggcgatcgatcgagtaggaagaatgcaaatgtgcaaaatgcatggattgggggtgaatttggggagtggtggagtgtgcagtggaggcgcgcgtgctgtggtagcatcacttggggtgcagtgatcatgcataaggattatgcctttaaggagaggagatttggtctctgctagaatgtcgactacagtttcagatatgaaaatgtcaggtttctgtcgatcaaagatccatcacatgaggcgtctactccatccgtccaaaaaaaaagataacttaaaatgggatgtgacccttcctagtagaacaaatgtagacattgtactaggaggttgtctttttttcagatggagggagtagattgctagctttctgtaggttcaatgcatcatatgcatgatctttttctcctttttttttatacatggcggtggcaggggtagatttgttacgaacaaagcattgcacttttacacttctctaagggtgtgtttagttcacgctaaaattggaagtttagttgaaattggaacgatgtaacggaaaagttagaagtttgtgtgtatagaaaagttttgatgtgattaaaaagttgaaagtttgaagaaaaagattggaacttgtggagattatgggtatcccatatctacacggcgatggtattcgaactgggtacaggatacctaatgtagatagaatatcttatctgtatctcgggttttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcga

SEQ ID NO: 43872 - DNA, 1501 bp, Oryza sativa
gatttctgatttccctccgcaatggcatacgaagttagctgaggcattgtggtcctatcggatggcttgtcatggatcaatccaagtcccaccttacaaacttgtttacgggcatgaagcagttttaccatgggaaagtgtcatcggctcgagaagaatagatttacaagatgaattaacagccgatgattattataatcttatggtagatgaaacagaagacttggttcaatccagattacgtgctttggaaaaagtgacaagggataaggaaagaatcgctcatcattataataagggagagttggtttggaaattgattttgccaataggaactcgtgataataaattcggcaattggtcgccgaattgggaaggaccttttcgaatctataaatttgtttctaagggagcttatatgttgcaagggctcaatggagaagtttttggaagagctctagatggaaagtacttgaaaaaatattatccaagtgtttggatcaattcatgatcggttcggttataccgatgcatgttagccgatgtgttgacatcgccttcagatggccgatataagttatatcgcccttcgaatttttattgttaccataatcggttgtgttatgcggatgtatgatggccgatataagttatatcgcccttagaatttttattgttatcataatcggttatgttgtaccgatgcatgttagccgatgtgttgacatcgcctttagatggccgatataagttatatcacccttagatttttatttttatcataatcggttgtgttatgccgatttatgatggccgatataagtcatatcgtctttagtcaagttataattttatcaatgtttactcagcattgcaaaattaagggggcatacatatatatgaaaatatgcgaattccaaaacaaaatatgtattcagttcaagttcagattacaatcactatgcacagataacttttaaccagatacaagcttgttaatagccgatatagctcgttgcccaatttgttctatgtcctctatggcctgagcgtcggttgcatcggtgtcatggttatggataccacatacctaatagaagttgactaaactcggcaggacccaccacataccacgtcttatacgagaacaaacctcgtggggagagaggacacacccaccacagacgcacaatacacaagccaatatataccaagacaagccgccggatatcaacatcacagattagtctagacataccccatccggctcttacggaggtcggcaagagggatctagcaccatttctgatctcgccgagtacggattcgaggaggaagactaccctgtcgtcgactacgagttggttatctagccaccaagtcgatgagagctagataggttatcaaaaatattgtatttgtgtgattcatatgaataaagagcaataccggcttcgaccaacaggatgttgggctattacctatcagataaggggctcga

SEQ ID NO: 43873 - DNA, 159 bp, Oryza sativa
cctcccccctccccctcccttgtttatataaacccgaccgcaccctggcgccagccatgtcatcatcatccacccccaccggagcagcagccgacgatctcgccgccgccaacgccaacgccaaggagtgcgtgttctgcgagatgacgcggcagcacc

SEQ ID NO: 43874 - DNA, 1501 bp, Oryza sativa
gaagttgatatatgccgattgaatcatatcacagaactctaggttctcatcccaattgatgcctagtaaattccagcaagattgaacaaaagaatagaaaaagaacaggtgaggcatatcctccagaactccagagttgcacatcctacatgatggtccattctgaatgtgaaattgtcttctttgaagcatatctcttgtgttaagtctatccataaatagcagccaaaggaaagcttttactttcatcgtgcatttacttttccatattgatgtgattgcagggtaaggtgatagatgagcaaagaacatatcataaaccttcttgggcttgaaagatggtccccaaatgtatgtccagctatcactttgattagagaggtgaatattattcagaaggtttgagatttcactaagctattgtagagcttgagcagagagaggaaggaagaaattctggtctagatcattttgcatgaacttctgaatggatacgtcttcattggcagcaaaagagaaaatcgtcgggaaggcaaactgaggtatgatgtctgtccaaggatccttccacacgagggttgaatctcctgtgttaatttgaattgcactaagccctctgaagattggaataagacgaaaaacatccctccaccaaaaggatcctttttcttgcatggcatgtcgtgggtgagggttgtttttgtaatatgcattccatagcagtctaacccatgggagtccccttttgttgtagaatttatccaagtgtttcataagaagagcacagttttgaaattccaaattaattatcccaaggccacccctgtgcttgggcttgcaaactttatcccatgcttctagagaaagagacctagcatcaacttcatttgattttctccatagacagtgtcttcttgctctatcaatgtgctctatcaccttctttgggattttgagggtacacatgtaataggtggggagggaggataagactgagtttaccatagtgagtctttgaccttggtttagaaacatggtaatagcaggcaaccttctttctactctgtcaattaaagggacaaagtctatgattttgggccttgtagttccaacaggcagacccaggtaggtgaatggcaaagatccaatgttacatccaaaggtccctgtcgaaacatgaattcggcaataataaaagggggtagcgcacgagacctaaaagtggatggatgtggagacaaggatttagacaggttcaggccctctcaatgagaggtaataccctactcctgtttggggatttgaatccgccgggtatagtatagatctgacgatcatattgtgtcatgccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgt

SEQ ID NO: 43875 - DNA, 1501 bp, Oryza sativa
ttttgtcccttcacatacagttgaatataatttaggccgagtttagttctgtcgaaactagatttcggcaataataaaaggaggtggctatcaagctagaaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaaacccgagatacagataagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtaacccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctaaagtactgttcaggcctaggcccattagcacctccgatacccttaactgaaaaatccgatatccaagcgacgcttcgtcttccccgccggaactctcgccattttccccactccctgctacagtgcaaagctgcgccgacgaactagggttcacaactccggccaaatccacctccgaaaagtgcatcaaaatccttcccgtgatccaccgcctcaatccctcacctctcccaagccatccctcgaatcaaatcagcacatttgagtgaaaccga

SEQ ID NO: 43876 - DNA, 1501 bp, Oryza sativa
gacatgccatgcaagaaaaaggatccttttggtggagggatgtttttcgtcttattccaatcttcagagggcttagtgcaattcaaattaacacaggagattcaaccctcgtgtggaaggatccttggacagacatcatacctcagtttgccttcccgacgattttctcttttgctgccaatgaagacgtatccattcagaagttcatgcaaaatgatctagaccagaatttcttccttcctctctctgctcaagctctacaatagcttagtgaaatctcaaaccttctgaataatattcacctctctaatcaaagtgatagctggacatacatttggggaccatctttcaagcccaagaaggtttatgatatgttctttgctcatctatcaccttaccctgcaatcacatcaatatggaaaagtaaatgcacgatgaaagtaaaagctttcctttggctgctatttatggatagacttaacacaagagatatgcttcaaagaagacaatttcacattcagaatggaccatcatgtaggatgtgcaactctggagttctggaggatatgcctcacctgttctttttctattcttttgttcaatcttgctggaatttactaggcatcaattgggatgagaacctagagttctgtgatatgattcaatcggcatatatcaacttccatcaacctgttttttagaagttgtgggcactgcttgctggcagatctggacaaaaaggaattctttaattttcaacaacatccagctttcaatccacttgtggaggattggtttcaaagaggatttcactcttcttatgcatagagtgaaggaggaagacaaacaaaaataccaatcatggatagactcaattttctagatcccttgtaaagttttttttctttttttctctcttttgtaaatatctttatatatatatatatatatataatctattatcacagtaggagcctctcctactgtttctcgtcaaaaaaaataccataaatgtatatagaagagtattctaataaaagtacaaaacttacaaaatagaagagaaaagttactgatgctaatgagttgcagagggttgtgctgtggcgtggtgtggcgtggtgtggactgatgctactgtgctgcttcttgcttgctgcacctttttttctcccgatctgagattgggtttgcgtcacccaccgtctcgtcgacatatgtacgtctccgacatcggcatcgactctcttcaacttcatcattctgcctcacgcatcttcggtttgatcacccattcaagcgcccggctacaatgacttctaccgccaatcgtcttcaactatgcgtctacaccatcaagcttcgggttgccgctgcgtcgccccctcgggccacagtgccgctgcctgtggtccacacctcctcaagtttttgcaatgctgagaggcaccctcctcagcatggctacatcaccggtggacttctcgccactgcatcgaca

SEQ ID NO: 43877 - DNA, 226 bp, Oryza sativa
actttattgttgagagaagtccatgtgcctccacccacacccaccagcaccgccgccttcttacctaggagtgtcatgcatccctgttgagaagtggaactctgccatgccaagccaaggtgttgtcacctctccgcgaggccgccaccgttgcctccacactaagcccaagagtacgccgcctttcgtctttccaccggcctctatctcgattatactctcaagc

SEQ ID NO: 43878 - DNA, 379 bp, Oryza sativa
cgctgcgcaggagagagaatcgatcgatggaagaacgcgacaggagcaagctagccagcctagctgtagcgacgtgacagcagtttgatctttctttttttcttatgatggctaagcttatacgtaagccgatcgatcgatggcgagatagatcagagattaatatacaggggtaattaatgtactaattacaattaagtgtgtggacgagcgagccgtgtggagttacagctagctagcgcttatgctactcctacttaaggcgagaccccaaactccaagcatacgatcaggtagccaaaccacaccaccataaagctagcttgcaaaggggatagagtagtagagagagagagagaggagaggaggaggaagaaga

SEQ ID NO: 43879 - DNA, 794 bp, Oryza sativa
cggagctagattgatttttagtcttcaattcacaaatttcaatataattattatttactaaagaaattaattccgtcatcaatttattcatctctaactctactattataaaaattgaagttgtttttcgctgatactttggtacatcgtttgcatttgagcaggtttttaagttcgttcacttttgacaaaaatataaggtttttaagaaatcattttaaaatactacatgctaacctacgatgagaatgagacttctaattgcttaagaattcttgccagacaataagaaaacaacgtacaggatatggccatcatcccaataagagttccaaatagatatcattactatcaaataaaaatcccatttactttttagacaaaaaaaatctaataacaatatgattaaaatagcattcacctgttgcaatgcacgggtattttttctagtcaatattaaaatttaatggagttttcactggcaagcctgggcaactgcctaggctagccgggcggtggctccgccactacatgcagttaattcagagaaagcatatatcctactaatagttgtttttagatgtataagggcttacgtgtttggttacctgcttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcaga

SEQ ID NO: 43880 - DNA, 1501 bp, Oryza sativa
aatagtttctcacctcatgaagcggttgtaagcagatgggaggcggtgtttcttctctggggctacaatggaagacataaaaacatttgtcagaggaaacacaagatatgctagctagctgtttgttcatatttatatattccatgtgaacacaagacacagagagctagtgaaggactcgtcagaagaagacagttaacaattagcaagaaactaaggagagactgaatgactgatataaatgagcagtaagcaagcaagaaatttaattagaaagatattgatatctactctagctggtatatatgcacgtgtatgatatagcaagtgaagtgtgcatatagttgctttgctacttacgcttcacaacgaagggtgctcttgggctaccctcatttgatgtcggcgagaccagcggcagcggctggttcctcctgcagtcagtgcaaggtccctaacaccaagaaatatccaacacaagaagcaaccaaggttaattactagcttccagctctagcacatttcaagatctctcaaacgcttgccatgcatggatcagtgtagtagtagtagtagtagtagtagtagtagtagtagtagttggatgatgataaaatcatcatttcctaactattttctcagatctctctctctctctctctctctctctctctctctctctctctctctctccctctctctctctctctctctctctctctccctctctctctctctctctccctgcttgggtagaagtagctatactagtcaactcggaaaacaggcaatgaatgcatctttccacaccaaaataaaaaaaaagaagtaaataaataaaaatgcaggtttaatttggagaggcatgaatgccacagtagagcagctgctagcagcatatgctgcctgagaaaaaaaaaagatgaactggccggccgcttttgcagcatgaggctttcccaggccacagatgggcaagagagaaatcttttgcaatccagctttgtttaatcttgccttgcaaacagtattctgagtggctccataaagccgagacaggacacagagagctagagagagaagggaaaagaggagagagaaaccgaacaaaagaacaccccaaagctctgctaaaccatatttcatgagaaaaaaaagtcccactctccatgtgcaattaataatttctttaattatatgtcttccctttcttgtataaggagaaagatttatcgccagcctttctcctcgcaagaagctacccatatgcagaaaagagaaagtagctagaaacagcaacacgagaactgaagaagatcaagacgacgaagaagaagaagaagaaagaggaggaaaaatatcaagaactgcaaggagattcagagaaagagagagagaaaagaatgaaacgctagcttaattagctagaggagaggactgacctgaaacgggcccaaggggtgatcagttggggagagcggctgcaccatcggcggccgcg

SEQ ID NO: 43881 - DNA, 1167 bp, Oryza sativa
ttgtaggtccagataacatactttgatgatacggccgatcgacactagctatatgtgttcattatgcactcgtgactaatcgattatgttagtaggtgagtttttcacatgagagttgcaggtacgtttaggcatgctcctagcttcagtgaaaaagtacacgtaccgctaattaatgaaagcttatgatgggctgccttttactgatgtttcttcggtgaaagaaattgaaaaatataacggaaaaagcaacagttggggatcatttggtttaactgttcatgacaaaaacaagacgagcagggaagattttctatctgagcagcagctagctagcgggaaaaaggcgacgggctcgcatgcatatgcggtcgtacgctcccaaaatataattctgtgattggtaattatttctccctgagcaggtcgccagcatgtcgcagttcattttctctattacacatgtggagacaaaacagtgcacaccatgaatgatatatggagtatatagcggtacatgcatgcgtatatatattcccaccctgatgttgttgattaaattcagtgaaaatgtactgtctaattaattactaccagcagtaattttattctcgagctgaacaattaattactctcccatccaaaaatatactactacctattttagcatctaaattttatccccaaaacatatcaacttcttcacttactccctcgttacaaccttcttttatttaacttttgatctttttatgaacacgcaaaagaattgcacgtcaatatatattaaaagaaagcagagtttcagttacacaacgcaacctgcaaccattgccgggggacaagggaaaattaaaaagaaagaaaaaaaggcaatcgcaactaattataaccattcttatttaactcttgtcttaatctagcttcatgaaaaattctagaaatatttatattttggaacgcgagagagtacgtgtagagctttacaagaattaaactcatgatttgccaatgatgtgtcccactatggatgatagagctagtagctagcaaggctgcattattattgtgcaccatgggtgagtcaaagcgaaagtcaacaggggaatatatatagtatatagtaatgttgatccccttgatagggccgggcatgcacaatagagc

SEQ ID NO: 43882 - DNA, 1501 bp, Oryza sativa
tacaacagaattcccaccatgcacgggcagctcccacggcaatataatcaacctagccgtaaggtatagagttggataaccatcatacatatcacacacctaatagatttttattgccctagcaatttaaagtaggagaggtacggtaattccgtgttggattgaactcagagcaagggcatccgcaggaattaaaatgagtgagtacgtgggggcgagtgtcatagaatgagaaattaaaaatggataaggacgcatttgcccccactagatcgatcggtgtaaaattgctagagaccaagccctcattcactgctggaaaagtgatatttgctgggtcagctgttttctacaatagtctcgattctaataagaaccgggactaaaaacaatcggtcataaaaaattttgatctttagtcccggttggtgttaccaatcgggactaaagatcatttttagtcccggttcatggcctgtcagaggcatgccaggagacgaggatctttagtttcggttgatactaccaaccgggactaaagtttaattaccaaccgggactaaacatctatctttagtcccggttggagtctccaaccgtgagtaaatatttctctcccatatatgatcggttaagtcccagatgagacttcctcctcaccgagatatttagataaaatcagatatccttcaacccctcgaatctccttcctccttctcccctcccctctcctcctcacatccggcagcgggcaggcggccggcggcggcggccaacaggcgacgaggcagcgcgcgcggcggtgggcagcgggggccgtgcacggggcggcaggcgccggccgtggcaagcagcagccatggcgagcggcagcgcgccggttctctccggctttttttttgataatttgtgattgagagatgtataatttctttttgtacagtttgtgattcattgcatcgatctgagatgtataatcgatctgtgatgtatttgatttgtgtgtatttttttaagatttgtgatgtactccctccgtcccaaaaaaaagacaaaccctgggtttccatgtccaacgtttgactgtctgtcttatatgaatttttttataattagtattttcattgttgttagatgataaaacatgattaatactttatgcgtgacttatctttttatttttttttcataattttttcaaataaggcggacggttaaacgttggacacggaaacctagggtttgtcttttttttgggacgggggagtatttgatttgtgtgtaagtaactttggatttgtgatgtgaatgatttgggatgttgttttgatttgagaatttggggtttgatttgggtatatgcagggcactcgatttggagatttggtgtttgatttggatatatacatggcactcgatttgggagaaaataaaaagaaaatggacctaccgggactgcccctaccctctctttagtcccagttggtgttaccaatcggaa

SEQ ID NO: 43883 - DNA, 1501 bp, Oryza sativa
gtgacgcctgcctgatctaccttggacgacgagagcatgaccaggcaattggccaggtcctcctcctcgccggcagcgcacgctgagggtgtcggtgacaaatcgactcctgtgcccttgcagcgacgcgagcgcttccctttcaaccaaccggcggccggtgcagaatcctcttcgccgtcggcctcgggcgaaggcgaccacggttgcagcgagtgatccacgtcgtcctcgtcgtcgtcgtcctcgccggagctgcacttgccgtgctcgaggaaatgctcccacgacgtgaactccttcccgcagttcttgcacacctggcggctcctcgtgacccggttaggattggtgcggagctcgtagacgtgtgtcgctgcccctgacgacgacgggccgcccgcgttccaaggatcatctgccccgccgcgcgcacgccgcacggcctcatcgccgagcgaatcgtcgtcgtcgtcgtcgtcatcatcggcacccaacccatcgccgtcgccgacgccgtgggccctcatgtgcccgcctagggcgcttccgcacgtgaaccccttgttgcagactctgcagaagtgcttgtaccccgacgcctgcgccgccgtcggcggcggtgcccgaggtgatgacggcgacggctgcatctggccatgatgctcaagaagatgcaatcgttgtatggaaaatcacaatgtcaacatgtctcgacgaaaaatcaaatcaactttcggtgcgagacatatatatatgtgataatcgactaagtaccaaagacggtgaagattcacacatgcatgcgcttggttcgccgcggcggaatcgaattcgacctggagatgggagcgccgatcaagtgcgcgcctccgtccggtgtcacgaactcacgatcgcagcaatgccgcgagttctcctgaacctgaaggtccaaaacagccatccaaatttaaaaacttcgtcactactgcacgtccatagacatatatagttctcataggcgtgtttcgcggtgcatcggccgctttagctagtgacgtttgacaacgcctaggagtgacacgtgccggtgataataagctacatatctctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggat

SEQ ID NO: 43884 - DNA, 1501 bp, Oryza sativa
aagctttatctctataagcatgagtatctcactgttagcggtgacgttacttaccactaaataataattagccgtaaatatgagcatctgtaataattacaggatttaaaactgtaggatcgaaacacaagaactaagacaaccagaggggggtgaatggttggtataccaaaaaacataattttttagcggaattaaaagttaccctcgaatcgatatagatcagtctgactagagtagtcccgtcggtctgaccgcgcctgtgccgccggtctgaccgatgtagattgcccgatctgactgctccgaagtcgcctcagcctcctgacgccgacgccggtctaaccgccgcaatgccgccagtctgaccgccgcaatgcagccggttagaccgacggtgtttcaccggttagagcgccgaacccgagaaaacacaaatcgaagaactctcaaagtagatgacaactttattgctcctctctatgtttacaaagtgcaacaacagtactccttacaaaaatctcgactaaactcgaaaccctaactaaactatcaactcaatgctctcaaaagcgataccgggaagcctcacgctccctctctatttatacatgaggtaggcagcctaaagccacgaaccaaactcattctagaagtcctaatccacctagaaaaccttcccgcacaagaaacaaactttacaaactctaaccataccaaatttggactccttccaaattcgactccacatcccatacgcacacaatacctccgtcgtatgccatatggaatcttcaccaatcacgtgcattgaactttagcctaagtatcccgtatgatatatgatcgtcacagacatcgccttatccccaagtcgacttccgatccatcaccggatatactctcccgaggcatcaagtcacctacacatgaatcaaacaaagaaaccatattccaaaaccaagctatctccaacttgactcattgttagcaaacaacagtattacatatgcatagtatccgtctagaatccataaacatgaaacaaacacggatatccaaacaaacaactgaaaccgaaaccgacacaatgttagccgatcagaccgcgggctagccagtctgaccgcgcaatacacgccggtccgaccggcagcacctgcccagtctgaccagatcaaaacagcagcagtacctgttaacacctgtaaatccaattatctccaaaaccacttcgacaataatccaaatttcaaaaccaataatctcagatgccaattgtttatcacataataataatcaaaaacacttttgattttacaaaaacttgatgagctagtttcaccgtatgaaacttaactagctgatatgagctacgttcactttatatcatcgagttaatttggatgcaataaattcgttgtttggtcttgcaaaaccttagtaatacatttttataatatgatatcattgttatttataattagaaatatttgtacat

SEQ ID NO: 43885 - DNA, 1501 bp, Oryza sativa
agtccctcttgggacgtatagtttactcactaattccccttttgactggatagtgttctcttcattcgtaattgattatcgtattatcaaaaaaaaatctgatttgatcatgacaacaacattgggagctagcgaaaatgtcctttttataacatgcatgtatgcatgactttaatgcggagattagttaaatcaccgatcgtctttaaccatatccaatgcgtgcatgaatttaatgcggagattagttagttaaatcaccgcttgtctttgctgaattaaagtaaaactatatttatttagggatggagggagtagttttcggtaataatccaatgtggtggttactccaattactcactccgtattcgtaaagaaagttgtttaggataatgttcaagtcaaaccttagaaatataaatcatgaataactctcaagctgttgagtttgaaaatataaaaattatatgaatagactttttttttgcaaaatactttcataaaaatatatcacttttaaataaatatttttataaaaacaagaagtcaaagttgtgttttggagaccgtgtcgctgtccaaaacgattttctttataagtacggagggagtatattagaaagatactacacggatagcaaagtgaaagtaggataaggctattcccaactcaatgactaggatgatgtccatattattaaataagctaccatctaagatgaaaaatgatgtggaagtgaatacgtgaggaaagagaaggaaaccatgacttgcatgagacatggtttctacacaacatataagacattatgtgagataagtagcattaaatttaagtatgtaatagtggtgtttgtattggaagagtagtgtctagtactagttttttgatgatgtagagtttatggaaactatgtctagttccttgggttgagaatggcctaattaactagttaggttttttttatggtataacctgttcactcaagttcaaacctcttcgacttaatatgggtagtcgtatttacggctaattattttttcaacggtagacaatatagccatctgtaatgaggtatatatggtgattttaccaatccctaaaagtactgaactaatctgttggaagtgtttataggagtatggtgaaatacgccctcagttttcaattgaataactattgccagaactactttaatggatcactcgtcttttataaaatgtacaaatatttctaattataaataacaatgatatcatattataaaaatgtattactaaggttttgcaagaccaaacaacgaatttattgcatccaaattaactcgatgatataaagtgaacgtagctcatatcagctagttaagtttcatacggtgaaactagctcatcaagtttttgtaaaatcaaaagtgtttttgattattattatgtgataaacaattggcatctgagattattggttttgaaatttggattattgtcgaagtggttttggaga

SEQ ID NO: 43886 - DNA, 161 bp, Oryza sativa
cgagcgggcaagaaaacgtgcgctctgcttgtcaaaggtcactcccggctgtagactagccctcattgtaaaaagcatgtttcctttcttaggcagctagaggcccatgtggtgacccctgaccagataaaaaggaggcccaggcctaagagagaaggaag

SEQ ID NO: 43887 - DNA, 1027 bp, Oryza sativa
tgcgccgcaccgccgccggacaccgcgccgccccaccgccggacgttgcgccgccccgcgcgcgtagccgccgtgctggagaggtgaggggaggggaggagaggtgaggacaggccagccgtgggtgaggggaggatttgagacttagaaaaaaatcactcctatccaagtctatttatattcgagtctattttcgcaggcggaccacttaacgccgcttaagtggtccacctgcgaaaatagattttcgcaggcagacggtagatttcacctcgatttatatttttataggcggtcatttggctctaagggttatgtccgcctgcgaaaatgagacccccatgttgggaaaaatgctttttctagtagtgaaatatctaacatttggatccaggggatttctagagatcaaatgaaaaggatcaattatatgagcagcataggagggaattttcttttggtatcaatttttggtaccaagaaaaggaaacatattgatagaattttggcatgacttacaactctgcactcacaaaatgaaagttgcacagatagattttcatcaaactagtttttaatgctgagagaaaaaggggtgttacaacgaaggtgagaagttacattagagttgtataatatgtacttataatctgacgtccaagaatttgtaatggagttgactgtcgatgttttaaatttttaaaatacaattttgcattctattttaggaaaaagtatattttacatcttcagctattattgaagtccaaaaaatcacccatgtgttagcgatagcgctattatcgcatgtgataatatatgcatgtcgtgtattagagataagagagactttggataagaaacttcttgtactacaatgcatgtatcttctatctctctgtaagccatgttggaggctatttcgaaccaatacaaatacatatatgcgacctctgtatgaggtgagaacgcttccatattttctacagagaatatatggtatcagagcctcctcaccaaaactaga

SEQ ID NO: 43888 - DNA, 1335 bp, Oryza sativa
tcaatgggctccttccgatgtcactgaggaaactctcaaggagatggtggagcacggagtattaccatccaaggagatcatcgaatagcgtccagcatttggtgaggcctttccaatccccgatactcatgaaatcgtagtcttcacccatttcttctatggtggctttgctcttccaacctctaaattctttaggggtattcttgaattttatggaattaatatctaccatctcaaccccaactccattattcatatcgcaaactttgttcatctttgtgaagccttgctgggcgttcgggctcattgcgccttatttcgccgaatctttttcttgaaaccccagccaaataaaagcaagccttgcattgttggggtatctagctttcaacttcgtggcaccctatgccaaaaatacttcacccttcctttcaaaacctccaacaagggctggcatgctagctagttctatatccaaaacccagatccttccctgcccaaatactcatgcatccctcctaagtatcaagatatctggaactcactccctatgggcgatgaagcttctcaagctcttgaactgctgaaccggctgttgaagttgaaagaacagggtcttcaaggagagcagatcacttggcatttcataaagtgtcgactggctccaattaaagaaagatctctcgcacggccttcgagtatgatggggagaatgaccccaacctagaagaccctgactccctcgaattcaagatcatgaaggagaggatgtataaagtcttttcatccagtattgcggtcagcttttcacatctactgtcagtcgtgccatacaacgccttcaatcctcctccagcggtaaatatctaaatgtttaaatttccatcatgcttgctgcctttggaaataatctttaaatcattatctccaggaaaatgccttgatgaaatctgagccaccaactactgttgacgaccaaatttggtagatcatgcatcaaattcaaagctaagatcgaagcggattttgtggaaggtcgtttctcagaaacatagtatgcatcggctacgggaggcatcgactggcgcctgcatcggctgacgttggatcagacaaataatagccgatgcagccgatcttggtaaggtggttctagaatcatctttgggattgattgatgtgatgcagaagtattgccacgattgggataagcccacagacgggcaattgtatatattaattaagatattttgaatagtttccttagagatatttatcggcaagagtctgcctaaacgacttgttcgtatcttacgtttgtaacatatttggagt

SEQ ID NO: 43889 - DNA, 1501 bp, Oryza sativa
atattaatcacaaaactataacatttatagttcaactataaaatatataattttatgttaactttaatattaaatctatagctttttatgtactttaaatatgtggttttgtgatatggtgccttaaatttataattttggatagtttagttaaaacacctatagtttcatgaaatttatttttaaaaattctctagtaaacacatgcctcaatttgtttaccatccgctcgcatgagcactgtcgcaagccatggccgattgattcgatgtcccagagtggaatctcttggcaaagatcatgctgtacattatcacgcctgacaataataaacaaaagctacttgtccagtgggagagaaataccaatatccaatcaagatcaggagttcaaaaaaaaaatctaagatcaggggcatgataactttgatcattattatcagaaagcaaagcaaagttctgctttattcctgcaagctttatgtgcgtgcatataccaaccagacatctctttccaaaaaatgatcctcacaaatgaaataaattaacctttggcaactttaattattttcgatgaagcagcttattgcaacctaacctcatcattctgcaagtagtactgatgatgaagaaaaactatcagcagatccatttttatatcctctctggatcttcatgtcaacacctcgatgccgctgtcctatgagtacccaagaacagtattcccactgatcatccaacctactaaaatagtgcaaatctgtcggcagaaagggccactcctctccagcaactccaagaaccggttgttacaacgccgcggccattgtcgtctcctgcatccatcggtcgcttcgacgtcttaacagaagttcccattaccatcataaactagcttatcaaccggcaaggcaagactaaaaagatcagaggcatctgttcttcacttgcccacaagccacgcgtctcgccgtgacacaagacgccgtacctgaacagcaggtagcacgtacgcgggaaaagtctcgcatagttaaatgtgtacgggttcgccgggcaccgacgcgataattcgccactcgcgcttgtttttccctcataaatccagcctcgtcgatcacggatgccgcccccaaccgcagtagtgcagtaccagccatcaatcagatctgcccctggatgcatttgtcgtccgcttgatcataaataagctcgggtgatcgggtcaggggcctcaatggaaggtgcctgaaggcttcatctccgtgtctcgatttgttttagctccagtttgcgtgtacgtgctgagtttttttatgccgatatcttttgtttctttgctccttcctcgtgtcgccttcagctgttcagttccgccattgttaatagcttctttttgcccccacgcttgcctccctctggtgtataaagtgtctgcatttgcaagagttctctgtgtacttgtgtagcataggttttgtgaagaaccaagcttttgccat

SEQ ID NO: 43890 - DNA, 1501 bp, Oryza sativa
cttgacttgtaccgtatctgtacgctgtactagtacagtactgacagtaccagctacaaagtgaaatggaaatttggaaattacctaccgaagtccaaacacgcacacacacagaaacacacagaaacacacaaacacaatgaacaccatgcatcggcagcacagtagcatgctactaacatgacagccgtagcaagcataacaaatgcttgatcaacaatgatgctggatacttggtcgctacttgatggtagtactaaatatgatcctgagtggctagctcgctagctggtaggtgtttattcggggtgaatggccatcatgtacataaatcgggggcgcacctaatgcgtacccatcataaccagagagatccctaaagcggttagttggaaaggctagctctcgcagatgctttgcttgcttgcctgctaagtgctaagctctcaacgagcatgcagcagctggtgcatatgcatgcctggtggttaaaattggcaggaagataatgtgaaggggaggccaggagtaattccagggagattaagaacaagatgaggctggatttggatgggcataattctgagagatccgctgatgagatgcatgcatgctggccgggcactcggtcaggctttgtgggtaagcaactaacgtgctgctaataagggattaatcgttgcctaaaccgtatcgagatcttttgttcccaccatacccagatcttaatttaatgagaaaggtataaaaacagtggtgcattgtaagtgactcttgtgatttagaccccggctgattaatctgccacttattactatcactgattccccaagccacactccaccctgtgttcgctttgttctcactggtctacccatcttcccaaccttcttgtcacctactctttgttcccatctcattctgagccctctattcagacatatctcacccaacttactgaacgcctgagctgcaccaaggtgtggcctttggatgatcaggatataaaaatggtggtttaacaaggcaaagctatattaaggagatccatcaaaagggcaatttgacagccatgaagtgtagtggcatcttccaaggcgggtaattttcagagctattgcattgagtacagcagcatcccacagtacattccctcgcatagaaagccatatggcacgtatgcaaaagccatttctgtatggtagcaaataaagatttttaattaggactaatctgatcaccaaaatagccaccatctcagcaatacaaccgctactgctaaaaactacgcactggaccacatgatggtacatggcaaaacattagactcatttcatcgaaaagaacaataggctcattcctttcatccgtactaacaattaactacaagcatcagtccgaaatcttccatacggttgggcttggttctacacgagcagtaaaagaaatgctgcaaatacaaccagtcaagaatacaatgagtcacccagaaaaaaagggg

SEQ ID NO: 43891 - DNA, 212 bp, Oryza sativa
  unsure (1)..(212): unsure at all n locations
aagactctggtatagattaattctaatttatcaccaaagaatcntttacatactcnccttagcaaatcacantttcatcttgtttttcactaggcagatgagttttttaccacaacaatctgaaattgcaccagtaatgacataataaaagacagcatgttggtattactgaagcctactattgcttcatttatcattactactaaatcagt

SEQ ID NO: 43892 - DNA, 445 bp, Oryza sativa
  unsure (1)..(445): unsure at all n locations
gaaatatgttccttatgaggaaaataatctttactggttttattatggttaaaaacagtcttcatagggtttttaatttcggatttttaaagtttagagcgcatattgtccttaataatcattaccagaacatgtaacaaaatatgttcttttcctagttagaccggccggcacctgttaccctcncctttatattagttattttttggcggaaactagataccttctggacagcagcgtactccatcctgcaatcctgctgttacgccttgccatgcataatcaatgaaatgtgaagcaactcctgttcggatagcgcccctcctgttattagcggctttaagtatcccggtcctaaatacgggccggatcagtcactagatctttgcaccaaacactagccatctcgtccaaagatccttagcatttggtggtacgtgtatca

SEQ ID NO: 43893 - DNA, 1501 bp, Oryza sativa
agttgttgcggcgacagtcccttttccttggcatcgtcggcagtcgatgaagaaggggaaggggtagagctgcgacgaggtccttgtcaaccctgcagtcaccatccccaacaaggtgtggctcaggttgattccttgatcgacgatcactgctcggggatccaacctagatctaagcgaccgtccctcacaactccacatagggaaaaagtgacgacgtcgatagcgcaggggaagagcagagagaaagggacaactggtgcttgtaggcggaaagcttgtccgcgtgcatgaccttgtcgaagctggagcaactcgttgaccaaagggagtggagtttgaaagggtgggagagagcagataagggataattagatcttttgttacacggttggctgagctagcaagaaaaatggcaaaatagcaacaatctagtgggtccgatggcaaataaataaagttgtttggtaagatggtattggagaatatgtcgctgagaaatatggcaaatagtccaagatccccctagctacttccttctccttcgtgcgtgttttagcgtgtaactgcttcgtgctggctttttctttctataaacgtttgatgaattctgaaacagctggaagagcaagtttgctggcaaggtagtatagggatattccacccgggctagagcatcgcattcgcatatatcggcgctagacgccttcaccatcgtagcgtgacaccagcaaattccgcagccagcagccagcagccagcagatccgcagaagtccccaatccgtccaagctccaacaacgctggggagtgtggccccgcctggcccccaccagctccaccaaccgaggcacacgctgcggctgcgcgagcagggcccaggtgacggccgcccgcacgcacacgacacgacaccaacgacgcgacgcttcccctttccccccctcatccgccgtttgcctccaccccccacccactccaccgtccccgctctccccccattgccgccgccgcctgcgacggccgcgagctcatcccgagacgacgtctctagctagcatcgagcgttctttctctcctcgggctctcgttggtaagccctcgattccggtttcctcctgcttctcctccaacctgcccctcggattagtcgccagtttgttcctcgttagttcttgcagtaattatagtgctaagctccggttgtccgtcggcaatacgccggtagtccatgcaccagtctcgttttcatgggttttgttgtttgcagcaggcatacccctgtttcgctagctcaatcaatcatttcattgctactattttttttgttttactttgtatttaacgagtacttgcatctatgaaacaaacttcacacaaatttgatgctcatcaggttcttagttccaccttcttttgtgttttttttgttcagttgagataaggcaaatcaagagagcaaaattttggtggtacatgtggtgattctatgtcgacaagg

SEQ ID NO: 43894 - DNA, 402 bp, Oryza sativa
attctgcccatcagtgtcttcttaatgtaacagtacttctgtacttatcatcctacattgtgcgctggcaaatgcttctgaagttgaatttccacggaacagtattataaactagtgctagatctttcaccaatctttattaattttctactacaaggttgcaatttgcttaagaatagtaacgtgcaagttagtagtactccatactatagtatgcaatcattaattgccttgcaagttgcagcatggttcccacacactcgtttgcacttgcagaaaagtttgcaagttgactcagccagcacaaacttgttagctgctgcttaaggctttctctggattgaaggaattttacagaaattttgatcaattcatgtaaaatttctgcgtgtggtacaaagg

SEQ ID NO: 43895 - DNA, 419 bp, Oryza sativa
cgccagagtggctggcgccgtcgttcaacaggacggcgccaacctctttggcgccgtccccctgccgacgtggcggggcgatgctgagatggttagggggagtgcgccagagtggctggcgccctccccccgaaattttttatttttgttttatttgtttgatattttttttcacgctttgggacacacaagaaccaaccatagaaaaattgaactcaaatggacgtaatatgtgacatgtagaatttttcctctcctctcctctctctccgaactagtgcagaggagagatgtgcaacttttttatttttattttatttttttgatatttttttcacacttaggaacccacaggaacaaaccatgtaaaaaataaactcaaacggacgaaatatgtggcatgtggaattttccaaagc

SEQ ID NO: 43896 - DNA, 876 bp, Oryza sativa
atggattatggagatgacgatgaagaggacaacatcgatgagacgaatagcgtgcttggagggaacccaacttccatttctgggcagaaaccgttttgggctgtgtgaaaaattagtttgttctgtactccaatgcaagttgagtgcaggtagagaatgttgcctgacctgatgcatcagctcaatgccattacgctaacagttcatcgctcaatgttctcagtgtgagctatgtacaatatccagttccttttcttttggggtggttcaaatgtcgacgtgatggtcatttttcttttgacatataatcctgtagaagctagtgtgatcaggcagggcaagggcacttgtctgcacgacattcagagtgctgatgatgcttaagccaatttttgctagcttctcttggatgctgtatgttgctggttttgttagtttggtgaccttgacttgtaagatcaatgcaacaaaaccatgtgttgatacataaataagatcccattttgacttcgcaattatgtgcattaattaatctcttgcagcctgcaagtgttgcatctgaagtccctagtcataaccaccagaattgccacaaggatattccacggttaaaccaaagcatctgcggatccagctccgaacacaacgattagtcgattagattacacatgcccaacacgtcccatcactaatctgataaatcttgcagagattaacgccattttctcctgcgttctctttctttcttcgagccacttgtgttttggcttagacgccactctttcctccgtgccagctctgcgttaatcatcttcctcctcgctgtaccaatctcttgctgcgtttggggggagcaaagcgagcgagaggccgtga

SEQ ID NO: 43897 - DNA, 1501 bp, Oryza sativa
actaaaactggaaccaacaaggatgtgtaaattggacctaaaacatataagttgatgttaatgtgggaaaaggggtaaactactccgtcaacaaaaggggggggggacaaacctgctgagccagaaggggaagcatctggacataatcgtccattcagaagactaggatgataaagaagatgtaagcatcctcctatctgttggttcaatgtaaaactctcttcggccatgttcttaacatggtcattggttgctctccaaggcaaacctgcaccatttccaaaactagggagtacatctcctccacgggatgccagacgacccatcctttctggcccaattggctccctaaaaatgtatataggtcccatttctgcaaacaatggacattgtcgcctccgcctctgcaggcctgcaatagttggtggaggattcgttccaatgcagcaaaatgctagtggttttgagatgcgtgggaactcaaaaggacgactctcatgcaagcttccatcaacgtacaaccgcaattcactgtcgccctttccaagcaaaccatgcttgtttgtgtgctccaacccaacgaagtaccatcgctgaggtttaaacgcataagtgaagtgcagagaagccttcttacccctcccacccccactttccaccaccaagaactgtccatggaagtaagcctccacaccctgattatctgaagagagaaagctaaaaagtctaggcatgtgtgttgttccttctcctgcaagagcgctggctgcagcagctgctgacattgctgatgattttccagatgttgctgcggctgcagcagcaatggcagctgcagctgttgctgtactaagtgtatctgagaatgattctatgtaaatccaagtagcaaacccgtagccattagagaagggccacctgctgtcaccagggccaagcaagccagagctctccccgtcaaactcaaatgtcgcagcaggacctcttgcttcctcactccccatggctttctcaagtgccagcatcagtggtgttgcccagcttgtaccaagcgccttcttaaccaaaccaagccacgaatgcaagtccttcacgctaagcgagtgcccacccaatagctggatgcaatggagcagtggtgttccgtcccagctacttgcccgacccattccaatgagtagcttctcagcagaatcgaggaggacgggtagaaggcccgatgaagagcacatggcacgattgcgtgtgcaggcgcggagcgtggcgtgaatgcccacggccatacgagtgcgcggagatggctcatcgccgcaggggaggtaaggcaggagctccgcggcaacaacggcggctctcgagttgaacatgatgcttgggggagcgccggtgccggtcttgtcttctacctcgtcgaggccatcggcgccgcccatggtgccaagcagcacgtccacgacggtgtgcggcaactcgccctgttcctcggagaccatctcgtgga

SEQ ID NO: 43898 - DNA, 1501 bp, Oryza sativa
gtggaaaagaatctactatacgcacacacgtccataacaccggaacgcgcatcagcgcatcactgctagtgtttaatcagtgaaaaatgcctaggatgcataaaatttaataggcgttcatattccagctatatgaaaaataataacgctaaagtgtcaaacaagatttggtattactcgaagcacctcattttatctgtatgttaaaggcttattcacttctcctttgaaatggacactacattatcatttattttaaaagattgcaccaaagaaaaattcctatgcctccacttcaatcctttggatcgtttgctacacaaccataagaaattttcctatgtttttcaattcttaaaagtttgcacaagtattcccatactatttctacatttttttctattattacattttgaatatcctagaaacttaacaagccctaaacttataccattcacgttttgaatattaagtaaccatcgagttgtattttttgtgggggttgggggggtgtgataaatcttctcacactttggtttgtgtttaaagcttgaaaacctcctctcccattgacccatttatttgttgaaaccacgttttcgtatgggaactagaattgattacctgatgacaatgtaaccacatcacatctatttgtaacataccatacctgttaaataacttcccattataaagatcttaaataggagtacagtctaaataataatgcattgcaatctgaaaaaaaaaaacaccagtttcaagtggtgcacttaaccatgtcacaagcatatgctcgaaatgcaatggcgcctgacgtgtaccccaaccaggctgagagagcggtcatcggtcgacgtcccaactttcttttcacctcacgctacatgttgcagcgtttgcgccgttgcgctagcatttatgaggtgcacccataatttttcctactccaatgctgcgttcgcgagcactttcgtgttgcggttttccaatacgtaaccatgcgctagagcggtcgcgctctcttttttctttcttttttcattttttaccctctttttagtttttgagcgagcacgacgatccaccccaccaccccggcgcccctcacgccgccctccccgaccctataaattcggccatgtttaaaccatttcaccacaaaccagcagcaaatcaaacgatcaaattgtaagaaaggaaaataaaaacagaagccctcttccccaaactcgagggggtcacgcgaacacgctgccaatggcggcgagcactcgagccctcttcctctcctgcttccacggaagcggcggcggcggcggcacttccgaggtgagccgccgcctcgtgctgcggccgcggtacccgtccatgccgcggcgaccgaggtcggccgcggtcgccggagagggaggggaaggaggaggaggaggaggcgacggcgatctggaggcggcggccgtgggggcggaggaggaggagaaggtggcggtgttcgagg

SEQ ID NO: 43899 - DNA, 1501 bp, Oryza sativa
taaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaactcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctggtccttcgtttttttctatacaatttaaaggggcccttaatttttagcaacaccatgtggtcctcaaactcatcagcagcagacaacaactaaagagccgtgtaatatatcagacaatgcaattagtagggagaggcgcccataacacacagaagagaacaaggatcagagacgaaaagggttagccttttaacgctgtgatctactcgccgctacaaagagaatggacggattgatccaaagtgcctcgactttactacttgcggcggggtacaccgtgccgcccggcgtgccgcgcgctcccaacgcgagagggggtttcga

SEQ ID NO: 43900 - DNA, 1501 bp, Oryza sativa
ttggcattttggtcatatattcgatctacatagaggaaaaatgtgataataaactgaaagatactccctccgtttcacaatgtaagtcattctagcatttcccacatttatattaagaggtctgctatacaatgggatcccgttgcaacgggataatttcaatgactctttcctaatacttgtaccttggttaccgggctggtacctggtaccttgggtagtgactagtacttgatacctgataccctagtaccgacaagtacaagtacctagtaccctagtaccggctaatacccggtacctggtaccttggttactgggctagtacctggtacctggtaccttgggtagcgactggtacctagtacctagtaccctggtactggcaggtaccaatacctggtaccctagtaccgggtaatacatggtacctggtacactgggctagtaccttgtacctgtaccctggtatcggtaggtaacagtacctggtaccctggtacgggctatactttgacaactggtaccctaggtatcgagctggtatctagatatcaaaccttggtacatgataacagcgtgataccccaagagagaggaggaggagcagttgcggagtccgggaggtcgagcagcgggacgagctcgtcgcctgggggccgctgccgaggatgagaaggcgacagatctggtgcctaccttgtaccatgcctccacagcctcctcaaccggctgtggacgacgacgtgctcggcgcacccctgccgccggccatgaaggtcttcatcaccgatgctgtagcagatccacttgttgccggccatggaggatgccgccgcaaccgcaccccgttccggctccaccgcgccccgctcccgccgccgagctcctcgccatcgccaccttccccgcggcggcggccgccggctccggcgagcggtgggtgacggcgacggggagggctgcagtgccgcctgatttgggggaggagagtgaggtaggaggaggtgacggggagggctgcagtgtcgtgtgatttgggggaggagagtgaggtaggaggaggggatccggatgatttgggggaagaggagtgaggtaggaggaggggatcccgtctccacgggatgccgtggtgtaggttttctgttatattaatgttaatgaatctaaacatatatatctatctagatttattaacatcaatatgaatgtggaaaatgttagaatgacttacattgtgaaatggaggaagtatctaagatggtcagcgggatcatgtatgcactatgcaatacaacattcttcttctaacaccggttgatattactggttcatatatatctactgttgatataattccatatactccctccgtccctgtcgaggagtgatcctctctagcgggaaatcgtgagatcccctttttgtgagttcggctgggggaaagagctcgcctccagagatcgtgtatccgccctgaatgctactaagtcacata

SEQ ID NO: 43901 - DNA, 1501 bp, Oryza sativa
caaatcccagacaatccaagtgaaaccggatgaatcttgctgacctgaggaggaggaggaggatgagcagccgaagagtgagtgcttcggcaggaggagcgagcggggggccgaagcagaccagacgaggaggcgctcttgtcctctgcgcttgcgctccccttgggtggtggtggccaatggccatggcttccccacccggataagccgacagacgtgtggccgtgtgggcggctgcctctccagttcgtcccggacacggtctccgcacgacaatggcaggtggggcctgctgcggtgtgggccactttgtcagtgagagcagaacggaaacgaaacggcggggaggcccaggggaagttgaggcgctcgcggttctcgatgggccatgggaagttgtatcggcatgtgtgagcggtgcgcccagaggcccatgaaaagttgtgtcgaaccagttccggttattttgccatagtcagctgtccaacgattattttgcgccatacagttaaagagctgtgagattttttttttcttgatgcatttattaattcaacatctttcctttgtctcaaacaagtctatacggaaaatttctagaggaatgcaaacctcttaaattctttcaataatatgttgttccaaaaaaagcctcaaagcagattttaaatataagcttctgcggtaagaaatatgaataagtgattgcttgtttatatgcataactaaaaagtgttatattttaggattttatattattcaaaaataatttagaattattatttattttatttgtgactggctttattatccaaagtactttaaacgcaacttttcattttttatatttgcataattttttttaataagacgagtggtcaaacagtacaagtaaaaggtcataatcctttatattatggaacggagggagtatagcagtatctacaatgtgggaataagagtaatcacagcatcagcaatgtatatagcaaaaagtgattaatatatatgggactcacatacatggactttaaatatagtaatatacacgagataacattaggagagatagataataggagtattgtttattttatatgggtagtccatatgcatatagggtttgtttggctactagatttatggttgcgctgtagctgcaccaacaatgccgcacacacgcagcggtagcatagccacagccgatgttgtccgcttgccgaatagcccaatggatatctttcattattttcttcgtattgatttattgtacaatgttactgtatgactgatgtaatattatattatctatgaaccatgttattgggatatcctaagggaatcttatcagtatattgtaaatgtagatcttaagcaccaaatggagcaaatgggctctttgcttagacctgatatctcaaataaaaaattgatattttttacaaacatccaccttaacacttattggacttgggctctatagagttacatgcatcctata

SEQ ID NO: 43902 - DNA, 1501 bp, Oryza sativa
gaagccagagtccacgggaaccaactcgccgggagatctcgtcgaatccctcgactacgatctcatcggtatcacttgtttcagttactctctttgtaatctgttctcatcatcatcaatcacatataaactggactagggttattacttgataaggggcctgaaccagtataattcttgtcttttgtctgttttgatgtcgtactacgtagacccctgctccaacgtaccttaatactctattcatccagtccgcgagtatcactcgttgacaagtacggtgtcggtttctaccgatcaagccaaccaagcgctctgtctctacccatggaggtgcagtcgtactagtggtctggttgggccattgtttgctcagaccccacaagaacattatgtacacaatgggcctatgagggcttatgcatccttcaaatggagcaacatttcccagaactcacgacgggacgggatatagtgcgcgctccagccgctgaggacgactacttcggttttattgggagttcggttcatgcgtgataaaactgatctctaaaccgaggaccgaagcagcgcaaagtaaaaattgagccttctcccgaaaactggagaaaccactagttcggctcgattcgattcggtgttcggtccacggtttatttctgcccacccctacttgttattcagttttgttacaggagaggagaagtatatgccatgcaagctatggaggtaggaaaggcgaacggatgaaactcctcttttatagtagctgataagtaataagtgttggagtagagatccccatcaattaccccatccgctaaagaaagccaccaaggatacaagggaccatattggtggtttattgaagaccattggatttctgcatatcaaatacgatggcctaaagtcgagtcctcaaaggatcgaaaactcttcaataatacacttgagggataaagcgcgcgaagctctcaagtaattcgaagagcatacaattgccaaaggaaattcaagctaaaacttagacaacgctcttcacgaaggaaagaataatcccaatattcctagaagatgctcagggaccactagccatggaaccgggaatcctagtgcttagcttggcccatgggcctaaaccctagtcgaaatacatttctaacgctcattgacttgtgtattgcacacaagttcaattatctctcgaacgagattgagtgaatagtaacatagagagaacattgctgcatcacaaagtggtctgctgtggctgcaactaggtatttgttgcccatatctatattgttttgggaggttatgagtaaagatgaatcatccatttaagttttgggtatagagataataatacccactttacccatattcataaggtactagaaaagaaacgcaacaaagcagcgtaataggccaaccattaggaaatatcaatggtccagcctgtataatgttttaatgggcaagttttataaatgttttttaa

SEQ ID NO: 43903 - DNA, 1501 bp, Oryza sativa
gcgcgcggtttcgcgcaatggaagagcgagaccgttcggtttcgcggaatcaaacagcgaaactgtccaccggttccatttaattagtgcttaattacttaattagcaattaactaataataattagcaactaattatcttaattagcgattaattaataaataaataattgctaattaagataattagtcgctaattgaatcagcatggcaccggtctcgctcagtccttgcgcgagaccgttctgtctcgctgtaccattccgtgagaccgagcggtctcgcgctttcgccgcggataccgctcacgacgtcattcccacgttattctcgcgcaacggttgtgcgagattgacggtatatttacgcaaaaaattttacatcccgaatatttataagaaaaaattaaataaacagtatattttcaaatttaattcgaattcggattgaaatacttttacaataaaattttaataaatcatttatatgtgtaagagaaattttacagtgcctcagctcaaagataacaagtggtaaaaaaaagttttagtgtaattttcatatctcctaattaatagtagggtatcaaattttacacatttatgatgtatttctaatacctcctagagtactggacaatcacttagctatgcataaagttttgagtgaattgcatcatgggccaagtattattgcctaatttccatcttggaccaggccatatgcaatattttcactttaggcaagggtttgttaccatctttgcacattgggccactattctatcaatctgtcagtctatccgtttccatttgctagctgactgccaccactactgcactacgcaagcggcaagccgttgcttcttcgggcattcaccaactccggcaatgcatccgagagagagagagcgcgctaggaaggaggtacagtcgagtgcgaggctgcgagcacgtgcatcgggccagttcgcgtagagatagcttcagccttcagctgagctcgagttaatcggccagagcaggcgaagaacggttggagctcatgtgccgaccagctctaagcttctgttgatcaattttgaggaagccacccatgctcgatggcagctcgattgtacaaactgaaagggaggggatgagtggacagaggccagcaacaatcgtgtggaagccctcacggcaccttggcatcctcacagtggtggcgcacacaccaacagtggcagcaggctgctgaagttggagatggtggacaagggtggtccaaagtgaaaaaaatagtaaagttatatggtctaaagtgaaatctttgtattaggggtggttgtaggattgagatgtcgactagaggggggtaaataggcgatttaaaaattaaataacacctaatcaaatctaacctaagttgctagacttggtgagggtgaactctaactaagtaactaagttatgttttgcaaacctagggtgatagtggctcaattatatctctaggaaagt

SEQ ID NO: 43904 - DNA, 1501 bp, Oryza sativa
cccccctccctccccaagtctcttccttcgccccctacaaccagcaatgctcccttgcttaaccctctccacaaataataaagtaactgaatttgactacttcgagctcgaggatgccatattcgactagtttgagctcaagaacataggatcttatgtagtacgacgacgataatgactagaggccactacagtggcccatatgacggcgagcaccaacgcggctaccgtctagctcctatcccaagccggagcaccgacacggatgctgctaattaagtgctaaccctcacccatccgagcagaagcaatgaaatagtggcggactgtcgtttctccctctcttttctacaccctcagcctcgagcactgcaagctcccactgtgattatgttttttgcttttttttttgtcgattttcatatatgtcacatttgatattttttggcccgttatagatgtcttgatcactcacggatgttcacatgttacaatgagtcatttctcacaaccgagtaataatcaacatcggatcactcaataattagtgataaccttattgaaccgtcagagatgaacggttatgttgtagcgaataaaatcaaacacaatgtaataaataagtaactcatctggcagacaaaattcaagatctactcctttttccactaggctggctgaagaaagtcagccgaaatttattagagttaacgtctaagatcatagtttttttttaaaagaaaaacacagaagaggacaaagagtgtctgtttttatttaagaagaaaagacttggcctagattttaagagaaaaccaagccaaaaaccctcacataagcatggtttgaagtaaaaacctaggctaaacccacacgaagaaaaagccaaaaaaaacctgcgacggcacaacgacgtgattatatatattggatcaggtagcacagcgacgtgattagattatttacatacgaggcaaaccaaacaagactacaagtgcatatgttcgaattttcgatagaatcatccgacgacgatcccgtgagccaaatgaaacaaaactgcagcctggaatttattttccctcttctgcaagtacgtacactatgaaacctgaaaacaacttaacacgggtgtccttcgtcgaatgattctttcgctgtttattttccctgatcattaattattgcatcgttactaattaaaaccaactttatttggcattttgtgcacgttattagctaggcacagagagacagagcagccaccccatacgcgaatatgcttaagcagaattatgaccaaaaccttcaagcaggtacaaacgtcaacgtgcattcacaaagcagcaatcttggtctctagctagttctgttcaatactagctaaagtatttccagcgtactttccttggagaatccagatcagcttcctaatcaccctcacatgcatggttgctcgtcataacatataaccaatcagcattatattgctttaatcatc

SEQ ID NO: 43905 - DNA, 1501 bp, Oryza sativa
cgacgcagcagtcggccacaaaggaggagaaggagggcgacgagccgaagcggcgccacaaatagccatcgccattgccatccaccgctgccgcccgcaccaccgccatcgccatcgctgccggcggcggttgctctgctgtttttatttaaaagatagagggagaagagtgccctgacaagctggccctacgttttttatatttttccctaatcaattgcatgtgggcctcatgactaggctgacagcgagcataatgggccaagtgccacgtcagcaaaaccaccctccaaaaccgttgagggattcaatttgtattggttttagtaattgggagagtcatcctgcccggttttgtagttaagggtcacgaattagattcggtgaacaattaagggagtcaaagtggactttttccaataggctatttgggccttttgagtccacgtgagcattgggctgacaactaatgggcctcaacgtggtgttggcctgtcaagccggccgtgaattatgatggataaactgaattagagaaagaacaactgaattatacatggggcatttgaacgttgtgcttctgcaatttatggtaaatccagtcgatatctaaacaagcccaaacaatttcgcactcgtatagtcttggaagctgatatctcaacaataattgattgcccaaccactaccgaatgtgcacttttaagataagaaggaaacaaaactcaggaatatcaattagctgaatgtttcaggtttcagctgcagaggcaggcagttgaggaggcctttagttaggcttaccctaccacactctaccaaatcttggattacccagttctagctacatgatacattatcctttgtggaggttgtttgacaggtgatgttgattcagagtagagaactgcaaatgcactttgcagatggaaattttagccaattttgcaacaaactagtgtgcccattatgagttctataaatttctgcattaggcagttagttaactgaaataggctacacattccagggggaaaaaaatcctagattagtagtagtagtaatatactagtatataaaaaagggcatacccaaagctgacaccaaaaagaaaatccagaggactcacatcggcaacgttgatgtcgcatccaacgaatgcgattggattggaggtttttgcaattaccatgacgagcattctaatcctatcccttaaatatgatatttgccgcaacgatcccaccataaagttcaggccaatatcctattcctccgatccccgagctgctccacggaatccagaattccagatcaccatccgctcatcataccatcgccattttgcccgtatactttacttcaagaggcagcaaccgcttagccacttcccgcgccgcgacgtccaggtcacacaggttctttggaacgggaaagggagcaaaaggccgaatcttttccgctgttgctgctcctcctttctcgctctcgctctgtccga

SEQ ID NO: 43906 - DNA, 994 bp, Oryza sativa
ttccggatcttttaaacggcttgactcaaaattcttgcgaattatgtacaggtggtggaaatatttatacgggaacttgactcggttttgagggttgttgccatatcagtgatatcactccaacaagtcgtaataacgggcaacggctgtcagctttaacgtttggttttcgtaaatagtagtggtagtagtactaacttcagaaaagtcaggctcgttttgggccgggtgagcaaacctgcggaacattttttttttctagtttaaacgatatattgtgaattgtagcctaatttcgtgagctttcagcaaagccaggaaaagatcttatgcattgcatgcattcgatcattgggctgccagccagcttgtatggataggatgaagacgtcatgaagaaatggacaccccggtgaccatcatctgcatccacgaggctgaccggatggggtcgatgccatcgaactaatttcaattgattactaagacaagaagttttttgttgtaaactggtgtaaccaattcatgaattttcggaatcctaccccacaatttagtcttagagatatagagaatcacgtcgccgtctacggcgggtccagtgaacttctttttttccctgtcattttcaggggagaaaggggatgcgagttgacattattgcaaatcctggtacctaaccaagatggagactaatggagaaaatatcaggattagcacagtgccgtaatgcttgtgaattttcactggtagaactgaaagattgttcacttcataaaaaaaaaactactagaactctgcctctgatgataaatattagaagaaacggaatagcatcgactggttctttgcaactatgggagctaaactatctagctactatccagctccacgtccgggcactgtaaaattgtcgcccagggaatgcttaaacgctagcgtcagctagctatcccaactaaaactgattggctaagctgtcaatcttcaaatg

SEQ ID NO: 43907 - DNA, 1501 bp, Oryza sativa; identical to SEQ ID NO: 20461

SEQ ID NO: 43908 - DNA, 1501 bp, Oryza sativa
gcggagcggaggaaaggcttcccaattgggggaagctgctgattgagccgcgccaatatctctcgcgcgcctatggagttgccgacttcggttgccttcgccgccgctgcaagctcgtccaggaggtgttgctgctgcgccgccgccgccgccgcggttgacttcatcgcgttgcgcggatgctgcatcgaaggctggagctggaagggtaccgcgctatgtagcgttggaaacgggaggcattgcgcgggcgccggcggcggtggctggggctggttgtggaggaggaagagattgtcgggcacggagtggtggcgcttcggcggtggctggagcagtggctgttgttgatggtcggagaaggaggggaacggcatgaacaaggtggaggccggcgtcggctgatgctggttgaggagtagtgtgggtgatggcaagccaaggagagggggcttcatgtcagcgccgttgtggaaaggcgcagtagtcgccggcggcggctggagcgccgcttcgggcgacaggaggccgaaagcggaggtggccttgctattgctgccgctgctgcttgtgagcgacctcccgccggaggacgacaggtcggaggcgagggcggctggcgaggagacgccaccggggtgatgctgcagcgggaacccgaacccggcggcattggcgagagctgctgctgcgagagccccggcgcctggggttccatgtcgccgggggcagccatgatccagttcaaaaatgtctgctcctggcctgccgccgccgcggcgtcgccgagcatggcgtcccagctctcctccgcgacgaagcccacatccagggcccccggtatgggcggcagctcaccgccaccgccgccgccgtgttcgccgggggccgcccatctggtggcttcggcggcggctgcgctgctctccgaaaccgccgccacgccggtagatatagaatccgccgcgccgctaccatgggacgaagacagcgtcgatgtggagttgggcgggctcgggctccccctgcagtccagcaccgacctcggctccaccagcaacgacccccccgcgcccccgccgccgccgcctttgtcctccggccaaagcagcgccgctatgctccccgcgagctccgccgccccgttcccgtcggcactgaagggtgccgccctcatctaccaacctactcgcgcatgctcccgccgcgcgccgccgcccgccgcccgcccccctctcgatcggcgcgagagagatatggagggaaggggatcaagaaaaacaataaaacagatgaggccgcttgcttgtgtgcgtgggtgtggactgtggaacagcgaagatggagagaagaaagccttgtgcgctctcggtctcgtcctcttgcccgtgcggccgtgctactaccagtatagttatgggttgccgtggtgggtgcctgccttggatttctctctctctctaacggtgccatggtccataggagtaggagtagatgcgtg

SEQ ID NO: 43909 - DNA, 1501 bp, Oryza sativa
atgggacgaagacagcgtcgatgtggagttgggcgggctcgggctccccctgcagtccagcaccgacctcggctccaccagcaacgacccccccgcgcccccgccgccgccgcctttgtcctccggccaaagcagcgccgctatgctccccgcgagctccgccgccccgttcccgtcggcactgaagggtgccgccctcatctaccaacctactcgcgcatgctcccgccgcgcgccgccgcccgccgcccgcccccctctcgatcggcgcgagagagatatggagggaaggggatcaagaaaaacaataaaacagatgaggccgcttgcttgtgtgcgtgggtgtggactgtggaacagcgaagatggagagaagaaagccttgtgcgctctcggtctcgtcctcttgcccgtgcggccgtgctactaccagtatagttatgggttgccgtggtgggtgcctgccttggatttctctctctctctaacggtgccatggtccataggagtaggagtagatgcgtgcaacataaaaaaggttggaaagtgtactcccctctccctatctctctttccccatctctgcctatagcttttgtttttcttctctttggtttctcatcgttattattactccctgataccttatctgggttttatttttttgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgccatgaatcgccgtcaatgcatactccgtaagtccgtatggtgtagagaggtatgtccactacacactaccgggctgtatttggacacggcccgcgtcttccagtcccaaccgccgagcctacgtaattgccggcccaactgacatgctgcgctcaacttccacattttcccggcccttctttgggccaactcgcaaaccgcccctgcgcggcatggaacgcagcgaatgctcacgcagtcacgccgtcatgcgtcggcgttggagtaacagcgacgccaagcgggcacgcaccgccggctagccgctaaaccaggttttgaaaataaattattgatgagtttattttaaaagttaaaaatgcttaaaaattattttaaaaatccacattctgctcctgcctttgctcgacgatggttttgagcaaacagttttttgttagatttctctctgtctcaaaaagaatcaaactctaaagataaatttagatttgtttttttttgaaatagagagaactaaagaacggtattactatatctttgaaatggtatagccatgatatctactccatataatatcattctctagatt

SEQ ID NO: 43910 - DNA, 522 bp, Oryza sativa
acagatcagaagttgcatctgcaaatcaagactcacaaatcgtgtcacccaaactaatttgtctgtgtagtactagtgtgtagagcaagagcattgaggatgagatattctatttccaagggaaatgggggaacctgtcttccattttggttcatctgttgaccttctgttattattcttgtaagtagaacgtgcaaccgaacaaggagaattatagaaaacctgtgatagaataagatttgatgattaaagagttcctgcttgttcacttgcagatactaactacgattaagtattcatgtgctgggatgtttaccccgttttaaagtggttatggtccaccacgtcttagaacgtgtgcctgtggcctctctgaaacgtcctaaatttatccattagtgctggaaagtaccactaaattttgttgctagatagtatatgttgtttggacccactttgttctacaaccaactgtagaattaaatgaaataggggacacattgactaaagaagtggatgttg

SEQ ID NO: 43911 - DNA, 1501 bp, Oryza sativa
cctcttctctctccttcctggtgcaacacatcgatctcaaattcttcacaggtttctctcatttcccttcccttttattatgaacttttcgatcttttctcccgcgcgctctcaatcggttcgagaatgagaggattcgttgtcggctcgccttgtgtttttgccccccttattttttttttcgtttccaattccatgatatttcacatccggggtgcaagtttgtagatttgaatacttttaggggaatgccatatatactagatcggaactgttcatggtgtagttacctttctggcatactccgcgacatggtgtattcatgccgcgcacgaatcgcatcgatgttttctgtttctgaacttgattgtctaacatgtcgttattactttagatcgtatttattccatgatagactcaatgcatgtgctgtctattttgtgatggatattccccccccccccctgaagaatcacttccttgtagttctctaccgtcagattgaatttttacagaaattatgcatgattggtttttaaaatcgaagtttacagcaatgcaaattgactttggtgccctcatgattcacttggcaaaagagaagttaggcgtacctaccatgtcattaagggttaatgatcgatactagttacttattgctaaatgttttctcgggtagcttatcactgtggatggttggcattgcattcgtaataactgaatccttctggtaaatggcatgccattttcagattatttgaagcaacaacaatttgattctgcaatgtgggcagatcggtgcatatttgtactttgctctttatttgaagggaatgtttatactttgctccaaggccttttcaaccaaaatattgagataaacttttctgcccacaggataaaaattcaatttagagcgttgagatcaaagtttttactatgccgaccattatgttgttttcattctttcctcaatgacaaggacgctgatgtagcataattactttctgcgggattaatctaggtgcaaaggggattcctgttggatagatgccattatatgagtttgctcatgtacgcatgatgtcatgtaactcatcttgtattttgagatttttcaagataaatgacgcctcttggctcttgcatgcaccaatgctatatgaccaggtatatgcgtagggcggattacatggccttttctatctggctgtcatttttctgatgcacataccttcttgaactggagagtacatgaaggtaaatcacatttttgtgattgtaaagtatatgtgcgtttagttgcgtcatattattatcttgtgttttttttttccagatctctgctaactttctgttgaacaactgtgcacgcacctacaccaagaagaaaacactcaagaagtggtttttcattgacaagaccctgggttaaatctagttgaagaaggcctattccacctcattttggtagtggatatgagcaacggtttgccactca

SEQ ID NO: 43912 - DNA, 1501 bp, Oryza sativa
gctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcat

SEQ ID NO: 43913 - DNA, 1501 bp, Oryza sativa
ttgctccttgtcctcgccgtgtcaggcgacctacacatacatgcatggcactttctgtgatctttactggtataacagaaatgatacctcatcgaaatgaaattgaacttagccacgcatattaatttcgatggtatagctatataggggaatgaattctaaaactctctgtcgttcttttcttgcatcttgtcccttttagtaatgaaaaatttagtaaaaaaagttatcaagatagattattatatacacaaatatactattcaaattcaacctttacgatttgtaaaaagcaaaaaaattaaactctagctaagatgcgtgtattcagtcatatttgtttttcttttgcaccttgttgaagtcaggttcaaattaatgatatatcacatattaatatatcttattaatattttaattttttttaactatttagacgtgagaaatgagaggacgtcccctcaaaagattaggatatatttttaagtacccataccaggagaagaagaagatcttgctcttctggcagttctcgtcggtgacgaagtcgaggtcgtagacggcgtagcggcactcgtcggcggggagggtggcggcgaagtcctcgtagccctcggcagtctgcccgagcctctccaccttgatctccatggccttgtcgtcgatcttgaacacgatgaacctgaaccccctcctcgtcttcagctcctggaacttgaacttgcactcgtcgttcaccgccagccctgacgcagaattcgcctgccattctcaaatcaaatcactctattaattttttttttgcgggggaaatcactctattaattgcaattcatcattgaccatgcaagaaactgaaattgcaattgtgcttaatttgtagcgagagagagagagagagagagaaagaaagaggagatcgatcaccattggtgctcctgcgagtgagttcttcttcttcttcctcctttgcgcggtaatgcgaatggagggagaggttggaggggagaggatggcaatggtaggcaagctagctaggaagcttttgctagggatcggaggaggagcggacaatgcgctgcgtttcgcgagaggaacgcggcgaggaggagagataatttaaggcgattgcagttgcagagattgatatgatgccatgcacgtcctcctctctgtgtgtgcgtgtgtgtgtggtgaagggaaaatatggaggcaatggttgacttggtcgcttgattcctctctttctctttgtttatgtttaggccttggccttggcctgccagccctaaagacatgttccccacaccttctcctgcatgcaatgcaagcatggccatggccatggctgcctctcacaaagataatcatggaggtgagatcgatcaaatagttggttgcaacttacatgatcagatgatgatgatgatatagtttgcattattacatatccaattgttttctaccttgaataaactttgaaggcgttttttttaaagaa

SEQ ID NO: 43914 - DNA, 697 bp, Oryza sativa
tgcttgcgatcatggtacgcgatgagtcccttttactattttgcaattgatggtctgtggttcaattttatgatagctcataatgtcctaccaaaaaaaaaactttaagtagattcattttcattttctggaaattgtgctcccactatttgcataaggactgcaggctgtagttatgaacagactccatatgccgtcataactgtccatttgatcttatgcattccaaatttacttattaaaatacgggaccaacattcctattttacggttgacttaaatttttctgtcatggaatctctgcataaggaaaattgatattgctgagcatggtggatggtccttctgttaaccttcttagcaaattattagtcagattctcacaaatatctttgacgagattgaagcttgccagcaagctgatgtgaagaagttgcagttgttagtcattagtaacagatcatagtattacttgtatttcagcttagactgttgttcagctccctttgttgctctttcgtacaactgtactgacctctgcttctcacttagtacaaaaatatgcaacacttctacacccacaaaagtagatatgcttagcaattgtgtatagcttcacatcttaccatcaaatgtgaccacatcaaattgcattctatgtttgatttttcccttaagtattgttgctatgtgtagg

SEQ ID NO: 43915 - DNA, 747 bp, Oryza sativa
agtcgtccgtcaagcgtgagtagaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcaagaaacacttagcatatacatgactattttagtcttagcatgtaatattgtttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 43916 - DNA, 1501 bp, Oryza sativa
atagccggaaaactccaactcgagctatgctttaatcaactgtagagaatggttcaatgaactgactttggcctgatatatatgatccctctagtcaaaccaaccatgataagtacgatctttggtgaacgtcatttaagtgtatccaaaccaaaaaaaaaaagtgtatccaggcttggtttaagcacagtaggtggcaaaattaccagtacttacaggaaataagttaaataaatttagttattttgtgtgattattatgtaaaaaaaagttattttgtgtgattttatagatttgtactccctccatactcataaaggaagtcatttaggacagcgacacggtctctaaaacacaactttgacttcttgtttctataaaaatatttattgaaaagtaatatatgtatacttttatgaaagtatttttcaagacaaatctattcatataatttttacattttcaaactcaacaacttgagagatatttatgatttatattcctaagatttgacttaaacattttcctaaacgactttctttatgagtacggagtgaatatgtaaaattaattcaggacgtgcagttctatcggttgcatttatgggtagcggataatattccacgctaacaacaaacaggtagaggtagggcacgcagtaggctgtagttataggattgaaaaatagggggtcggtagttggcgcgcgtgttttctcaagtaaggtagagataatttcggtagtagttaagattttcttttttttcacgagacttttttcaactaacaaattgaaaagaaatctatatttgaaattaaatttttaaaattttaaacctatatttgaaaactttcaatccaagatttgaaaactttcaatttgaggtttgaaaattttcaagtttagatttgaaaatttttaagttaagatttgaaaaattttaagttaagatttaaaaattttcaagtcatgattttaaaactttcaactcaaaacatttgaaaaaacacgtgtaataaaaaaaaagcagaaaataaagaaaaaaatatcgccaaaagaaaaaggaaaaaaaagggaaaattgcaaaaaactaccccaaatatcactataagtttgagatggcccctataagaagatttgttgcaaatccccacctctccacctcctaattcaccttggttcgatttaggcaccttctctctacacatgcgtgatttaggcatctcatggcgtaattagccaagtcccgctcatcgtgatgatttgtcaacaggtccctttttgcattagattgtgtggccttaattttctgattaaaccgtactaaacttgctattttgggtcatctgatcaattacaacatatgaaatcatcaggtctaatctaactatatgattactgcttaatgttcaaatgtttctatatgctcattacgtccctggaaaaaaaaaacggatatgttgttcagtccaaaagatatcgatttggaatatatagcta

SEQ ID NO: 43917 - DNA, 1501 bp, Oryza sativa; identical to SEQ ID NO: 43890

SEQ ID NO: 43918 - DNA, 1501 bp, Oryza sativa
gagagtggaacgatcttgattgcgccgtccggcttcagcgtcttgtttgttttgctcactttcttgggtggctcagctatggcgggtgggcttggcgtgtgctcgaccatgtcgaggctccgcttgtcgcattgtactgccagcttagcgttcccttgaatagtgattgttcccttcggtcccgacatcttgagcacttgatacgcgtagtgagacgcggccatgaacttcgcgagtgcagctctcccaatgatggcattgtatgctgtatcgaattcagcggcatcaaaggtgatctgttctgttcggaagttgtttgcttggccgaaagtcacaggcaacgtaattttgcccaatggtttggacgatgactgaggagtgattccatggaagggttgatcggtgggtgtcaactcgcttcgtgggatccccatcgcgtccaaggtgctggcgaagaggaggtttattaggctgtcgccgtcgatcagaactcgtgctaccttgatattccgaatagtgggttcgaccacgatcagatattgccctgggatgacagcagtcttggggtggtcctcttctgagaattctatcttctgctcggaccacttcatgttgggcgcagccccctgccatgtcaaatagacttcacgttccactttcttgtattctcgctttgaggagtatgccgtggaacctccgaagatgtgtgagacatgaatgtcggaatctagttatgctgagtccgattcctgagtaggcgccttagcgtccttctcaaccacatgtactcgcttgcctttttccgatgccatgtgttttgcgagtgactttttgaagacgaggcaatcttctagagagtgtctgtccgtcttgtgtatatggcaccatgctttcttcatgtcgctgccttgtgggtctaggcacttgggagggtccgcgtattctgttgcgaaaacttccgattgagctttcctcttcccactcttgcgatttttcttcttgctcgactcaggtgcgtccttggctggtttcttctctcctccggtcttcggtttgtcgttcttgcgtctcagtgcgtcatccgcatgagcgcatcgatcgacaatttcgaataatctccgagtagtcgtgatgcgcctcattgccaactcctgagtagtatagcgatctctgacatcggatttgaaagcgcgaattatagaagcattggtgatctcggggattatgtttctgcactcgttaaagcgccgaacataatccctcaagtattcgcccgggttctgtgtcaacgcatgtaggtcgtcttcgatcgcgtggcgcttgtaagttccttggaagttggctatgaattgctgccacaggtctgcccacgaagagatcgagtaggggggagatgcatcagccatgaatgtgcagagcctttcaatgcggttggcaagtaattcgccaatgcgttgtcgtccgctccggcagcgtagagtaccatggagtaaacctgaag

SEQ ID NO: 43919 - DNA, 1501 bp, Oryza sativa
tgcaactcccatcacatccatcagtaatcaatttgattgattatgaagtgcaaaagtgttgaatactcttcaaatgaataaattcaataagatgaaatggatcacaaacaaaactccacacaaacttatcagcggttatcatcactagggttttccctttcaaaaagtaaggtaattttggtgggcaatgaaattccgaaatttcggatatttcaaacgaaattttagcacatatttactaaatttgaagaaattatgatcaaattcacaaatatttgaaaaaaaaaactgaaaatttcacttaaaataattgcttgccggatgggggacgaaattcccgaaatttcggttcaaatttccaaaattgtgaaccgaaatttccatccctaattcatcactaaacaacaccttgtaaaacttctctcttccctcttccctattcttagcactatccaaccgcgctgcttcctcatcgtcgtcctcctcctttatctcaatctcacctctcctcctttctccttttctcctccaaattctctgcatgccgccgctgattatactcatgcagccccatctgcatcagctccccgagcctatccttcgccactacctcgggatccttctccctcagctctaacccatcataaccctcccgagcaccactgtgtgtatcttgtatgcataaatgatatggtctttgacaaatccccaatgaaatcttatatgcagatactattcaggtaacatactggcttcagttctgagcacaaatataaaggtgtaatgaggacagtacatactgtgtgccggaacctagagacaacgatcatgtagatatttgccaacttcgaatgaagatttacaaacagacttgaataaatgtcttgtgttggtatcattagttattgtctagtcatttcttggtttttataagctgtgaattatgtaataagtggctatagcatctttaaagcaaatgccggaattcttttcactatctaaaagaagccccatacagtcatacagatgaaatcagaataacccttgcatatgcagcaaacaggaccaaattgttttgaattcagcttgtgcaacgtgctagaaattcacatggatcatggacggtgattttgaaattctagcgtgaattcaggagtgaatgtttttctctatttttttggctgatacattcgtttgatcaataacctaattagctttgcgatgtgagtgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatct

SEQ ID NO: 43920 - DNA, 1501 bp, Oryza sativa; identical to SEQ ID NO: 20459

SEQ ID NO: 43921 - DNA, 1501 bp, Oryza sativa; identical to SEQ ID NO: 43889

SEQ ID NO: 43922 - DNA, 1501 bp, Oryza sativa
gaacttgggcctcaataaagtttgccgttgcatctgatcgggctcgaccgctagaaacacttgggctgaggcatatgaatgtgaggtgaccagcacctttatagctgggcttgccttccttgtgcacattattttttcttctttcatttgtttcattccataagactgcaacgggctcgttttcaagctaaacctacccagagataccgatgttagcttcgttgtgacgtcttaaccaaaaagcttcattgtggcatatctatccacacgtactgaggagaccggcctacgacttggaagcaaagaaacaacaacaacatcatatattgcgttgttgcatcattcaaaaatgctagtccagtcttttctctatcaaagacgtagcgacactgtagcgacactgtagcgacgctgcctatcgaactcccgctgttcgatacgtccatgccacgcgccctatcgaactccccctgttcgatacgtccttatcgggcattgtagcaagtacttttttattttttttcttggacaactagcctgtcgaactagggcagttcgacagtaccctgtcccagttcgacagggcgctaaacttgtgatttcgtctagccgacctaaagttttgtgattttccattaaaataatattattttcaaaaaaaattcaccgatcgtataccttactctttaaaaattaatggcgcgcggcgtacatgtactggttctcagtgaacctgtacgtacagtaagctagtggggatggctttgtctgcgtacgaggacgacacgccatttctctcccagtgctagcatgtacctccgtcccataatataaatcgtcttattcaaaaaaatttatgtaaatataaaaattaaaaaattgtgcttaaagtactttggataataaagtaagtaaaagaataattttataatattttgaataacacgagtgatcaaatagtgtaagtaaaaacttaaaatcacttatattataagacggatagagtatttgtgttagtacacgtctacatatatcggctggagcggctaatttcattatattcacaccaccgctggcacgcacttgtagctgaaatgtccgagatcgatcgcgtgtacgtacttctaaattaaatcactactcaccaaacaaatcggtaacggactaattaattcacttgaaaaattaatagatactactccagtatatttctgttagttggggatggagagattaggtgtgtgatgatcgtcggtgcaatatgtgatctgatgccacacgtttatcctttctcaggggtctacgctgaatgatcgatgtgccgaaacgtgcttttctctctcaatagtgtactgataaggacgttctgttcgatctgttgatgaccgactagacatgttggtgttgtgatgatgctctaactcgaccatcgtgacgatatatagtcttttcaaaaacaaaaagaagaaaagataatattttgtagtttcttttaatctaa

SEQ ID NO: 43923 - DNA, 1501 bp, Oryza sativa
gattcgctatactatgaagtatctcgtcttatactagattgctatattataggacggagggagcactacacatgctggagaagaaataaataaacataattcgaaattaatcagacgcatatacagtagtaagaccatattgaccgggaacctaaacaatagggcgctaatcgtgattcacctgatctgcaatggccgaaatgcgcatcatcgatcaacaacgccctctgcaaaggtcaccaaaatgataggaatctacactccacggacgacgatcgtcgcccgtgcattgcaacattgcgaactcagctggagtacgagggtccgttggcacggctctaactttcaactccaacttatctagagtcggagctgtaccaaacgatccatattttctgtttttggagtgaagttagtagagctactcctaaaaaataaactacaggtgtagagctgggttttttctgctccacagctccactccaacccaaaagatccactaccctttaatttttaacacattcacataaaaatgtcactgaattatcccaagctcaacctcctcccttccccccccccccccccaaaacttaactcccacatgtgggcaaaggcagcgggccgatggtgacgctcctgcggtgacggcgggcgatgcgagcagcgacggcgcacgggtggggtgcgcgggcagcggtgctccggcggggcggtcggcgcaagcgaggacgacgtgtgagcggcgcacagcctgtgacgggcggcacgctgacaagggcggatgggtggtgcaggggaagtagcgcgaggccggcgtgcgtggagacgatgcttgggcggcgcacggccggcagcagggattcctttttttcaatattttttagatcgggagctaaaagcttgtcaaacacttttggatgggtctccaactctaataggagctagctccaactgaaatagcaatttagagctaggagttgaagtttatagccctaccaaacacggcccaagacttcttgagagagagtcggcagtgaggacaccatcgatttgtcccggagcgctctcgcgcggatgacaaatcgacaaggcaacgaagggttgcagttgtagtagcagtaaacagcagcagccaccggccaccagtaatcgtcgtcccatacgccgagctgtaaatactttccccaagcccacctgccgctccccatgttaccctcctctccctcccgcagtcgcaggccagccaaaagcaaagccattgcctgccgaccaccgccgtctgggccccgaaacactgcatgttcgtcgtcgtaccgtcgtacgcagccccccaccacgtggatgccggaaagccggtgacggcggcgtagcagcagcacacacaccgccggtcgcgccgcggatctaggctcgcgctcgcgtggcatgcattgcaaacggaaagatcgagagcagggtttcatttaccgccggggccgcggttaccgcgccccggcggtaa

SEQ ID NO: 43924 - DNA, 228 bp, Oryza sativa
aagtaaaaattagacatattatatgccatgaacgaaagaatagggatctaaaatagacttttttatctatacatatgtcagccgaagaggagggacagaaaatagacttattttaggtatacatatgtcagcccaaagaggagggacggaaaatagacttattttagctatacatatgaaatagtccaaagaggagggacgaaaaatagacttattttaaaaaaggcc

SEQ ID NO: 43925 - DNA, 1501 bp, Oryza sativa
taacaaaaatgaaaagtttgttagacttataaattgttgattatgcagcacagttccaaaaactatttctggtcatacatatttgacacttaggacaagattcggttaaacttttaaaactcggatgattaattttagattagaataaatttatgatatatatatttttgagtcaaatctaagtataccccttttttggcttttaaactaagcatttgaccaataatttatggtcaaaattttaaaagtttgaccaattcttatcttacctaaaataattatgactgcgagagtaatgtatttgatttaatgaaatggtttacgattacgtgaacacaatatcaatccatgaatgctagatacgatttcattccttgaaaattgttgcaaacaatgcacaatatctcgtgctatgcttccacatttttttctgtctcctttgtttttgctatttcattggaactcaacttgtaagattattcgagtgaagtgcatgatactaccaattgaagaatatcttccactcaccatcctttcccaaagggcggaaacgggacctcccaattgctccctctcaacatagcgcgtgtaaacctgcaacaagcaaacataaaataaaacaatcagcagttgctctaattaccacaagctgatgaaacaacagacgatgatgtcttctttttggaaagaacagatgattatgttaagcctaaacaaaaagctggaggaagcctgcctaaaattgactcgctggggcggctggatctcgatggagccgttcacgacgaacgcgccagagggcgggaaggtgatcacgttgttgagggcgccaccggggacgtcgattacctggaacacatcaccggcggcggtgcggaagaagggggcgttgcgcacgatgaagagctgctcatgctcggtggtccagaggagccgccacgtaccggaaagcttgtcggcatcggaaacggtatcggatccgggagcagcggcggcgagggcgtcgatgcaggagacgatgtcggcgaggcgggaggggtcggactgggtgtcgaggccgcggcgttggtcggcgatgaggcggaggagctcgtccttctctggcggagggcgggagcgccgtgaggggaagagggcgcggaggaagccgccggcggcagggggcgcgggggcgaggcggcggttgcccctcggaatcggcgcgagaattttcgcgtgggagactagtggcgccatgggcgaggatttggtttgggtggtggcggtgacggggggaaggggaggcgagctcgcgttgccttcgtgaggagtttgggccggtataatgggctgggctcatcaaggcccatcaagtccaaggtccatttcacaaccgcatcgaaccctaacccccgcggctcctccagcaaaaccccccattgcagacgccgacccccgcctcgaactctccagtgctgcctccacagttttcgcctcgccgccgccgccgtcgtcgtcgcca

SEQ ID NO: 43926 - DNA, 1501 bp, Oryza sativa
tgagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcactacagggagaggggatccaagtttttgaccagctttgacgaatcctcactctcctctctcgcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaggcacttggcgcagcacttgttgcagaacgtcaggcacgccttcttgtactgcgtgttggagcacctccccgcgcacttgggcgagcactcccacggcctcaggttcccgccgccggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagct

SEQ ID NO: 43927 - DNA, 1501 bp, Oryza sativa; identical to SEQ ID NO: 43913

SEQ ID NO: 43928 - DNA, 1501 bp, Oryza sativa
aaccatgtaaattcccccgtataacctaaaccctattagtaagaacatgtaatggggctataaatagtcccctagggccatgtaatggggggatcccaagtaaaattaaaaatttaatacacttcgtttctttcccaaccactgttgagtaaccacgtctttcgacgtatgcggttgtcgtttcgacaacagctggcgccgaccgtggggacctccgagcgaaaccactaagagcgaatgccaccgaagaaggtcgcgaaggagaaggttacaaggcgaaaggaaagcgacaccggagtgggcatggccgccgaagaaggagcggagccttcggcgtcggtcgccgaggttggaggggcaccgtctgcttcggcgacggcaccgtccgcttcgacgccgacaccatcactgctgccttcggcccctgccacctctgagcaggcgccgagtgtgaatgacgtggcgaaggcgaccgcagtggcgagggcacttcagaccagggcggagatcctttcgacaagtcagctgctggtcccccaagctgctccgtcgcagccagcagcggcccaagctgcgctccctgccatacaagtccaagtcaactccgaccctgaaacacaagccgaagccgatatggagggcatgcggcaaaacatggcacgactccaagacatgcttcgccaaatgcaagaacagcaacaaacgtacgaagcggcaaggcgatccaaggttgcttcggcaccgatcctccagtattcggcaggttttgtcccacctcaagtctatccgcaagtgcagcccaagcccgctccgccgcaagtcttgcaggcaccaatgtactttgtcggacagccgacagtggcaacagtgccccaagccgcgacccaagtatagcctcagccacttggccagctgtcgcaagccgtagcagaaggggcttcggctctgcaggcacaattccaagctttcctccagcaaatcaatcagccccacaacatttcgaatacaactccctcaactcgtccagaggggaattcaagtcaaggtgcgctcagttggttgccgccgaaccagccgaatctgaggacttcgccatggaatcaggtacctcagtgcgactttaccaataccgctcaggcgcaaaccgttcggccgcaagcaccaacaccaggcttcggaacaagccaagcaccaactcatgtcgccatggcgtggtcgcagccagttttcgatccatccatggcggctcagcaagcatcaccagtcggagccgggcagccgaacgccatggctcaaaatcatgcgcaagccgtaatttcacctttcgccacgccgtacccacagcaaggcaccgcaggcagagcgggaggcgaaaagggtctgccgctgagtgggggaatcaagaaccgcccaattccgccccagttcaaattccctcccgtcccacgctactcgggcgaaactgacccgaaggagttcctatccatctacgagtccgcga

SEQ ID NO: 43929 - DNA, 1501 bp, Oryza sativa
tttaatacatacctctcatcatttttacttttgtatccaaatgagactagtcaaagaaaggctcataaaaatgaaacgattagtctcatatagttagatttgtcattaatcaattaaggcacttgaacttacaatactacaaaaggccatgctcttcggtctccataaatctttggctgtgtttagttcagcgcaaagtttgaattttggttgaaattggagatgatgtgactgaaaagttatgtgtgtatgacagattgatgtgatggaaaaggactgaagtttagatccaaactttggatctaaacacagcctttaaacccttgtctttctctctgagttgattgttgaatcaggcatcctattgcttgctgttatggtctacgcgtaccagtgcagattaaacttttgtgtacttgtatcagttcagtattagggttaagactttgtttaccaaagaaaagaaaagcatgcagtttcgcacatcttccttaattgccaaaagagtaaatttcacgaaactacatataatttgatcaaactatcacaaaactacacatttaagaacgtgtttcacaaaattacaggtttagtgttaaatttatcacggaactacagatttaagatattatatcacaaaactatagatttaacaactattttatcacaaaactacacatttaaaaactatttatcataaaactacagattttataacttttaataaataataatactatgatccaagtctagaatatgtagttctgtgataacttcatcactaaatctatagttttctgatatggtgcattaaatctgtagttccatgaaaagtttgacgttaaatctgtagttttgtgataaacattcttaaatctgtagttttgtgataattagacccccaaagtatctgtaattttgtaaaatttattattgtcaaaatcacttgagaccatcaagttcatactatcggtctcatctttttgcttatacttatacttattagctaaaatttaaagttaattttaaagttttttcattgaagtttatttttcagcttttgcttttaaatcgccaagaacacatatataaaagttttattcataaattatcttttgtttgcaaatatgccgtttcgcttatgcttaaaataagccaaatggcttcctatgaattcacatcagccaaggttggtagttccgttcaccttctcaacattataccaagctttgcagtttgcaccaggaagctccatttcttgcagaaatcagcatggaatctgagcctttagcatcaagttcatcaaggtaagccagtaaggtatcatggtgtatggcctacttggtgctatttgtatgagttgcttcagctgaacccatatcaaagctaggctcctaaaatttgtcatccacatacaaatttcacagagaaaaaaccatgatgtcatccaattccctcttccagcgtctggcaaaatggtgcccgtggttactgagagatg

SEQ ID NO: 43930 - DNA, 1501 bp, Oryza sativa
agcgcggcgcggcgaactcaccgatgaccaaagcaacggcggaggagcaacggacggcgccggcgacgaggaaaaggcggcggcggtcttcgggtcgacgatgacggcggtgctccggcggtcttcggtggcggcgaaggagcggacgaggacggcgacgaccttgcgaacccgatggcggcgacggcgaccgacgacggcggctgcaacggcggcgcagcgcggctgaaccgacggcaacgacggcggcgactaaggctacgcggaggcggcgctagacacgacggcgggctaaggcaaaggtggcggcgggtagaggagacaccgggggtccttataaaggggctagcgagcggcgacggaggcccacggcgaccggcggcgagaaggaaaggtcggggattcggaggaaagagaggaatccgattcgacctcgaatccacaagtttccaaaccgaattaggcgatgattccaaaagagaaaaggaagaggagatctcaaggatcatttgccctcaaacaattcggccggagaaggaaagacgcggccgaatttggaaagcggcggcggagcggctcggctagggtttcgggcggcggcggcggcgcgaggaggaagacgggcctgacagacaggccccacctgtcagcggctgagagagagaggagagcggcggctcggcggactgggccggcttgggccgagaagagagagaaaaggttttgggccgactttcggcccaaagccaaaagagacttttaaaaacccttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaaacttttaaaatcatttctaattattccttttaaacaacaatttataatttaaggattttaaacaagaaaagctcttaacaattataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctaataataatttattaaatagtttataaatcctgaaacgaaaatcaggatgtgacactgctcgaaggcgaactcacaaggaaaatcgccaataaggaaccacaaacactcgtgcacttgcttcgcatcattgacggtttcgcaaggggcgaagaggattccaagcgacggcaagccatacaagctgagtacgataaagcttctattgccgctgctcaagctcaagcacaagttcaagttgccgaaccacctcccctcgcggt

SEQ ID NO: 43931 - DNA, 1501 bp, Oryza sativa
catgaaatatgttactaccttatcttttatagggaaacattcacttgatttcatatgtgattgtccacgatatttctctatttttaacattaaatctttgaatgagtaatttgcaaaatttacgataggataaatgggttggcgggttcactgtcaccaccgctatctttttgcaataaatttcttcgctattataactggaaaaggattattacaatattaatgtagagagataaaaaaaatattttagcccccaacaatcgtagggaggagacatgtgcacagtaaatggtaataacagttaaatggagaaggtttgtaagtttgacagggaaatttagagaaatacaatagttgctagaaatccaacttctatattcataggaaatatatacatttaagtatgcgtgtattgtcatatttaaacaattttatggttcgtttcagattattgaaatggattatttactctaagctttggaaaatacactcaaaggacgcatatttgttaagtttgtttcttaaagtattcaatttattcatataattaagtatataatcagtagcagtaatctgcctaataatccaaatcaaacatagctcaagtccaaactctacagctttgagttttctctaggctggagcaataccaaacatgtcaatagatagataaagatatgttcgattgatgattaacattgccaaacctcatattacataaggtgaagctttaggcaaagtgttgcaaaaaattgtgtctttgaaataggccgatgaaaaatatagctacccataacaatggcatcaactaaacaactgcaaaacaaccacctaaagttgggatttggcaagttgaaggcatcatccaaccataacatagttctccctccgaaaagaaataatactaacatcatactaactccatcccaaaatataataacttttagtacgaatctagacatgcacttgtccaaattcatagctaaaagttattactcccttcatcccaatatatagaaatatagtatcagatttgatattttaaaatactacgaatctaatcatgtttcatatttatattcgtagtactataaaatgtataatgcacttttagtaacttttagctacgaatctatacatgcactttgtctaaattgatagctaaaatttattactccattcattccaatatatagaaactagcatcagacgaatatgatcagaggtttcctgttcatattcatattactataaaatatctaatctggtatatggctttcacatttaggacaaagagagagtactaatctattttaggaaagaaacaatattacagataacccttaggactgaaacgcacaattctcccgtattaaacccgtcaaatatctagactttaattaacataattaattccaatctatccatcccgtcgtcaataattttgtccccctggctcccccccccaccttcctcttcctcccctcaatccccccttttc

SEQ ID NO: 43932 - DNA, 1501 bp, Oryza sativa
tacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagctccacatcatgtcaccatttgcctcagtaccaccacggtacctcggaaaggagctgtgacattaccccttgcataacacaatccaccacagcgcaccttcctggatcataatcacccccttataaacaaggcatggactccccagcgacccccgtgggcttatctccgccacttctcagtctggtgctccgcaatgaaccatgctatacaaaaggtaaagccgttgcccacactggcttgtggttggcacggttaatgttccacaacagtagctcgcgaaccagtccttaattgtcatgagcacgactctcaaaaccatgtgctcacaacccaccattatcaagttttagttggcaagtaattaattaaccaatcacgattgaccatcgtgagataccattaaatataaccataagtgatagtgaaacattagttatcccaattatgtgctaatgtttctaagcatggctaagcaatcatatctaatatctagctgaaccaatatataaagcccagctagtcaagttataataacccaaggtatcaaggaataaagtaatcaatgcaaacaggccataacaaaggaataggttcacaccacccagtgacattcgaaaataaatgcacagttgaaatatatagagaatttaaatataggatcaacatgctcaaaggattgtgtttaggatctgtgtgacttgccttgcaataatcggtcttcaattaatcttcttgaatacttccggcgcacttgcgaaccttcgcaacgacggaaacgacaagctaacacgcaaaacgaagaaaaagactaataaaaaccaaataaacagtacataaaaagtaaacaaacatgtagattacaattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattatttttgaaaaggaaaagaggattattgcgtcagcggactagggtttcggtggaccgggcgcacgggcgacggttcacgcgaacggacggccgagatcgacttgatccaaaacggacggccgagatcgatcggtccacgaccggctcacgggagaagggacga

SEQ ID NO: 43933 - DNA, 1501 bp, Oryza sativa
ttttttatagcattaactgcactaaaagtcagtgggtcacaattacattcaaagaaaggattatgtctagctataaactcaatcatccatgttatattgctctcattgctatcatttttagtataattatgggcacaaatttgataaaatattgcataatattccctccatcccatcataatatgagggattaaattatttaaatttgtcccaaaatataagggagtctagagcactacctgtgcaccaattgaccctcattcaattttcttcccactaaacaaccttccaaccctaatattgcctaatctagtagggaaaacatatattacaaacttcatatgtagtgtaaatctggaaactgtcgtacgatgtacaagtgaacgtttgagatttgtctatatcatcataagcaattttttttactaccagaacaaaaaattacttatgattaaatctaggagaaaaatactcaaggtgatatggatgaatctcggatgtccattcgtgtatcctacagtagtttctaggtatgcattacacacttcctcaatctattgaggggtatttgatctttttttcattttccttaatctctcaaatgcatactaaaatcacttctagtatatgatggagttagtaacatatttatactctctccatttcaaaatgtttgacaccgttgactttttagcacgtgtttgaccattcgtcttattcaaaaaatttaagtaattatttattcttttcatatcatttgattcattgttaaatatactttcatatacacatatagttttacatatttcacaaatttttttgaataagacgaacggtcaaacacgtgctaaaaagtcaacggtgtcaaacattttgaaacggagggagtattatcttattaaaccctgaaacggtacatctgtatcggttggtatgagaacttcctttctaagagccaaattggaatggcctctcgaatgaaattgacaatcttgatgcatatagggtagaaaaaaagctcgcttgcccggcttgatggctcagtccaaaattgttgcgattcatctagtttttcttttgagatacaaatttcaatctgaaaccagaagacgaagcatactaaaaaccgattggtatcttcgaaaaatagataagaaaaccaaatttgttttcgtcgaaaaatatagaaaaaaaatgttagataattggaaaaaaattgtgaaaatgccatttcctataaatttagtaatctcccattgacatacacacaatatgtaatacatattcataaaagacaatacatatcactcaccagtcaccaaccattggccaaatagaatgcctgtcacctaaatattaaagtccattacgtacatagtttagagtccaatacatatattgaagtccatttcattactacatggaatttggcccatgaaagggcttccctttttctaaataattattcttttctttcctactggacaattcaagaaatgca

SEQ ID NO: 43934 - DNA, 1501 bp, Oryza sativa
cctcgatttgcatttgcatttgtatttcccgcctgaattttttttctgtgcccatgcgttgatgcgtacttcttaacttctatagtgcatatcttttttttaatgaattgacgagcgccaatttcattgaattgagaaggagtagctttacaaagcgaaaggaaagaaaagaagcttaggacctttggtctgagctaactaaaagaaaactaattacgaagatttttcgtttctgctaaggcccaagttttggcctcttccttgatcttggctagaagagaggtagctgaaagctccttttgttggaaggttatgcgattcctttcgttccatatcttctagccgaccaacagcatcaaagtgcggagtgccttattgggtgcctcttgtattttggcaagataacttttgcaggtgtcgttcatcaattataatcttttaggaggttttctttctctgttctctcctcgttgtattctccgtgtattctgttctcctatcctccagggcccctgcgcttgcgtaggtaaagcttgccctgtgtaagatcatttggctcaatatattcaggtggggattctctccccccccggtgatttagtcaaaaaaaaatctatcaccgtcaaagtttgccaccactgactaggatttagtcgtccgcacgccgcccgctccgctaatgccgctagattcattccgcgaggaggtgcagggttgttttctgggtccgacaacataaggggcagatggaaccatttggccaacctctggtcgccaacttggcgaaggtccagactctgttttggatgacactatcatatattcactatggttagtaagctttcatgttatattgtcctcctcgtgctctaccatgtgtagtgcgttccaaaccccgataagttggtcaatcaggtttgtcgtccagcccgcatttccttgcaggtccaagtcgagaagctattggtccgcttgcgaagcctgctgaagcgttctattcttttttttggaggctgcgtagacaagcggttggaggtatgtctttctcagccggcttgtaatcagggggagacccagatatttcataggcaagtttgctatgattgctggcgtgtcctataggatgtcatcgaggtccatgttattgcacctgattgggccacataggatttttggaggttcgtgcataagctagttgcatgtctaagagcaagttcaatagtatagccagctagctactagctccaattcatctatagtcaatctaatagctcatctatacaatagttacatattacactattaatacctagtcccatctgtcatacacacactgtgtcttggagtctgtgctacagctggctacaaatctgtagcccactgccattctctctcctcatttatcttcttaaaatatgtttgcagctggcttatagcctgttattgtacctgctctaaagtgaccaaggaaatcagtgaaggcttgcacattgtacaccgt

SEQ ID NO: 43935 - DNA, 1501 bp, Oryza sativa
gagatcgatcagggctttatctatagttagggcgtatccgaccggagtgcaaagtagcatgaattatttataaataataatacctatattatgaagaataaaaatttatatttatggcaccaaatactctgataatataatatatttgaacgtaaattctataacgtgaggcctctcgatctagtcttacgcagcgacgcctggcgcggccatccgatttagtcgagaagcatcagagtttagaatttgagagaagcatcgtagtgttaggcatctatgtctttttctcccttcttataaaattttctttcaaattacttatctgatctacaatccgattacaccattgtatttgttgcaattaaatctttataataagatctcacatgattatattatgatgaaaaattacaaattacttttataatatatctaaattatttttagatttcactaaagtacttcttggacatataaaagtaaatttaataaagtctaaaagtaatttacatatattataatagaagtaacttaagacaaaaggaaagtaactttgtcataacattagaagtaaatctgttgtaaggataaaaacataactctatctagagactaaattaatcagcacaaattatggaattgactaaaaacaataataaaagtaaccacctcatagcattatgaatgtataggaagtaatttaatcaaatctaaatctaaaagtaatttatatatatgataaaagtaacttagtatataataaaagtattttacaaacataaatattttttcatcataatataatcatataagatcttgttgtataaatttaactgcaacgaacacaactgagtaatcggatcttagatcatataagtatttaaatgaggatgcatgtggcaggtgctactacttttagtaagaggggtaatgagttgatacacactgtactatttttggtaaaaaaggatggtcgctggttagcactaacgagtgcatgcgctccctgtagtcgtgtccatatttgtaatttattaatgaaaatacaaattgataaaatttaaatttgaatagtgcaagtatcaattattcgagatcaaagggagtatatattactatttggaattattatttcaacaaaattaatgataaacaataaagtatctttttaagattcggaggaattgagaggatatgcatgcataggtgcaaagtcaagggtaataaaatgttccaaactatacactataagcatgattgcaatccaaatgagacataataccgcgtaaatcattctgataaaaaaaaaacaattttgcaaaccgtcaaaaagaaaagaggcttcaagacttcaatatgttacttattactccctccattccgcattgatcatcacataagttttttcaccacgaccaagaaagatttgacttctctacattttatttcatgtgaatatgtagtggaaaaaatcaagaaatatacatagtttaactccccg

SEQ ID NO: 43936 - DNA, 1501 bp, Oryza sativa
agtgctatgtagacgtgactaccacatccaaactcattcatatcattcactcataaattaagaggcaaaccatataatatgtcacctctaatatacaatgtcatctctaatatctctagtactcttacacctttcttgaaactataaaggaagcccacgcagatgcgcgggcaatttattttgctatttgtaatgagaatactaaaaaagaagttatatcacactatattcattataaaaaatcatagattaccttataaccataaaaactaaataagtataccgtgaaatagaccaaagactttgatatactaaatgataatgtctatcatattaaaaaaactttatcccgattatacgtaaactcgcatattaccatccttcccaaacattcgagtaaatatgggttttggctttttttctccttttattatacatcgatccacttatgcatgttcaggaggcaatatacaatggaatgatctatattgtcaaaattatttttactaattgttaacactatttagaagagactgacataataaaaaaaggtttataatgtggtttcattgacatttaggagtgtacatacgcatgaatatttttttccggcgattagtagtctcgtacttatgtactttttttcttgggttttcaacaaacaaatattttttctctcctaggggtagagtatatgtatgtgcattcattgggtgggtgtgcacgtgtttatatgagcatctacaattgtcttttacttcatagttaataaaaaaatactttcaagtaaatagatgggatggcgtgcagtggcacggtgtgccttcttcgataacctcaccaggagtggtcactacatatatatatatatatatacatatatatatatatatacatatatatatatatatatatatatatatatatataacgtgaggaaaatcgtagagctacatagaaagaaagaaagaaagaaagaaagaaagagaactaccgaacaagaggattgtatacgtacgtactcttctttttttcttttcgtgtacatgtgtacatagggagggattaactggtttttaagagcgagcaattactttaatagatctaatctaatggttgaaaataatgaatccaccggtttaagtgtaaaacggtgggtagatgctttattttttcttattatttttcttacatttacttaatttattagagcatcatgtaacatcctagaagtggttgtaggagagtaggaatattattactcatagtcacaatctaattgtagtcaactattgtttgactgtcacttggtggcatcatctacttatctgtcatctttttatgatttcccagttagtatcgtccttcatcctcaatgctagatggtacacgtgctcattggatatgagataattattaggtgcattgtgtagggtatgactctgtcagggctacggataagatataccctttacccttagatgtacgcgatatggcaata

SEQ ID NO: 43937 - DNA, 1501 bp, Oryza sativa
ggggacagtttgctgtgtgctacagtgaaaacatggagattatcgcaggatcctcagacttctctattgttttttttttggattgatatagatgcattgtcttgtttatgaggcccggtgttcggaccgcgtcatacattcgtggaacagtgtgctcatgccttcggtgtgagacgaaaggttgtgtcttttttttttttttggttctctggcaggcgatgactgaatttcgtcactagcttgtagtgttgtaggcttttgtagcttggtctgtgattgtatagtagaaggatgacgcttctgcattgattttagttcaaaggagatacttttgtttttgccatttcggggggggggggggggggcgtggtgggggtgcagttatgcactacgtatgcattctgttctcttgcaattgattgaagggcacccagttctgctaggtgttgcaccgttttagtttagctgctgcttctttctacagcgtggttgtgctagttatagcggtctccattatatcaatttagtttgaaaaaacactagtggtgttactactcctttgagttaaaatgtgccaactattagtagcttgtatttgggtatacacctctccaagatgaggttgaattcctcatattcatatagtcgtgggtagcaatagataaccttttttctttatatgtggcctgctgataagatcatgtcatgcattgtggaacaatattttgtcgctatctgtttcagatgaaaggcgggatctgttttttagaattttttttttggagggggcaatgattgaatatcgtcactagtttgtagtttatgcttttgcagttaagtttgagattgtctagcagaagtacaacgtttttgcacttcattatagttgaaaggaggcatctccctgttttctgccatttctggtggtatggtacctattttatcaaatctttgttggaaagacattggatatagcctttgggttgaaattttgctaattttactattgttagcttgtctttgggccatcaggtatgcatatacatctctgaaagctagaggttgcccactgccttgtattcctactttagtacccttcacaaaatggtgaaaaaagactattgttcttagtttacgtatcattgtgaccagcatttcaaattgtgtcagaagagcatagttttgaacatatgcctgtcatccataccggagatcaatgtctcttgatttttgtaagctggtgcatgattggtattagtatagatatacagttctgagaaactacattttgttgtagattgaatcgtggtttaggagtacttgtctcctcaggattaattggatcattctttgggatcattttaatgatattagatgtgcctttacctgcatttggtgtgttgctggttaattatgccgatctatatgggagttcctgcagttagtgttcttgaacaaatctgcttcattcatctgtcttaactctataatcaatatttct

SEQ ID NO: 43938 - DNA, 1501 bp, Oryza sativa; identical to SEQ ID NO: 43883

SEQ ID NO: 43939 - DNA, 1501 bp, Oryza sativa
cggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcatgcactcgttagtgctaaccagcgaccatccttttttaccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaagatttaattgcaacaaatacaatggtgtaatcggattgtagatcagataagtaatttgaaagaaaattttataagaagggagaaaaagacatagatgcctaacactacgatgcttctctcaaattctaaactctgatgcttctcgactaaatcggatggccgcgccaggcgtcgctgcgtaagactagatcgagaggcctcacgttatagaatttacgttcaaatatattatattatcagagtatttggtgccataaatataaatttttattcttcataatataggtattattatttataaataattcatgctactttgcactccggtcggatacgccctaactatagataaagccctgatcgatctccatcctgaaacacacgcaaaaccgtattctaattctaattaaacagaaactcaaatcacgaagacaaacaaacataaaaaaccgtttgcattacaacacaacccaaataaccttcctgtcctcctccgatttaggtaggccccaccggacagtgactcgaccttggcggcggctta

SEQ ID NO: 43940 - DNA, 1501 bp, Oryza sativa
ccttcgagttggataggcttacaattgttggtggcaacacgatcagcaacagttgtaaatcttgtagttactaagatcatactgcctttaggtccgttcttgaatggtgcataaaatgactcccactcgtcaatagcttcttgccaaatgtcatccaacaccaaaaggaactttcgtctccctagctgctccatcatttccacctgaagagcatctaaactgaacagtggcttatactcttccttggtgaaagactcaatgatctcttttgttattcttctcttgtcaaagaggtctgaaacacagacccataccctcctcttgccaaagtgagcttgcacccttggatcattgtagatgaactgagccagggtagacttccccaccccaccaatgctaaaaatcggcaagacagaaacattgccgatgcatttggcctcatcaagtctaggggccctgctgctctctcccttcagtttcttcgttctgcaggatgctgatttcgtgccagtgacagtggctgctgctctcttctctttagcccgtgcagcagcacccctggtgagtggcacacccagtaactcaatcacctgatctcgttgactattacgtccaatcatcgaacgcacacccagcttctcaatcactagatctcgttctttatcacggccaaacacttgagacacatctatgactgaacttgtctccggcatgtgttgaactgcctcgatactaagacccactgaattgatcgctccctctaaatcagccacagccttgtcgagcttctcctgggcctactttatccttgttttgctaccacggatcaaagtttttgcatgatttagagaggaagataagagttgacctgcccagctccggtcagcgtcctccatcttttgccgcagcgcctggtcatcgaactcgcggagaagatcctcggcgtcgtaggtggtgtccttgagctgcgacagaaggatcgccatgtccttgttcttgaacctgccccactcgccgcgattgatgaggaagcgagccttgggcaaggtggcctgcaggcgggacagttcatcgctcagctgggtcgcttcatagatgttgatcccggttgagatgatcgtttccacggcgtccatcacttccgtagtccttgattacttctccggatcttgccctctcgctacttctgatgagaaacaggagcgatcgattaagattacaaggagattatgtggtccaaaagcgaaaaatgtagcagcatatacataagtcaagtttacgagaaacggaatggcaccaaaaccaactcacctgcactcctccagctgttatactccctccgtcccaaaatatgaacatttttgaaatagtgccaagtcaatcatttctaactttgactactaatagcaagaaaataaaaaagatcaatcgtgtaaaattgatcttactagatttataatcaagctatcataatatgtaactctttttatttgattttttt

SEQ ID NO: 43941 - DNA, 1501 bp, Oryza sativa
catagcaagctggtagtaaatgatggtaaaacatgttaagcaatgtgggtttgcagctggaacattcgttttaaatctgaaattgtactgcagctgaattatgaagtgcaaaactcaccctgtagccactgataatagatgtcggatggattttgtttctcacaagatcattgccccgctggtaaaaagaaaaaaagagtgtcataaatgcatatttagaatggtaggcaaatacatagggaagaaaagactgacacgaaagctccatttcattacctttagcaattctgcggctattatcacaacagatgtcgttccatctcccacctctctgtcttgaagctcagccaactcaacaagaacctaacaataacaggaccaaaaaacaactaagcacaaaacaacaaccaggggaaaaaggagatggcacctttaagctgcctgacatcaccttggctgctggatgctcgacttccaacatcctcaaaatggttgctccatcatttgttatggtaacatcaccaatatcatccacaagcatctacaagaaggatatgctcaattagctcattccagccaaccttttggaattatcagggattggtgtggtgcagaactgatctaagtctaacttcattaatcctgattaggtttagtgatactgatgcacatactgttgtaatttcatgatttcataaaaagtttagtgatactgacagttatttcgagcacataacaacattagccgcacacatattacaccgttgaatcagtaagcgactgaactacatctggatcacaatgagcagctcataaaggagaaaatacgtcattctaagtagcggatcacacaattttgaaacctacaagttcgcatccttcacacacagtaacaatttatgcgcaaccaagtagatcaaatcgcaaggtacaaaccttgtcgagccccacgggcccaagcgaggacttaacgatgttggccaccgcctggcacgccaccactgcaatcagagaaggaaatcaaatccccgcgtccggacggcgagtcgtgccactagatcttacaaaaacccgccgcgactccacggaatctggcggcggggaagggcttgcaggagggggagagacgagttaccgttttgcgtgcggacgtcctggccggactggcgctcgccgaggatgtcgggggtctgggcggtgatcgccatggcgacgacgacggcggcggcggcgaggcgaaaactgtggaggcagcactggagagttcgaggcgggggtcggcgtctgcaatggggggttttgctggaggagccgcgggggttagggttcgatgcggttgtgaaatggaccttggacttgatgggccttgatgagcccagcccattataccggcccaaactcctcacgaaggcaacgcgagctcgcctccccttccccccgtcaccgccaccacccaaaccaaatcctcgcccatggcgccactagtctcccacgcgaaaat

SEQ ID NO: 43942 - DNA, 1501 bp, Oryza sativa
ttcatataatctgtccaattgagctttaatttgattcaagtcatatatcatatataaatatatttagacaaagaacaacaatatcatattgcgtgaaaataataattcataaccatcaaaaattatatattatcatttcaatatacaatatctcaacgtaaagatatgagggcaatataagtctacccaaaaaggaataatcgagagttattccattaccttgttgcgggcataaacaagtacaaaaataaaacatttgatacaatatagaatatactatgcaactaatcaactaatcctaactttgaatatttgcgatatacttaagaaagtcttatgcgccacattctatttgtacgtcaatggatacagcaaattttgttgtcttagctagtcaccttcctgcacatgcatttattttactaaaaaaatcatgatgtagcacaaggtagtatgtcagttccaatcacgcaatatcccacccaaatggttgcggcatgctgtaaaaaccaaaggacaacggtaagtaacattctgattagcattttattatcctctatatcacaaatattgaaatgcaccttttttacatgccatacatattagcctaggtacctagcgttgttaaccagtccaagacatctttatacacaatattcctagtgcttttccctataggtctacctctttctttggtcaaaggtacacatcttccatgccacagtttctaccttcggggggtaggaatgaaatgaaaaattcaactccgcttagctcctagtgcaaatcagttgtgagatagtccaaatttagacaccagaagctacctgttacaaaatcacgtgaacatcagacttaggccctgtttgtttcagcttatgattattataatctaaattattaaaccagattgctataagctagattataataagctgatataaaataagctgtgagttgtttgtttgtctggattattggaggcatggattattgggtttgaaaggctaaagtctataatgccctcagctatctattcggttgatggcatagatgggtaatttttctcaaatatgtaagggtagtgggtctttagccactcaataatctaaaaaaagctcctttaaagcagcttattagattataataatctggcttatagattataataatctgctataataatctatttgtttgtttcagtttactcctataagctagattataataatcctaagctgaatcaaacagggccttacagccataggcccccctgattccacaacaacccataggaggataggagaaaacacagaagaaaacaaaaagaaagaggaaatcctaaggagattggaggagcttgggtgtgaggaaggcaaaccgcatgctgtgtcagtgaccgatgcagcaggccagactccctgttgaatggaatcaggaactaaccatcaggttctccagcttgatgggtcaaaaaaaaacaagatttattaaccatcac

SEQ ID NO: 43943 - DNA, 1501 bp, Oryza sativa
aacacgatgacaggaacgattaattgttataacttgtgtagaatatacgtataaattcagtacagatttaaacagatataagttcagctgaacctcgctaagaaatatatatcatgaatctctctttgtcgtcaccaagtttgggtcttatccagtgattttccgtggttggataccgaacactggtttttacaacattaatcctagtagggaattttcatgcattacaaatgtggccttaccctagacttgcatattattgtacctagcatggactctattattgtgttcacctttctatcatacttgtttgttaataacatagtcttgattttctctttacaataaggttttgtggaatactccacacttgagatatttatttgctcgctattcatactcttagctaaaatgttaaacaaaatatggtaagcgaacatatctctactactttaaaagtgtaatcgtctgccttccgttcccttctcaccatgcaccagaggttgtgcgtccctttatgtgtacgtaatcaatatagaattcaatacttttccctcaatccacccacctagcctatccctaattatataggttagtctatgttttattctcaatccatccacccagccaatccctaattatatgagatgacccattggaaagcacagaatcttactagtttgaattaaatgtcatggttacccaaagaatctcaagtgatctatgaatgaaaagattgtagcaaattccaaagaaaaacctaggtcaaaaaaatccttcgaatggaaattgttgcttttacgcatcgcaaaactgaattttgaatatattataacagtcagtctcattactggagttgcatgcctgcaatcaatcgaggattttgttccttgcacacatattgatatactgactcttcagagagtgataacacaaaatggatctgcaggctagctgctgagccattgatcaaccaattttgtcttttcctggatcaatgcaaaaaaaatattcagtgacaggcatacaacctgaagaaccaattaagtgagagttgatctgattaattaactgatcagacgggtcgacgggacggccgtttacatccctagaggctctaacacaccttcatcatgcatgcatatgtgctattttgtatagttatgtgtgctataagtatataatattaatctatgtagcaacatctctagatcaggtcctagctatgatatgatcttccaggtatatattggaattggagtgagagagcccaaacatgcactgttgtacagaaccaaaatacaattgcaagtagctacatcatctataattcattcatccatatatctgaaactgcaaggaggctgctggctagcttcctcctctatttatacacacacccctctcacaggcctccacttgcatctctctctctctctctcccaattatatttgtagagagagggaagaaaagaagagaggggaggagcaatggcagggt

SEQ ID NO: 43944 - DNA, 1501 bp, Oryza sativa
ttaatggagtgcaattggaagcaacagagatcatcaaactaaatatgcatcttggtcaaggcatgatgcagagatcgattgaccaaatactacatgaacgtgcgataaaagcatcaaatttcgtgcgtcttcatccgtcgcaacatttgaatttgatcctccaaggaactaaatggaagggctgaaaatgtattacttgccttcagtttgaagattaaaagtctggagtttctcttcagtccttaatttgtacctttactaagaagctagttacatggtgaatagttaatactaactttatgcccaatgctatatactctcagactaaggaagtataatgctcaatacaattaatttattaattaataattctatttttctatatgttccaagtaagcagataatatgtgatgccactgaaaactttcgatagctcactaataatttctaaattcaaggtcttatacaaggagaaaccgaagaggtccacaatcaatttggaattttgcattgcgtgccttcaacctatttgattaatccgtgcattcaacagccaatcgataatcaagcctgagatcgatggcattaactaaatcaaatcaattaaactggctgagctttcgtgttgcagcaagattattaattggatatcattacatcaccagattcaaaacgcatgcatatatgtgcaagcatccatccatcaatatgatgatgatgtaattatctacgtgatcaaatcaatttgtaattaatccgagcaagtaggtcaggaaacgctcacctcgatcaaccggccggagagagagagaaaagagaagggatcaaaaggaaatgtggagagagaatgagacgtcggaatggagggagcgagaagagggggagggacgtagaaggcgggcgttcagggaagatgttgtgatgaggaagcaagacagcttgcatgcatgcgatgcgcccatagagaatttcatatctacatgacatgagacatgcaattttaagataatggcaaggaaaaagtttacattttcgacctctgcacatgtgcacacactactacagaacactagataggtgcgggcacaaatgactttgatcatcggtataaaaccggcacctataatatatgcataaactcgacacctttctctgacaggctaatagttgctggttatatttaaaaactggcacctatttagggagaaaggtgatttggtaggctggcagccgcgtgggcgggtgagtgggcgggaaaagcactatagttgccggctataccactttcggcatctacagtgctgatctctatttgcctccatgtagtagtgacacaacctatttatccttgtcggggattggtttctttcacataaaatcagagagatgtggttgctttcatgtgagtcataccaccctcaggctcacatgttagtaaccacgtcaggtgggaagttacgttagacaccctcaattagacatgtcatatatactcatgatt

SEQ ID NO: 43945 - DNA, 1501 bp, Oryza sativa
gcatcgtacacctcgtggcgttcgcgtggcgtgcatgtgatgagctcgagctgcgctaacgagctttccagagcaaagcgacgcgcgcggccggccggggctgcgcaggaaaaccccgaacctccatcagctgattctctgagcgtaaacctggagctacctggtagtagtagtattacgaatttaattacgatacaccgtcgcacgtcgctcacagccggcgcacacagctaaccagccagtacataccagcggatagatcaggcgaacggcatatactacgtgccttctgtatagtgttcacgctgtgtttagatttaggggtaaaaatttttatcgtgtaatattggatttgaagtattaaacgcactctaataacaaagaaattatagaatccacctataaactatgagatgaatttattaagcataattaatctgccattagtaagtgtttactatagtgctatattgttaaatcatggagtaattaggcttaaaagattcatattacaatttacacataatctgtataattagtttttttttctatatttaatattttatatatgtgtctaaacattcgatgtgatatgtgaaaaaacttatcaagagatctaaacatgcccataccttagtatatgcgcccacagaaaaaggcaaaggggaattaattagtacttgaatacttgatctctagatatatgtatgcatgattctgcgtcgaatcgtggttaccgaaaagatatgatcgagagctaggagttaactccatatagtagttaattatgttagctaagagctaggagtactcgtacctttctgatctccttggaatgtctttttctcgatgaccttacgtgaaagcgtaacgcgatcgagaaccgactcagccgagactcatcgttgcgcacgtacacgcgcgcgggggtggacggccggcgtgcacggttccgctgacacagacctgcacaggcgggcaaacataattagatcgagtagcccatgcatgttgattataccagtaagtttcacgcacgcacaccggtccattgatttctcgccgcgcttaatttgtcctccgatcctctcctggtctcgggtctccggaagttgaaattaaagcttcttcgatcgcgtgcgccgattgattcggattaccaaacttcccagagattttagcgatcgaatccctgctttgagatcgacgtgtactctccctccctggtcactggatttaaggttgtcgcgtgccccctccccctgcgacgactgcgagcctctccttcccttccaccttttttcttcctctcttcgcatgcacgcacgtacacactcacatccccccttttctctctccagatatctctctcatactatttaataaccggactcgtagtccctacctttccatgattccatctcctccattcccatccgcccgcatctccactcctcctctccccacctcctcatcaagctagctaagctagctctcccaa

SEQ ID NO: 43946 - DNA, 250 bp, Oryza sativa
cataatgtaagactttctagcattgcccatattcatatatatgctaatgaatctaggcacacatatatgtctagattcattagcatctatatgaatgtgggcaatgttagaaagtcttacattatgaaacggaggtagtatttcaaagcgtgccatctgaatatgggcagaatagtttccatgccatgccgtacgacgtaggctcgcgttgacttaatttgaccagtgtgtagtttcatatggtcgctaa

SEQ ID NO: 43947 - DNA, 1501 bp, Oryza sativa
gctatagcactataccttcgtacagtaactattcgtaattaactgtacagttgtacgcgtatgtatgtacatgcgtactggagtagtagtactagtacgtagtagtatagatttccgtaagcatacaggctcttgataaggagtggaagatggatggatgaaaccactgtttgccgtgttgcgtgcgcagcgaccacccggcgcgcgggttcctgttgatgccatggtgatcatatgcacggtcggcctggccagtggccacgcagccactgccactccaagcaagcaggctggctgggccggccaggcaggcagcgcagtgcacataaagtcgtgcattaaaatctgtgctctcagcgtctcacacatcccgatgagctttttggtgcgcacctgcagctctccccttgtttcccggcatcaaaccaaccagtactcctactactgggagtggtacgctcctgtttgtgcagctaacctgcctctccattggtctccctaactattactgggagtagtacgtacgtactacacgtactagtagtatgatgattaatggaactgttacggccgggacgggaggagtttgttttgtgtataccgtgtgggtgcgcagagcccctggccatggcctcgctggcgttgctcctccgccgcctctcgttgtgcccggccagccgccgccggcagctcttcttggcgtcgtcaaactccgcgagcacgtggaacctgcgcgtacaagtgaaagaccgctatgagcacgcgtgtagcagagctagacatgtgacgtagatcgtggtgattgacgcaccggctgcattgctggcagaagcgctgctcggtgccgtgcacgacgaccctcggggccttggcgtgcacctcgcacaccttgtgccgccggtggtactccttgactccctggagcgtaatgtcgcacccctccacctggcaacggggcaccaccggcaccgccgtcgccgccttctccttcctcttcccctgatccgcggaaccaccaccgcctccgcctccgccgccgccgctcccctgcgccacctggccggcgccgtcgccaccccagaagcacggccgcttcccgagcttgaggcaggtcagcccgccttgctgttgcatctggacgtcgggcctgcatggcgccggcgggaggaacggcggctgcgggctaggcggcgaggtgacgacgggagcccagtgcatcccaacgacaccacgtggtgtcgccccgcttccgccgcagccgtttccttccatggtggcagccgcacacggacggacctatgtgtaaacgtaccgcagctaagctagctagcgtcgttacacagcagcagccacctggtcgcgcgggcttggcttcgctccggccgacggcggcggatcgaaaactagcgccgattgggaaaaaggctgcggcggcggttgtaagtacagcgagtaggtttgccgcactggcgttccatataaagcgaagcagccaggcagc

SEQ ID NO: 43948 - DNA, 1501 bp, Oryza sativa
gctgtgcactgcatgcgtatgcatcgctttttcagatggcagatcagccttcgtgacgtgtagtaacacgttgtgcagttactagtgggagtaggacaagaggcgtggtgtagaagtgtccaacaggatgagatcgtagcgtataataaagtggatacctcctcccatgcaagcatatcgtacgatcgtagcgccctcctaaagacgctttacaccatctaatgcaaatcctctcacttttgcttggtttcctagcgtctaaatataggcttgtccgtattattgtcattttgaccgtatcaaattttgataagacaataaactaaacgcaacgcaagaatcttcaggaagattgcatggacccctcaaactctaatcacaaatataaaagaggaagcatgagcctagtaaagcaagggcagtaaaattgaaagacactacatagaaaagagttcgatggcttggaagacactatatagaaaagtcttttatgggcatggttccctttcccatgcgggcatgcccactacattgtttcattttaagcttttattcaccatctctattataatatataagacaaatattcttcctttccttaaaaaaaaactaaacatgatatcaccaacttcatcctaccaaaatttggtagttttggaattccctctcacaaaaaaactatcaaaaaattagaaaggtatcaaactaacgcacatcctacgctaccacaatttaataataccaaaacttgagaaatgttggtattgctaaaattcgataatgttgattttaacagcaaagtgaaccagagccctctgcatattctacctgtctgccgtgatgggccaatgctgcaacagcgactaagcgcggtttgccgtctgcggagtgctcaaagcgaacggcccagctcgcgttctagcctaacgttttcggtgtggattgaattaggcccatgtagaatacacttgggccgtcacacgaaacggaatggaaagggcccaaaaagcacatggaccttatcgctggtcctcccgtccccgttaacaccaccggccgcctcgtcctctcgccatggccgcaccatccgcgagctcccgtgcctccgcgatctagcgcggcgcggtggctctcgcacccccggcgtcgacggagcgcggaggaaggcgggcctccgtacagaggcagtcgaggggcacgggatttaggggagaggggttggggggatggggaggaagcctgatccgtcgaagccacactacggtggcggcgcctcgccgagggcagcgaggaggacgcagccgtcgccggttttcctgggaacggcgctgttcgtcctagggtttgtgtccctcttcacgggacacatcgttacggacgccgactggtcccggatccggagccggtggcgatccaagcaggtaattttctgacaacctagaaggtctgtactgtataatttgacgggatttatcggcaccacttagaattcacgtgatat

SEQ ID NO: 43949 - DNA, 1501 bp, Oryza sativa
tcgtccgtgggggaaacacaggagagtcccaggcaactcctgattctcgtccaaactgccctcgtgtactcgcaagcgtggaacatatgggcacatgattcagcatccttcccgcaaaggtgacagtatggagccaagtgccatcctcgccgctggaggttgtccgccgttaggcatgctccacgtatggcaaggaacatgaagaacttgcaacgggtcggcgcgcgagacttccaaatcagcttcccaaccgccgagcgtgtcttcccagtgcagaggagtgaataggctgattttactgagaaaccaccatctgtggcaggcttccaagaaaacaaatcaggctgagtagggttcaaggaaacggtggcaacaaggtcccagatttggaggtattcaaacatcgcttacagtgaaagacctcccctgatgtcgccggtccaggcatcatcctgcagcgccgaatgaaccgttctgcctctgtttttaacaaaggaacacaggattggggctcggttcaggatcgaccccccatctgggagccagtcatctgtccagaagaaggaactcttcccgtcacccagcacaatcctgcatccggccgctagacaatgttcggctttcctatcttgcggcaatgtgaaggacacccagtggcgctccggctagacacgccgcagccaaagccaccgcgtccgaagggcaatgcccattctgccaagattgatgatgcccaacccgccattttcgatcggcagacagagcttatcccaagcaactaggttgcatccacccagtgcatcctcatcccccttccacaagaaaccaagaaaccgtggtctcttgttcacatactcttcagtggttgtcttttgtaacttccattgcagggaaaacttctactactattcataatgcaatacctaagtaaagatcaacaaagtatatcacttccaatacaagattgcagaagttcctttacagccaagaaaaactgttgttcaagtaatattcagaaatttgatttctcctacatttaggagtcaaggaagagaagaagataagatattagataatacatcaagaacatgacccaacaacagtttagtcattacaatgctccataatgtttattagccaatagataagataatacatgacccgatagcttctttctaattgtcttgtggtgtatcctaacgtggttcatgtctaaacaatcacaataaacacaaagttcaggcgttcagcagaacagagtggttggtcggccaatataaaccacaaaacacgattagtttttagattatcaatcttgtggttatcatttcacgccacccataatattgtagtgaacatttaggactgtccatcaagtcattacagtcacctgttgtgtgtataaaagggggcctgaagaagggctttacctgcatcagtgtgatcaaccatctcctttgaagtcctagcctaaaagctcttctactcgcataaagaaaga

SEQ ID NO: 43950 - DNA, 1501 bp, Oryza sativa
cattttcagcccttccatttagttccttggaggatcaaattcaaatgttgcgacggatgaagacgcacgaaatttgatgcttttatcgcacgttcatgtagtatttggtcaatcgatctctgcatcatgccttgaccaagatgcatatttagtttgatgatctctgttgcttccaattgcactccattaattgtttgaactaatagtcgttttgcttcatgtaatcgaatgcttcctgcgttcgattggtgagagaagtgcactccaatgctgtaccaacagtactcttgggtttttctcttaggagagctttatttagagtgaaagggacttcctaattaagatttctttattttgaaagaagctagtaattaagatttcttaacatatgcacacgtgaagttataaaacatgactcaaatctgatgttgatgtgtgttcgaccaagtccctaatcagtttttgcactttttcttctgatttctcacgccaactgatcaattaaggcaagtaggattttagttgtgttcttttcttattgttttcctttctcttgcttttcgctttctcacctcctacctccttggagacagtccacaattgtgaattttcaacattagaaaaataatcacaattttgtggaaatgattgaaaaactaattaataggttgcatttcacatgaacatagttaattagagaacaaaatgcatacactaggtgttagagcagtacaaaagttatagaagatgtcactgcttactgcatgagtatctttcttcacaatcccattccatcataaatattgcctaaacaattccactcaaccttgttgcttgttcaactttaattctttcataacttgatatgaaggtcaggacaattactgtagactagtttcttcatggttgcacgctgaataatcgtacacagatgcccttgctgtctctgaattctcaaacactgaacatatattgtagaacattttacacctattcctgtctgatctcttgctgtgtgtgtacggagcatgctgccgttcttcccaagactttgtgtctcaattggttatttttgacttgaagcgatccgtttcggtagtccctgaggcagctagcgtaagcctcttttgacttccaagcacacaagttacttgctgcctcagattcatcagcaagtcactagtacttttcggtatctagatgaagcatatatataaaccacaagaaaagcggctgcccatttgtgttctgatcatgaggagattcaggtggtttcttgaaagtatgtattgccattgcttccttttgcccttttgatttttcattatatgatgtagagagaaaattatatatcttatcgcatcgatgctttatttttcgttgtgaaagggatgtgaatctgtggttgcaagatactgaagaaagtaataaggtggttcttcaatcttcataggcttcagagttcagagttgagttaatgtttttgcaaacaaggtgtctg

SEQ ID NO: 43951 - DNA, 1501 bp, Oryza sativa
agaactacaaaaatatctatatattttagggcgaagggagtagacaagttgtgacgaaccaaaaattttatctagccgagacaaatatacttcctatcaaattacttattattacaacttgtcctaagtcaagaccatcagttctagaaactcgtataatttaacaaaatgcaaattattttaaaaatatttctcattgcgaatcattggtttatgtgttgatataaatatttgcctcaagagaaaactaaaacggcaatatgaaacagggagcataaatgcacacctatattctagtctcacaatcctagtttcccaccgaaatattctaaaattgaaacttaggcaagaaaaaggttaattggatccatgccattacaattgtgtcgaattagagaagtgccattataaatcgcctatttcgaagcatgccatccgtattgatgttaattttggtccatcccataatttggtcgtctcccgtgtttgtacacgtagtatcggatacatatttgtgtatggacggaaatgcccctttcagacgcgctctaaaactgacctggttcagctcaaccgtatgcttgctccatccattccctactccattccttcctattcgagctccagatctagccggcggtggaggcgaggattcgagcgagagagatgcgccgctagcaggtgatggtgctggaaatgtgatggcgacaacccccctccccgcggacccctgggcgagacggcgaggagatggatctaggcgaatccaatccgaccatctgttcaaggccatgagtatccctaaccctaaatcaattgaaacctgtaatgttaagaggcaaagcatcttttttctgcatcatacatctttggctggcattgttcttcatgtgtggtgatttgtttggtaggcacaggttttcggtagacgttagggttcaaggctatgtgacaatagatgctgttggtaggaaaacttacacaaaagggtcaactcggtaatgggttgtggaatcagatagctttaacgttgagtttgtgttgagtagccttgttgagttaacttggggcccaaaccaatctcctaccatatggtatttttgtaagtcaattagtgaggacgtgagactattggagaatggccagattccagagttgtttgaaatatatgcagaagagagccactttgagcttattgtatccatcctggatgctgcaaagggtgtgccatttgctataaatgctttaaatcctatatgtgtggcgcctcctgaattccctgctgaaatccatcctgaaatccctcctgacatccctcatgaaatccttgctgacatccccgctagtattgttggaggttttgaccagcttacaacagaggaagcagaagttagagaggcagatatctttgacaatgaggagtatgttggtgttgatgatgagtgcctatatgttcctgcatctaaatagcaaggtcaacctggatctgaacctcaggggg

SEQ ID NO: 43952 - DNA, 1501 bp, Oryza sativa
ataatatttttttcttggtctttgagttaagggtagttatactttatattttggaatggagggagtagctgtcaacaaattaattagggcatgttcactttgatgccattttcaaccatatcattttttgccaaagttaccaaaaaatatctacgtttagttgttggcaaatctggttaatacataagaaatcctgccaaaattttggcattgctaaaaacttggtaaggtttattttgactacaatgtgaacatgcccttaattaaatcagctccgtgcatgcagcttttgactccatccacaaaattcgcatgcatggcgacgtggccggacagcatccaagaagcagatcctttgaacaaatccaagtagctagtccatgttgcatatgatcaccagaaacccaagcggatcaccgatctattagctctctctttaaagttgaagcagaggacgacaagccagcagcacagctagtagctgcaacgtgcaaaaaaaattaggctagctaactctactagcctcttacacacacacaaacacaagagtaggaagagaagattaagagaagaaggattgggttgggttgagtgtttcaaaatttgctgctactaggatccaattgccaacttggcacgcacacggtatgaaactgtgtgccgtatgtctcaaactgcctctctaatagccaaacaagccgtcactacaagagatcttatcatagttccgaaatccacaatagtcccggttccactaaaaacccggttggtggctacagcgggcatatatgatctttagtcccggttggtaagatcatctttagtctcggttctaaagatgttaggccttgtcagacccccagggactaaagatctcggcgatctttagcctggttgataacatcaaccgggactaattatctccctctttatatatgtcttcttcctcctccagcccgagcaagcttcaaattttctccaaaaaagaggggaggtcatgccaaaatttcttgtgaattttttttttggtgattatatacaaatcggaggtgtctaaaaggttagtaacttcatcctccaatgttttttgttgttatattacttttggagctatgtttcacacattttttgtctccaaaactttgttgtaagttgatgagagaaacaaattgtgtggggaagaataatatataggaattttgtttgtttatttaaaaaagttttattctcatagtttaaaatataatgaaaattaatcatggaaaatagaaaacaaactaaattgaaaattaaaagaagtacaacattaatattagtttaaaaattcaaaaataataaataagaattgtttgttggattattttataattattgtatgaataatgatatgtcattattgtatgactattgaaagagtttttaattatttgatcattattgtatgactgtcattattttatgaatatttatttatgtatgactttttttcattacatgtagg

SEQ ID NO: 43953 - DNA, 1501 bp, Oryza sativa
accactatcgttgtataagtcagtgaggattgcatcttcatttatatctacacagttacgcatgcactactaaatcatatccgtccggcatattttaagttttttttgggtgaatagctaatttagtccctcaagtttcagcgaaggctcaatttggtccttcacgtttcattttgtccacatagatccttcaaatatttgttttggtttgaaatcatccttgggtccacttaatatgccatatggctatttctagtcaatatttctattagaaaatgtcatttttgcccttaatttgtatacatctatatactagaatagaaaagagaaagccaacctgaataaacaatattacagatgtacttcccattatttcaacatatgcacatgaaacttaagcaattgctattgtatacacttgctagtacataatttttttcgttttacataatatactatgcattatctataaaaaaattcaagcatgcaatttctctcttatacatgtgaatgatgaggggtataagtgtcatttatgaagagagttgttggttcaaggataagtttgaactaaagtgaaaacttgaaggactaatatggatatattgaaacatcaaggactaaactgagtctcagatgaaacttggagaaccactttggctattcacccttttttttatgttaggacattgcattgaatggttacttaaatttcgagacgcataaaactcattcgacgtactaccaaatactctaatcatatctcctgtaggtcaaccctgcaactcttgaaaagaaaagtgtgatagaaaatcctacagaatacgcaaccacttccaatctttttccttcaacaaggattgtgttgttcacatcaaaattagaagtttaaagaaattagaacgatgtgacaaaaaagttgaaagtttatgtatgtagaaaattttgatgtgatggaaaagttgaaagtttgaaaaaaaaaagttagaatctaaacgggacaaaacaaaaacacttctattttctccccagcacatccatcctccctctcacttactaatgctgacgacgtggcatgctgcccggccacacgtattggcaccgaccgtatcaatccgacggcccagatgcatccccacaccgcttcgcgctccgccgcggcggaggagggcatttccgtcatttctcccgttgccgccgccgtcgtcgtcgtccagctcgtcgtgcggaagcagaaaacgttttgttttaattattatttattattattattatttatttttgcgtcagctcatcgactcgtttttctccacgccgtattatcctcatcagctgcagcttccgctcctccttcctcctccgcctcgtctcggctcgcgctagggtttactcctcctctccttcctcctcttcctcctcctccggctccagcggcggcgaggttgcgagcgcgtgtgtgctgcggcagtgtgtaaagaagggagaagggaaggggagggga

SEQ ID NO: 43954 - DNA, 213 bp, Oryza sativa
cgggcaatttgtttccctccggaagaatgttcttgacgagtttcaataaatcgccaaatgccttgtcactaacattattttttgccttccattgcatgaactcgagagtggtatccaactttttgtgcccctgctcggaacctgggtacaacgacgttctgtggtcctctaacatacgcttcaatttatgggcctccttttcactttcacagt

SEQ ID NO: 43955 - DNA, 241 bp, Oryza sativa
cgattttcccgtgcggacctattaagagagccgcatgcaaaaatactaactccctcttttcccactcacacactttaaaatttctcctttttctctcctctcccctcccctcaatcccattttcaactttaaaatttccacgcagagcttctcctctcagtcctctctctctcacgcttctcctctcctctctccattgtcctctcctctcctcccgatggcggcagcggcggcggcgcgc

SEQ ID NO: 43956 - DNA, 1501 bp, Oryza sativa; identical to SEQ ID NO: 43780

SEQ ID NO: 43957 - DNA, 1501 bp, Oryza sativa
atagtagattaatacactcacaattcctagatgtgcaatattcatgatttagaagttaaactaactttgtaggaatacttttaaaatgaatcttttaagaatatctctaacaaaagatgtatcagtgctgttaaggaacaataattataaacccttaggacaaccacaatgtatgaaaagataaccttaaaataacgattgaagttataaagtgagtcatatacattgtggaaagtagtattaccttatggtataccttatgcttatgcttaaggtctaccacaagaaaaagaaatcattattttcctctcgcattcacctcattaatcagagccaaagcatttttttatctcatgtgggtctatcttgtgaccaaatcctatctatagaattgtgagaattgctttaacaatgatcaattatttatgggatacatgttaaggttacaccaaaaaaaaaacaccgacattgccttgtggtctaatatttttctgatcttattttttctccaaatgcatttcctttgtatgataacatttatattcagctgtatgaataagttacaaataattcacctattgattatttacaaacacacaagaaatatacaattatttttgaatctcgatgaatcctacccataggataaaaaacccacaaaactcgctaaacaagttatcataaccattttcggattattaatcatagtacaccaagtcaaaaaaaaaatgtcaaaaatggttgaaaagtcaacctggctacaattcccatctcttcttttcaacggtagatgcaatacaattcccagcttcctgggattaggggcctgtttggtttccacggacttattccaagtccatgtcacaccagatgtttgaatactaatttggagtattaaacatacattaattataaaacatattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatatttaatactccaaattagcgtccaaacatccgatgtaacatgggctaaaaagttttagccctatctagacaccccttataaaacacggttcattacgcgctttctattgtaccactccgtgcaaccactgcgagactaataataaaaaaaggaaaaatataaaataaaaataaacaagtggggagtagtagtagactcgtagtggtaaaacagaggcgtcggctgagtcagagggcgaagaggaacagaggagggaagtccaatcggaatccaccccggccccaaccggggtcgcctcccctcccctctcgatccttcttcatccagcttcgcggccggcgcggcggaggagagatcgatttcttgctcctactcgattcggcctccggcggcggatgggggtcgcgg

SEQ ID NO: 43958 - DNA, 1501 bp, Oryza sativa
cgcctcctttgcagacgcgtggttgacacgagcctggacaaactttgacccggcacgcctaggcttcgggcatttgtcggcgaagtggccaagctcaccacagttgaagcaggaccctggctttgctccagtctccttggcttgcgcggacgggcctgactgtgctggtgccactggtgggtgtggagctgcaccgtggttaggctgacctccatggtggttctgactgccactggcgccctggtggaagttgctagacttgaacgtgcggtgctggcggacgatcatggtggtaggtccaccctgctgtccgagagtgaagcgcggtcgctgatggtttccttggttggaccggaactgtgccgcctttctcttcctgtccattttgttgcgctgatcctcctgacggattgccttgtcaaccaacctttcaaagtcggcatagtctccagatatcagctggttggttagctcatcatccaggcctgctaggaatttctcctgcttctcggcgtcggtgcagacatcctccggtgcatatcgcgcgaggcgattgaactcatggaggtactctgtcactgtcctgttgccctgatggagtgcccggaatcccctcttcttttgtgccacgaccccgtctggcacctgcgccttcctgaagctacgacagaactccgcccaagtgacttcagtgcctggcgggcgggtggccacgtgattgtcccaccaagctgacgcaggaccttgaagctggtgtgtggcgaaagcgaccttctcctgatcattgcactgcaggagattcagcttcttctctatggcatggagccagtcattcgcctccatggggttggtggtgctggagaaggtgggtggcctgacgcgtagaaactcgggcagcttggactgaggaggagggggaccaaactgctggtgctgctgttcggcgtgctgcagcatcctctggtgcatctgctggtgctgctgctgcatctgctgcatcatggctgccatcatctgagtctgatgtgccattacttgggccagcgtcagattctcgggaaatggtggcggaccattgccggaatcactgttggggtgcacaccatcagcgcgttcttcgccgttgctgccctcgcttgtcgtgcgggtgccattcctggtgtagaccatctggaggaagagcagacggggaaacggagaaaaacagttactcaggaactaagctttattatagaaatttaaactgcaattgttctgatctgaattaaaacactttaaacagcaagcaaaaatccttattaggacagccatatcataggcacatgatatcgactgtcgactgaccccaagcaagcaacctaaacacacaaactaacaagcagaagctaggcagtcgataagctaatggaaaaccagcctaatgctcggaacggctcctgcggtcggtggagtcgaaggcgtcctcctgctcgtcaccacgtccttctgagcgactcctgga

SEQ ID NO: 43959 - DNA, 1501 bp, Oryza sativa
ccctactcagagattactatttcatgcattcattacttgatataatagcttgatgagtatgttgtactcaccattgctttaaccctctctttgagaatcaatttggagtttttgccgaaccatgagtttaaacatataaattagtttcattccaacttagttcccaattatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcagttaccgaatcttcaattttgggacctgatgtcacgcccggaatttctatccaaaattccgaacgcttacatgtgtgttaaaccctcgtccaggaatcagccgaggcacacaataacaaattgataatagagtacaaataaataactatttaatattcacaaataataaatcattacagaggtagatagtttctctcaaagaataactttctacgcagcggaaaaataaaactaaaacaaactgcggaacagctatggcgactccactccacagacatcttaactagaacaaacttaatcctccagatcatcaccttcgctgagatactcctcttctgatgattgaatattgcaagaatgagcatatgacatactcaacaagccacacagcaaatatgcaagtgcacaggataacaaaggatggcataatatagctcatttgcataaacagcatttaacaaatatttaagagaatagtaaaacagttgagtaattaatcaaaactaaataacaccatacaacacacccatgttgtatagtcccaacctcatttgaacaaccaaccccggttgtacaaatcaaacctccataccaggaatataccattctaaaccaggagtcaaattaattatcacaattaccattaatgaataatatgggactaatcacgaaaaacattgctcaactcacccataaccgcgggtacggctattcgaatagttttactctgatcagaggtgtaccactgtacccacaagacacaatcccacaacatgtcaccacgcgccttagtaccaccacggtacctcggaaaggaactgtgacattacccctcgcacaacacaactcaccatagtgcaccgttcctggatcataatctccccctcaaaaccagaggcaatggactccccagcgacccccaccaacttctcgccgcttcacagtctggcacactataatgaatcatgctatacaaaagataaagccgttgcccacgctggcttgtggttggtacggtaaatgtttcacaacagtagctcgcgaaccggtccttaattgtcatgagcacaaccatgtcacgcccagaaattcactagtaatttccgaacttatt

SEQ ID NO: 43960 - DNA, 1501 bp, Oryza sativa
ctctgctactttatggccatacaattacaatcgatcttccgcgcctatgtaacatggggaggtgacgagttagtagcagtaaccgtagtttttttagtccatcacatttatgcatttacagtctatgaccgtattaatacttttgaaaggtatgttattcctcgaaatttcttcagtgtaggccagtatgctttatcagcccatacagatcggaaacagtacagttggacatcttaatacaactaaaatagttgaagtatctagatacagctatggcattataacctgaacccaaatgataaatggtatttcgtccgtttcactgtagttgccataattcctctttatagcgatcgcagagggtaaagctgaaatagccgactcgtaggtcgacttgagacgatatatatatatatatgcttagatcgttgatgcgtttgtcaatcgatcgcgttgtagcgagtgcgactgattgattgcactaatgaacaactccatccatggtgaaaaaaaaaaacaatttctaactttgaatctatacaccctctatattcaaatttatagtcaggaattgatttaattttttttaaggatggagggtgtgctcaagtacatatctttctgtgccgctagctgaaaagcagcctgaactgaaaacattcaccatatcatgcataacatcagagtcagacacatcaccatgctctagcctactcgatttacttcaacctaaacatgagatatacctccgggtcgtactttgattcaagatctgcagtcaagtacacttctacaatactcactccgttgaaagatacaaggcagggtttcacttatcgcatgataatcacacgattatcgcgggggtacggtaggagaaatcgacgatatggtttggatgaattttgaccaaattcaaaattccggaaaaaataaaaaaaaattgaaaaaaaatcatggatatggttcttgatttgtaattgtcaatggtgaagaatttttttgaaatagagtaagctatattcaaatttgagggcaaaaccgagaatagtttacaaattagaaaagggaagataatattgggccttaagtatcctacatattcttccaattattcttaatttctagttttctacacatattcaaccgtattttttatttttttcccctatttattttgtatttacataatttcagctacacagcccgcgataatcgtgcgaataccgtggttatcgcggtaaaccatgcgattatcgtggtgaaaccgcgaaaccaccgagttttgaattcgaatttttggatgtgatttttgtgtgattttagacgattatcacgcgattatcgtgtttatcgcgctaccgcagggtggtggttatctcggcccaaacgataaggtaaaccctgatacaaggtctatcagttttaaatagacttcaatactgaactttgacagttattttctttcaccatgtttcatcaatagtacaaaattaacatg

SEQ ID NO: 43961 - DNA, 1501 bp, Oryza sativa
catgtatatataagttggatttagccgatcgcaacaaaggttttactgtttaatctaatcttgtggattttatgacatcagacatccagccgatgtatgctttaacctttggatcagtgcttattctactatatcatattgttagctgattggtttctactggattatattatcatcagccgattgcctttatatcattatctacattggacatatagccgatctctcaaaaccctatcgctatcggctggcatcggctatcagctggaattactccatcggcttgttagccgatcggctatttgattttcaatttatatcttgtcatttacagggtcaaactggctggcacgcccgcatctcatcaacctttggtcctgcactggagctaagcagatctcccaggccagtgtgtgtttttcgcgtcaacaagtagaggtcgggttgctcctttgtaggaagtaccaagtctaccagtggtggcggtggcggcaacagtgacaagagggcgaaagagagataagggcaactacacacgtcggttgtgctggtagttgccactgtcctcatcgtcggcaggttgcagttgtcgcttgcggggaggacggggaatgccaaattggcatggaggacaacagggaaggcgatgatgaacgacgacggcgaatgggaaggccatggcaagagatatgtaggagagagggggacggggagaaatccgttgtgggacccacaaatggttagccaaaatagcatggggctagtgcataagagagtttggctagtcgaatggcttatccgttcgattggtatggctgttaaagttgatcttaattgacatataaaatcgacccgccagatttttgtgggtgagctgaacccgaatatcagtggaatattaccttttgagccaacccatcccacctagtcataaccaaaaccaaacatctataaaaatataggtttgacccaacccgaccccttcaaccaaatacatgcaaacatatctatgtaaaattgttaatagtactttgggctccgaagaaatgaatggtgtaactattttttttttttacgaaagagtaactaaaaagttattagtaatacatcgaacaagagacatgctctaaattaacctagaaactaaggctgtgtttagttcagcgtaaagtttggattttagttgaaattagaaatgatatgactgaaaaattatgtgtgtgacaggttaatgtgatggaaaatgactgaagttttggatctaaacacaacctaatttaaaacctgctaaaacttgcgagaagcaaacagagtccaaacctgccccaactgtcagactgtcagtccaacacccccattcccgctcctccggtgatctcccagatccaccaccgcgacggcagcgtcggcgcctaccgcgcaacgcaagcaatggccggccgcgcccgcccgcagccgcagccgcagccgcactcgccgtcggcctccacgcggcggcgcg

SEQ ID NO: 43962 - DNA, 1501 bp, Oryza sativa
cccacccacacaccttgtcaggtcccaaaattaaagattcggtaatcgacatgtttaaactgtatcaagccctggatcagtagattgatacaggtttaacaatctgaatcttcatagcatacatttgatcaaggctccaaaggagatttctttacataaaataatagggtatttacaagattgtggctatctattactgtagaagctataggatgagccaactctaatgttttgctatagaattaaaccatctatctaatctatacttgggaactaagttggaatgaaactaatttatatgtttaaactcacggtttcagcaaaaactccaaattgattctcaaagagagggttaaagcaaggctgagtacaacatacttatcaagctattatatcaagtaatgaatgcatgaaatagtaatttctatgtagggtttaggacctaccctaaaccctatacaaaaaggtccattggcattaggtgaattgcatttaggtccataggcccacttggcatacaaagcaattttacaaaaagaaccttacaagatttaaatttctagtaatgaaagaccttacgcctaatgaagtggctaaatagccggggcccacatgtcggtgacttggttgctggggagcagaggcaataggagggcaacggcgaccgatggcattcgcggcggcgtattggcttgatcatattttggcgtctttctcctgggacctaggcgacgtcggtggcgcaatggctcagccagggatggttcgagtcgatgggaacgacgaagtggggcgatggcggcgctctggacaccgggaacgctgacgagcataccaccaagtgttcgatctatgccaaaatagaaacaaagaaaatggattgattaggtagagaaggaacttcatgttcccgtggttggagtgcggtgaagctcaccagagaatacgtgacatggatgaaactccttcgggtgaaaagagtaagtggaagttcttggagattccgaggtagtttttggtggtttgcatagtggaacactatgagaaatagatgaggttcatagtggcgagttggcttgattaatcactactacagggacccttttagattccgtgcaggcagcaactcgtcgcttttggaaaaatcagctcattttcacgtgcggtccttttaagaggacggcacggaaaaatcgatttttccgtgcggttctcttaaatggaccgtacgtgaaaatgagccaattttcccgtgcagacctattaagagagccgcatgcaaaatactaactccctcttttcccactgacccactttaaaatttcccctctttctctcctctcccctcccctcaatccccttttcaactttaaaatttccacgcagagcttcttctctcagtcctctctctctcacgcttctcctctcctctctccactctcctctcctctctccactctcctctcctctcctcctgatggcggcagcggcggcggcgcgc

SEQ ID NO: 43963 - DNA, 1501 bp, Oryza sativa
ctcctgagaatccgagcgtttgatctctccccccacaattccaggaaacgcgaaacgcatgccaagctagcccgacaagcaatcattaaaacgctaaaaagctagcagcgcctttgtttccccccacacacataaactaaacccagctagctagctatccaacgcgatcggattggttggtgattcctccaacgcgaaatccagcccggagaagaagaagggaaaacacacacacaccagcaaaacaaaagcttcgctgctttccgcacccaacaggtcaacagtaacagattcacctcgaagacgaagcagtcgaggaggtagcggacgacgaggaagaagacggcgaacaaggggagcgcgaagaagtcgcggtacgccgggtaggcctcccgctcccagtccaccgccgccaggagccggcccgccgccgccgcgacccccatccgccgccggaggccgaatcgagtaggagcaagaaatcgatctctcctccgccgcgccggccgcgaagctggatgaagaaggatcgagaggggaggggaggcgaccccggttggggccggggtggattccgattggacttccctcctctgttcctcttcgccctctgactcagccgacgcctctgttttaccactacgagtctactactactccccacttgtttatttttattttatatttttcctttttttattattagtctcgcagtggttgcacggagtggtacaatagaaagcgcgtaatgaaccgtgttttataaggggtgtctagatagggctaaaactttttagcccatgttacatcggatgtttggacgctaatttggagtattaaatatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatatgttttataattaatgtatgtttaatactccaaattagtattcaaacatctggtgtgacatggacttggaataagtccgtggaaaccaaacaggcccctaatcccaggaagctgggaattgtattgcatctaccgttgaaaagaagagatgggaattgtagccaggttgacttttcaaccatttttgacattttttttttgacttggtgtactatgattaataatccgaaaatggttatgataacttgtttagcgagttttgtgggttttttatcctatgggtaggattcatcgagattcaaaaataattgtatatttcttgtgtgtttgtaaataatcaataggtgaattatttgtaacttattcatacagctgaatataaatgttatcatacaaaggaaatgcatttggagaaaaaataagatcagaaaaatattagaccacaaggcaatgtcggtgttttttttttggtgtaaccttaacatg

SEQ ID NO: 43964 - DNA, 1501 bp, Oryza sativa
acctaactcatgaatttttctatgcctacttctcaccatttatgctatgtctaagctagaagattttgctatggccatacctactcttaaatttttctatgtcggccttgactcagccgccccaatagaagtgacgaaactactgttgttgcaagagttggattccttcaagaaagtgatagatgaatctgaggcatcaagggagcagcaatcgaagaaaattgaaagtttgattggcctaaatgctccatattttgctctgaaaagttgacagttatgttaccaatcatgtatcattgtcattttcatagccttcatcatggcgttgcgaatattgtgaatattccaatggatcaacttgcatgccctaagtgtgagcattcttaaaactccaaggtaaaaagtcaaaaatgctgaagtgtgatgcatgcatatgtacatattgctcctcccaaatggacatcatgcaggatcgggactggacaacacattaaaggctctcatgctacacgcttcttgcagctgtagttaaacaagggcatcaagcggtagttcgataacaataagattcattggccccaacatacccccatccattccaataaatatggcacgcatgtattttaagatttatctttaaccaagaattagtttaaatttacaaagataattgatagaaaattagcatcatttcaacgtgtttttcaatacgaataccacaattctatttatgcattactagtcatcaacctgtgcacttgcatgggctaaaaaaattatgtgacatcaattaactaacgtggaagctttattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctagaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattatccacatcatcacataacgcttc

SEQ ID NO: 43965 - DNA, 1501 bp, Oryza sativa; identical to SEQ ID NO: 43957

SEQ ID NO: 43966 - DNA, 1501 bp, Oryza sativa
agtatgttgtactcagccttgctttaaccctctctttgagaatcaatttggagtttttgctgaaaccgtgagtttaaacatataaattagtttcattccaacttagttcccaagtatagattagatagatggtttaattctatagcaaaacattagagttggctcatcctatagcttctacagtaatagatagccacaatcttgtaaataccctattattttatgtaaagaaatctcctttggagccttgatcaaatgtatgctatgaagattcagattgttaaacctgtatcaatctactgatccagggcttgatacagtttaaacatgtcgattaccgaatctttaattttgggacctgacaaggtgtgtgggtgggcgcctagagcggccatcccgctccccccccccccccgagccggccctgactacatgggccttaacaggccacatggcatcttatcatgatttctgggcttgatggtgacgaaaatggacgtcatagactgtatgacgacagaaggatcatcactagattaatgacgaaaagataagcattctttatataacgccattagagacgcatgataggtgataatatatatatatatatatatatatatatatatatatatatatatatatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatctaaacatataattagttaggtatgtaataatggattgtgaaataaagttaaatttgagttgttttgttgctaggtataggtatgaatcgaatacttataactaggtatatactcacaatttaaaaattttgaaaaatttgggcgaatttatgtatttcataccatggtgcccgggcaccatggtgccccatatgagtgtcctatatatatatatatatatatatatatatatatatagtaaatttgtttggtgctccatggtgcccgggcaccattgttgaaattgagtatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatagattgtgaaataaagttaaatttgagttgttttgttgctaggtataggtatgaatcgaatacttataactaggtatatactcacaatttaaaaattttgaaaaatttgggcaaatttgtgtatttcataccatggtgcccgggcaccatggtgccccatatgagtgtcctatatatatatatatatatatatat

SEQ ID NO: 43967 - DNA, 1501 bp, Oryza sativa
tcaccaccaaattttgatttcctaatgatagacacgaatagtgatctaacatatggggggaaaggtgatgctaaaaaatatgcacatggacagaaaccaaaaactgttctcctacctgttggattcgctgctgacgataacacggagaaacaatgtgatcttgaaagcagggatactgctagtgatatcagtgagaagaaaataagtttgcatgagttacttaagcttgaaagtgcagaagaatccaaggaaagacttaaacttgaaagtgcagaagaatcccagacccagcatcaaagcacaacttctgcaataaatgaaaaaaacatgccccctgttcatgaagaggctattgcacaggtaaccacataagttactggcttaatctgtaatcaaatttgttttctcattaccactatcaccaggtttgtcattattatttttttattacctgaccctactcttttgggtgataacttgaattatatagttatgagaagttcaatcatccttagattggttttttagactgacaaacaggtttgacaccacattgcaggtttccacaaatgactgcaatgatgttgcaactgcatcaaaaactgatgaacttattactagcaacgtatcaagtatcaataacaccaacggttcatcagcaacaatatctgacagacatgatgcaaccgcagcattagataaacccatgtccactgctgagactactgacggtttaattggctccaaacaatttaacgaagttggaacagcagaagccatgcctgatgctctgacatcaagtagttcttcagaagtccaaccatccgaaaagagcaacgaccaccccgaaagcttcaccagcgagccgatagcggatccacaggatgaaaatgcagtggccacatcctcatcacctcatgttgtagagtccagtgatgcaaataggcagatgaacaacaagaactctgacaacgatggtgctactgatgtgcatgatttcaaccagacagattcagagagctgcgcagacgcaacaaacgatggcagaattagcacgagttctaccgatgcgcaaaaggattccactcatgtggatgaactagatgtgcctgataataatgcaaagggaaaatctctgattggcaatgggtatccccttgagccatgctctcttgggcctagcatcatgtgcaacccagtgtcgacctctggtcacattggcaacatctccatccggtcagatagtagcacgacaagcacccggtccttcgcatttccagtgtaagcatccatcctcatccactctgtcatgttacaactataaacttaaaccttcttttgtgttcatgaacaacttttgtctcaaaactgaaagttgggaggtatgtgctgctttggtggatgaacaggttacagtgggattggaacagcagcccggtgaggatggcgagagcggagcggaggcgaaacaagcggcgccgtggctggaataagggcttcc

SEQ ID NO: 43968 - DNA, 1501 bp, Oryza sativa
agaagaaaacatttcacagctccagtttttctatggttcgaggtgtcaaacgtcgaatatttcactatgacagaaactaaaattggagacatcactacaaacgtacgcactcttcctcgtctggcgtatataaggcgcaccccctcagttctactataaacgtacgcactcttgctcgtcgttgcaccgcacaagtacatagagcacttgcatgtgtataataggtcagggggaactggacaatatgcaattaatctctctggaggattcatcaagatcaatgctttgctttgcttgcccggtctcctagctagctaacagtctccttttgatggatgcttttatactaattaactaccactactaatgctcttataccaattaagtatatgtgtatcaacatagttaattaattcaccttggagactcttgcttatgggtggtttatatatatgtgtctcatgagatgatcaaaactgtgaaggcagattgatgtttgtttatccttctagctaatatgttatggccgattgagaggcacagttggagaagattacctaccacaatcctctcatcttgcgatttttgtcgattctcgtaggccaattagggatgcaaggaatcggggacttaatctaattaattaatgaaatggcaggacagtagtagacccttgctaatcccggccctctggccaattattcattgataattttgatattgacacaatccctaaaatttaactttgagacctgatcgagtgtcatgatcattgtattgtggaagtgttttagacaaatctactagcaccattatatttttcacatatttccatcttcacatgtatgctcgtgtatatatatatatatatatacacaacaaattaaaatgaatatttgcctttggttaattagcacctcaactctcatggttcattttctcgcttgagataaaaattgggaataaattaaccgatattttccataccaaaattaagctaatatcgtcaacaatttttaaaatgaaaaaaatcatcaaatattgcgaatatactaatggatcaacttgcatgccctaattatgagcattcttaaaactccaaggaaaaaaaagaaaaaaaacactgagatgtgatgcatgcatacgtacatattgctcctctctgttgaatagtcccacattggttgtggaagggcaaaggacctaagatataagtgggggagcccctcacctcaatggctagcttttggggtgggaaatgccctttacgatcctataattggtatcagagccaggctaggttaacttctctggcccgatggacacgtgtgtgaaggcctgatagaccgtgggtgcctgcgggacccgtatacctgatggaccgtgggccggtgggggcccggatacggtgaaggggcggtgaagggctgagaggcaccaatgtgtgaagggggagattgttgaatagtcccacattggttgtggaagggcaaaggaccta

SEQ ID NO: 43969 - DNA, 906 bp, Oryza sativa
ttcatctaaaatcaagatctacatgttaaaatatccacatgtactgttattcttgtttttgaactgtttgttgatttggttattgcttttagtttccgatgttccggaggagagcgttacgttgagaaaggtccagaagtgtttgaagaagctcaaggcaagtcacacagatccgaaacaaccctttgagcatgttgaacccgtttaaagctaatgttttatttcaacttatgcattattttcgaatgtcgtcgggtggtgagccattcccagttaattaatggccgacaatcactttattttcctatgggtaataaattgaatagctcatcaatggggttaatcatattacgatattacttatggttatatttagtggtagctcacgatagttaatcgtgttatgataattaattgatacataaacctgattaaaggtgggttgtgagtacatggttttgatggtcgtgcttataacaattaaggaccggttcacgagctactgttgtgaaacatttaccgtgccaaccacaagccagcgtgggcaacggctttaccttttgtatagcatgattcattacggggtgccagcctgtgaagcggcgagaagtccgtgggggtcgctggggagtccattgcctctggttatgatggggagattatgttctaggaacggtgcactgtggtgagttgtgttgtgttagaggtattgtcacagttcctttcgaaggtaccgtggtggtactgaggcgcatggtgacatgtggagttgtgtgttgtgggtacagtggtacatctctgatcagagtaaaactattcgaatagccgtgcccacggttatgggtatgtcatattatgccatcctttgttatcttgtgcatttgcatatctgctgtgtggcttgtt

SEQ ID NO: 43970 - DNA, 1501 bp, Oryza sativa
gagcatgtcaggataaatgcgagaaagataccccgaggagaaacccgggtcgcgtcctccggtccggaatagtcaaaggctagatgggcccgagcctggagcggctggatccgcctaccaacgaagtctgcagcgacttcataccccgacaagcctcgtactcggagatcgtcaataatgtcgataaacgactagagagagggggtcaaagggggctttgcggtccaagacgaaatcttgtccggttgttctttgggaacaacgaagacagggtctgaatctttgatctgaagatagaaccacctattccgacatttgctgcgagaagaagggcactggaaggggatataacgcgacttcaagccatcgcgaagtcgaaacacgacgcaaccagataccctgttggactccatccaacgcagctcgtagtagaagcgaaagagatcaagaaaaggctctaccccaatgtaggcctcgcaaagatgagaaaagatgctaagaaaggtgatagaattggggttcaaatggagaagagaaagaccatagaagttcaaaaccaagagaagaaattcggaaggcggagggagaaaaccgcagagaatatagtcttcgatcgcaactggtggagaatgatttgccgagatccatcactgatcgaagatcgctggagaaagggcttaggtcgatgaactagggtttcttgtggcagcgaagaaggcgaagagcaattgcaggcgggatgttttctgcacggtgggcggacttcaaaatggatccccaaaattcctttaaatagacgcactactgacggtgcgaattccaaggaacaaagagagattgtcgcaccctaaaaatcccaaatatataaattgttgtttaattggaattattagattttattttaaaagcctagaagagaagatctaattttaaataataaaatccaatataaaattgggccagataaaattttattaaatactttgcttaattctatagtccctagatttttctgggatttatttgagctaaggaagtatttttaataaatggaattgcatctcatgaataatttaaattgaaaaaggttttaaaaagttctcttctggcttcggcccaaaacccccccctctctctctcctcggcccaggccggcccgcagccaagccgccgctcacgcgcgcgcgtccgccgctgacaggtggggcccacctgtcggggtcgtcgtcttcctcgcgcccgaaccctagccgagccgcgccgccgccgcccttccaattccgtcgcccctttcccgatccgatgaaattgattgaggggaaaggatccccgagatctcctctacctttttccttttggaagcatcgtctatatcgctttggaaatcatcggatttgagctcgatttggattcccctttcctcccgaaccctaaaactttccttctcgtcgccggccgccgtgggacttcgccgccgccccctagcccctataaaaggacc

SEQ ID NO: 43971 - DNA, 1501 bp, Oryza sativa
ttatacactaccattttggtttataaaacgagataacttttaaatccttatttaggctcagcgatcagtggccaagggacaactgccgttccgtgaatgaagtcaagtcaaggattgttgtatgtttgctccaagagtcaattaaacgcttaggttattaggacggtttcacacgttcatttttcaacatggtgagatggaccaccgggaaattgggtttattttgttgacaaataggatagctagctgtaccgatcatgcatgctcatgtcacgaaatgacaacagtagattagggggagacgacatactcgaatctccttgatatattccctctagaacaaacttggacaaccaacatgattgttggaatacttgcaactgttgaacttgttcgtaagtattttcaatgaagaattattcaagtaaaaaaaacagaacagtagtttgtcctttctctagaaaatatgagagttttcatttttaaataagaaaggtataaatccctggtatctgcatccgacgtcaacttaaggatgcacattaccactacattagctaaatgttaattgagacctaaaacgactaagaagaaagaacaacatgataaaaacttatcaatgctaagactggtctgaaatggaaaaaaaaaatctgaacctgtcattgaaaccataggccgaccaaccacaaaattgcaatagtttttttagcgaggagatatttcaagcttcattcctacaataacgctttcaaagaaagggtacaacttgtacaatcgtcatcaaaatccaatcagtacaaaattttcaccttagtgtatatgtaccattctcctgtacacatcttcaagactaggacatccaatatatccaatgtttttggacatccaatccaatgtttgatgctttcactgtctccaaccagtgaatgccaaaaccagtttttccacctcaagaagagcatcaaaagactatgcctgggtatgggcttcttttacaattacacgacatacacacacgcagacacatcactgcacacgtaagatgatactcagtagtacatccataatctcactacaatctcgttagaaacctatctgcataaacgtaatatttgtgggtaccagaatttaaactccgacgaatgaagtcattcgcccatgactccacgcccccgactattcgctaaattcaaccaatagtaacttatcctcactaattaggaagccaatataaaccctatgtttcaatctattatattattaaaggaatagaaaaatgagcctccacgttcgctctcatggcctagaaattgtcacattaatcggagaaaaagaaaaagcagagtccatatagaaatacaatttagaaatagctgaaattcggaattgaaaaataaggaatattagaagaggagactagagtccatatagaaatacaatttagaaatagttgaaattcggaattaaaaaataaggaatattagaagaggagactaga

SEQ ID NO: 43972 - DNA, 1501 bp, Oryza sativa
ttatgcataaacaaaatccatatggattgttttgggggcccaacagtgagacatgccctgtataataatcctccccttcgagataactacacacaaagccgagccaaagtctctaggtcaaagtcaacagttaaatatgcatttctctcaaggtctatctaatcagtgtgtttctttcgcttggctaccaagtactagtaccaaataaacaagatattatggtattgtcaaataaacaagatattatggtattgtcacacatggcaggtacaaaccactgagctaaccacagtagctcacaggccattatcctgtcagtacttaagagagtgaagcacgcaacacacggttgctaatctccttagccctctcctccattggagctatagctagcaaactttttttttttactgagcaaattcagttagcgaagcgaaaaccatgaaggtaattaacatggttccttttctctcatgattcccgtgtttctgcaagtttgagttcgaatttggtgtgttttaatttctacgagttgcaccacgaattggtgcgtgttttatggaggtttatttgcagagtttaattggtgtttcctctgaaagtttcttctacgtacatattttgctttggtctgcttgaaactttttgtccgagacacaggcgagattttagttaatccatgtctgaagaacttatctgtgaaatccatgcgttgaaaatttcagaaggagatcattatcaggatttccgtgaaaaccgacaaatgccagaagaaggccatgaaagaggctgctactgtcagcggtaatcatctttgttttgatcttgttttgaatgcgaaatcgtggttgtgttcttgttgatttcatggttgatttgattccggtcgagctgcaggggtgcagtcggtgacgctggccggcggcgaccggaacctgctgctggtgatcggcgagggcgtggacacgaacaagctgaccaagaagctcaagaggaaggtgggctccggtgagatcgtcgagctgaggaccgtcgacacgttcgaggcggcggcggcgatgttcccgggcgggatgatcatgccgccgccggcgccggggagcaaggacgccgccgccgccagggcgatggcgacgacgcgggcgtcgccgtaccactaccagccgtcgccgtacggcccgtaccaccagcagcagcagtggcagccgccgtacgccatggcgcccagcccgtacgcgtacccgtaccagtaccacccgtcgccgatggcgatggccgccggcggcggcggctacggctacggcggcagcagctactcccgcgcggtggcgctcagccacccggccatctactcgccgctggtggagaagcacgactaccaccccatgaaccactccaccaccaccaagaagaagaccaccaccaccaccaccaccaccggcgccggcaccggccgcgccgccgccgcagccgccggcggcaagaccttcaaggcggtgtc

SEQ ID NO: 43973 - DNA, 1501 bp, Oryza sativa
ccgatctctacaagtgtagcgagggataacaatcgacgatagatgatgtgacgccgacgaaccatgcaaattaaatgatcatgcatgtagatatatatccatcggctttaattcgatacatgtatttgctgaaactatatgtgtcggtatcaaattatctaatctcctttttgtcagttcgtttaatttgccataccccagaccgatctcgatcgggtatgtcctccgtgcgtgcaacactcggaattgctccacaactaacttgcgacagtaagctaggctatatattggcacgtcgggcacgtgaaatattttgttttgatacacagagcgcaagcaagataaccatgccatcaattttcttagacagatcagatcgatctcgggtagatgatcttcttcttcttttttttgtttattgcaactgcttgactataggtctactacaaatgctttttaactccgccgtgcatgcagaagctagctagtggaaacgtgcgcggaaaagaaccacatttagtcaatccactttctagtgtgtgtgtatatgttcatccattttaaacttatactaccttcattttttttaataaataaagctgttggcttttaaaatagcgtttgatcgcttgtcttatttaaaaatttcgtgtaaatatactaaaatataagtcatatttaaaagtgtgtttaataatagaacaagtcataataaatatataatttttatataatttttaaataggacagatggtcaaatgttatgctaaaaataatcaatgatatcgtctactgaaaacagcttttgaaccgtgggtgttaaagattttgagttgcatttggatgcaacaactgttaaagttacttgtctactactcccttcatctcgaaaaagattaacttaggtgggaaggacaacgaatctgaatccagatttattgttttagatggtgttaaatcttcatttaggtttttttttaaaaaaaacgaatagggtatatttttatggtacatggaaaagttatcgaccaacatgaattattttttactaaaataattacacgtgaccaaaacaatactactacgacgacgacgaaattcaagtaaaggcacgtggtggtggacgtctgctcccgtcagcaaggagatcctggcatgtttggctgatatatctcgtatgatatttgtgagtggatgggccttttgtttatgcataaacaaaatccatatggattgttttgggggcccaacagtgagacatgccctgtataataatcctccccttcgagataactacacacaaagccgagccaaagtctctaggtcaaagtcaacagttaaatatgcatttctctcaaggtctatctaatcagtgtgtttctttcgcttggctaccaagtactagtaccaaataaacaagatattatggtattgtcaaataaacaagatattatggtattgtcacacatggcaggtacaaaccactgagctaaccacagta

SEQ ID NO: 43974 - DNA, 1501 bp, Oryza sativa
tatcctatgcatgtatacagttgatggatgtacatgtttgttgcacaatctctggacaaactcctcatatctagtcctgcgtaccaggcaattttacaattgtacgctttcgccgatggacagaagagaagattttcagatacacttagctcgtacccgtcaaatgaaggtaaaaggcaacgagtaacattgttttatgtgtactattgagtagtccttcataagataacttagttgtgtttgtagcatactatggcgtagtagacgagttagtaccatggctagcttgcatgccatgtgagtccatgttagtttagttaggctccccaacgtgagtaagtgaccgaataggtttagaaatggtatatttctaggtctggctagcttgcctatgtaggttaatatgtgtgtatattatcgcacaaggtcggaacttttttgaaagtcgataccgtacttcttacaaatactacctacctccgtttctatgaataacacacatgctcgttattgaccgaaagaattgagaaagaaagaaaaaatcttatattcagtaattggaggcaccaataaagcttccatgctagttaattgatgtcacgtaatttttctagcccatgcaagtgcacaggttgatgactagtaatatatacatagaattgttgtattcgtattgaaaaacacgttgaaatgatgctaattttctatcaaatatctttgtaaatttaaactaattcttggtcaaagataaatcttaaaatacatgcgtgccatatttattagaatggatggggttttgttggtgccaatgaatcttattgttatcgaactactgctcgatgcccttgtttaactacagctgcaagaagcgtatagcatgagagcctttaatgtgttgtcttagtcccgatcctgcatgatgtccatttgggaggagcaatatgtacatatgcatgaatcacacttcagcatttatctctttttaccttggagttttaagaatgctcacagttagggcatgcaagttgatccattgatatattcacaatattcgcaacgccatgatgaaggctatgaaaatgacaatgatacatgacgaaacaagatttcggcaatactaaaagggggtggctatcaagctagaaaagttgatgggtttgaagaccaggaagtttatactggttcaggccttcttaataagaagttataccctactcctgtccggggattattccgccgagtctattattgatcgtatgatctaagagtagaatgttgtaccccaagaggcacccggacccctccttatataggagaaggagtccgtattacaaaatacagctcatatccctaacggaataggtagttgcagatatgacctaatcgtaaccaactaggatcccggatatttccttaacatacaagtttggaacttaacccgagtctctttaaagatattctatctatacatgacattccatacctagtcggactatacaga

SEQ ID NO: 43975 - DNA, 1501 bp, Oryza sativa
tcacagccgaaaatcgtgaaccggtccttaattgtcatgagcacaaccatcaaaaccatatgctcacaacccaccattatcaggttttggttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagccaagatgaattagttatgaattttcaaagattaaatcggattaaatcatttatatagattttaatggaattatgacgcaataatgaattattttttaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgcctgagaactacggcacgacggcgctaacgaaaggcatctacgggttgcggacaacacggcgaactcaccagtgaccaaagtagcggcggaagatcaacggacggtgacggcgacgaggttgatacggcggtgaccttcggcttgacgacgacggcgatgctccggagacctacggcagcgacggaggggcggacgaggtcggccacggcttgtgatcacgatggcgaccttcctgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccaaatcgagctcaaatccgatgatttccaaagcgatatagacgatgcttccaaaaggaaaaaggtagaggagatctcggggatcctttcccctcaatcaat

SEQ ID NO: 43976 - DNA, 1501 bp, Oryza sativa
aagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcacactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatactcaaagggttgtttgggatctgtgtgacttgccttgctggccttggaactcttcaaagtcttctcctgcaaattcggactctccgggaacgtcggactctaaagagaaaagagcaaaatcaccaaaacagcacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagaggactcggctcacggtggaccgggtgcacggcggtggttcacggaaacgaacggccgagatcgatctatccaaaacggaccaagatctaacggtctacgaccggtctacggtggacggcgtcga

SEQ ID NO: 43977 - DNA, 469 bp, Oryza sativa
ctcttttcacctgaaggagtttcatccatcgcacgtattctctggtgagcttcaccgcactccaaccatgggaacgtgaagttccttctctacctaatcaatccattttctttgttcctattttggcatagatcgaacagttggtgatatgctcgtcggcgttcccggtccattgcgccaccatcgcccgacttcgtcattcccgtcgactcgaaccatccctggccgagccattgcgccaccgacgtcgcctacatcccaggagaaagacgcccaaaaatgatcaagccaatatgccgccgcgaacgccatcagtcgccgttgccctcctattgcctctgcttccctagccgccaagtcactgacatgtgggccccggctatttagccacttcattaggcgtaaggactttcattagtagaaatttaaatcttgtaaggttctttttgtaaaattgctttgtatgcca

SEQ ID NO: 43978 - DNA, 1501 bp, Oryza sativa
atttttataaaatttgcatggggattaagaagctaagcctaggactcagattctagttgtcctaagcctagctacgttctactccctccgtcccataaaaaacctactagtacctgtgacatatccatatactacgaatttagacatacatctattcaaattcattgtattagaatattcaaattcatcgtattagaatatgtcacatccggttctatatttgtttttttatgggatggagggagtagtgtttatacttttttttttctttacagtgatcattacgagtgttgtggaaagacaaacacttatctctaagtatataaaggcaataaaaatcatatcttggagtctatttataacttacaagcatctgaagcaaactctagtgttttgtttatgttgggttttacataatcatctctttgataggaacatttacatggtatacttgtcatttcgtaacctgtctagcctagacaacttttgtgggtcagcgttctcatagaaacgttctttagagttgaccttcttcggcctagttggcctacaggatcgagcttatggtggtgtttaaatgtcctgaagatatagatgaagataaaaattaagtgtttcacgtaaaacgaggttgtaataacgtgtgactaattgagttttaattattaattacaaacttgaaaaatatattaatatgatattttagaacaacttttatatagaaaattttcgcacgaaacgtaccgtttagcagtttgaaaaacgtgctacgagtatccaaatttaatccaacttttgttggagaaaatgtttgtgtcctatctatccaaaatgtgagaagcagctaaaccttttcataacacaaggatcgatcgacgaattgatagcccgctccccacctcataagcaatctcacgaatgtccataacgtacgcctcctcacggatggatcgctcaatctggactagctagctactcctagtttttccccctttttatctaaggccacctcatatcttatcttacgtttattttggtctggaaaatagaaatgtgcgtacttgggtttccatgaacttcgcttaaatagtgacatatatatatccagaaattatatgtgtacatattgtgaggatgaattaactaaacttgccacatttgtggccgacggccctggcaaatataattgagtttgcttttgtagctgagcacctccatttgtggttaaatcgatcaaatcgaacgattgactttcacttaatttgcaactcgattaatttccggtgaatcgaacgagcacgtacgtatggtagatgccaagcgtacttgcatatatgaagtacttgcatgcagttattagcctgctagtatattacagtacatatttctttaccttgaatcggtcgatcgacggcgtcaagaagctcaaaattaagcaccggttcgtcatctactaagagtacgtatacagtactagatcacatgtatgtgcctcatcctg

SEQ ID NO: 43979 - DNA, 1501 bp, Oryza sativa
atactcattagttctggagtaagtatattcggctgctaattaaaaaaagaagtattcactgctacaacaaaaatataaggtactccttattaggtactgctaatacacaaaaaactactatatagtactgctcatcacttcaaagagtatatatactgcggcttaaaaaacagtatatactgttgcatactagaaaaggtggggatatctaaggtacgttatcaaatttgaaagcaaatgcatgccaacaatcttgttcaaatctgcacccaatccggtgtgcagctatgccacatgcatgcagtcatttggaaattaatattattaatttttttcatagctaatttgaatgctaatggatcatccattaataaaagggtgtacatacacctgggcgtatgaaagagccatcatatatatatatatatatatatagatatatataatgcatatatatgtattgtaacataaaccctaaaccatgcagcaatagggccatgcaaataagaaaaaaattggtagatcgatctttagtccaggttatttcactcaggactaaggatagcgatctttagtcccggattcgtagtcccggttggataaccgggactaaaggggggttacgaaccgggaggaaaaagggtttctccaccagtgtagctgatgctaatttacgtcatgaaaattgaattttaagtcatgttgtgaaatctaacgttcgtgtgacaaatatcattcgtcacctatgtcacaccctaaaaatccgaaatatataaattgttgtttaattggaattattagaattgatattaaaagcctagaagagaagatctatttttaaataataaatttcaatataaaattgggccagataaaattttattaaatactttgcttaattctatagttcctagatttttctgggatttatttgagccaaggaagtatttttaatcaatggaattgcatttcatgaataatttaaattgaaaaaggttttttaaatcctcttttggctttgggccgaaagtcggcccaaacccctctctctctcccggcctaggtcggcccgcagccgagcaccgtctgcgcgcgcgccctcgcccgctgataggtgggacccacctgtcagactcgtcgtcttcctcgcgccgtcgcccggccgaaccctagccgagccacgccgctgcccttccaaattcgatcgtgtctttcccgatccggtgaaatttatagaggggaaatgatccccgagatcccctgtaccttttctcttttggaatcatcggctaaaatcgttcggaaatccatggattcgaactcgaatcggattcgtctctctccccgaaccctagactttccattgctgccgccggtcgccgtgggccttcgccgccaccccctagccgctataaaaggacccccggtgtctcctctacccgccgccaccctcgcctaagtctcttgtcgccagtagagccctagcgtcgtgtagtctagc

SEQ ID NO: 43980 - DNA, 633 bp, Oryza sativa
ctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatgctgatacacatatacttaattggtataagaaaattagtagtgatagttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagtagaactgagggtgcgccttatatacgccggacgagtaaagagtgagtacgtttgtagtgacgtctccaattttagtttctatggtagtgaaatatgcgacgtttgacacctcaaactggagaaaaattggagctgtgaaatgttttctttttttatatacgtggagctctgaaatattgacagttttgtttttttctataaaaaaagc

SEQ ID NO: 43981 - DNA, 1501 bp, Oryza sativa
gttcagtatgaaacctaccaggcatggatgcaagtaaatcaaaccataaattcacttaatagattaatcaagtggattgaccctgtaaattacccatctatttagtccaagttgatggatcaacccatctctaaccctattataaccagaattaaatttgaaaatacattgttcgttcaattttttctcaggaatattcgggatacaaatttttttgcagaaatataccgtcggtttcgcacaaccgttgcgtgaaaatgacgtggaatgacgtcgcggacggtattgcgcaaagaaaatgtgagaccgtgcggtctcgcgtagcgacgcgacgcgagaccgcacggtctcgcggattataagtgcgacactgttcggtctcgctcaagcaaggagcgataccggtgccattatgatttaattagcgattaattatcctaattagtgattaattaattattaattaattgctaactaggataattaatcactaattattactagttgattgttaattgattaattaattactaatcaaatggagatattggacaatttcgctgtttgatttcacgagagcgtttggtctcgctctttcattccgcgagaccgcgcggtctcgcgttatctcgtactttcatcgtgcgataccgtccacgacgtcaccatgttattttcgcgtaacggttgtacgatatcgataatatatttctgcaaaaaaaattgtataacgaatatttctgaggaaaaattgaatgaacattatatttggcatggacgatttgagatattttgattgggccgatctctagcccatatatacgtgtaggccggaaatctgaaaattctgtccacgtgggcccagaaaccttatcccctcacattaaaaattgcttaaaaatttcgaacactacacctgccgtctcctcctattcactccacccacctcgccggaatgctcgccgtcgtcttctcctccggtcaccgcctcctccccctccccgtcctccccggcacattcaccacccctcctcctcctcctcctcctcctctcctatcccctcgccgtcctctgctcgcccctcgccggcgccgctgcctatgcggcggcggcggtggcggcctcctcctccttcgcgccgtcgccgcgaggcgcgcgggcatcgtgatcgacgtcgacgaggtgggcgaggtcggcgaccgcgacctccccgtggacgtgtcgttcacccggaggctgccgccggtgctcaccctcggggacggcctcgccgcgctgcggcgggccggggaggaggtgaaggcctgcccgcctgccgccgccgcgagcggcgtcatccggttcgaggtgagccgcccagcgaggctgtgtgggaggggatatgtcgtgttttacagatttgcagttggtttcgttgtgagcagccgctgcaatatttgctgcgcggcggcgaggcgacatgctcccccccctcccttacgaattttaatccagcactgt

SEQ ID NO: 43982 - DNA, 163 bp, Oryza sativa
ggatcgtcttggtatggataaggtgcggatggctgcctacttgtatattatgaatatggtgcaaatggctacctgcattgtatgtatgtatcctatgcatgtatatagttgatggatgtatatgtttgtttcacaatctctgaacaaactcttcatatctagt

SEQ ID NO: 43983 - DNA, 1501 bp, Oryza sativa
cttacttgaccgtcccattgctcacgcacgccattgtaagttcatattcatctttgcagcaattaattgttaccatagtttttctctgagaaaagcaccatgaaatttgtggcaggagcatttccctttttctttcttcgtatgttcaactattgttgattttaaccagtattactatcttttttgcagtgaagaacacgtccatgtcgagccgtggttcatcaacagaaagaggattagaagattcaaagaagaagctcgatgaggagaagaccaagaaggttgaagccgtgcaagttggatcaaactctgtccatggagggagcccggatgttcatcagtttgcgaagatagtagtggttgaacgccggggaccaacgcctcaccctaagaagcacaacttatgagtatagatagccaagatagatggatatatagctgccaagttcatcccgctgtatctattttgatttagactagcttttctttttctcagttttatctttctctccctaggctaagataggagaggagtgaccaaactccatagatcatagctagtagtgtactactttccagcagcacgtcgttgagaaattaacctcaataaagatgtcacatatagcatcttttcaattttgtagcctgtatttgactactgatttttcaatttatttagaattttttttgaaggattcaggggtatccgatccatggcgttctcttgagtccagagagtatttgactacggaattctcaatttatttagaaaatttttgaatatggaagggaggaaaaaactagaattttttttttgaagaattgatggatacccaaatatccaatgcgtcctcaagtccatgttgagagggagattgacaactgatttctctaagatttttctaaataaattagagcctcttaagagggggataaaaaaaagttgagagttggtaaagagggggtcaaagtgcgcgagccctttttgccccccacaagagagaaataagttcactttgggtccctctattttttgtccgggtatgatccgtcccccaacttacgaaaaccgggcaaacgtgatccctcagcggttttggctggcgtgacgcatacgtgacttgtttgaataggtctttcgtcccacgtggcattgacgtggcgcttacgtggcaattatatctaaaaaaaataataaaaaacgtggccccacatgtcagctgcacaaaaaaataattttaaaattgtgggggccatgtgggccccacgtgtcagtctcactcctctcttcttccctctcccttctctctcttcttccctttcccctctctctttctctttctcaggcagaggacggcgcgggtgggcggcggagcaggcgagctccggcggcggcggtggccgtggtcggcgccgccgctccgcgtgaaggcgagcagcgcggcggcgccctagacgccatcgacgctgccatccatgtcgccgccgccgaccacccgga

SEQ ID NO: 43984 - DNA, 1501 bp, Oryza sativa
ttatggccaagttatgttaatgtttatctccaataaattgttgaccatatggagcgatctatagtcgatccatctgttggtcccaactatttgtatgtcgtgcatatgtgcgctcacaagcatatttaatttctcttgctacttttaataaggctatagcactatccaatgtgtcatctgttggtctctgaccttagcaatttaatgcaacatgattattattatttgtgtgtgcatgttctttacttaatttattcttagcgtatttctgatgtttttgtgagttttagactatgggagataattaagattgtcatgccaaagagtattccgaatcctactaggaaagcaaagggaggggggaggaaacatggtcaatttctcggctgctatcacattccttgtattcttagtgtaacatacccgaaattttaggacttaaaatttcttgtcaaaatagttagaggttaacttctccaattttgagagagccaaaaatttccgttttaatttaggtgaagatcaacttaaaccattgcatgattataatttgagaacaaaataaaatcttttcattcccaacattagactagaaatgtcaccaagcatacatgtacataatgcatgcctaggcttgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatatttcatccaaaagtacatttaactgcacataagtgaacatgggaaataatttattcaaatactagactagttatcatgcctaaatataatttttctagaattttcctcctctgtttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaccctctcaccctagcctagtttgccatgacctggacccacctggcagcctctccagctcgcccttcctctgtccctcatcctcagc

SEQ ID NO: 43985 - DNA, 1501 bp, Oryza sativa
taataaagaatacaccttagtatattttgaccgaagttttggaaattttgaccgaagtttggaaattttaaccacataacgacttgctgcagtagctggaagtaatttgtggattatctgaaattttattggaagcaatatttgtttatttaaggtgggaaagtataaattaaacttgacaagttcatttccagtaattgatttagtatgtatcttggcgtattattctttccaaggaaattttacagcccaattagtgtgtatcatctaatgaaaacctataatcttcagagagaaattttggtcttagattgattggcaatatttcatcatatgaaattttgattgatgaaagccgtagaaagaatctctgaaaaaaaaaagttttgctatatggatctcattatattactacaagatagagacaagatgtcaccaaagccaagcaagtactctattggcagctcgtctgctaaattacaagcccaaccatgatttgaattttgaaatatttgataaaaaaaataaattttgaaatataattttaaatatatctagttagttttcatcacttttctattattcagtcttgtttctacaacgctaagagtagaagtgtaaaatttctgccttaaaatcgtttttggctgctactatattgacatactagaaatgctagactctcgaaatcaagaattaaaacattaatgaaatgcatatacacaacaccatcaagctaagccatctaaaccacatcctgccttccgttaggtttcgtccgatgctgaccaacacttgatggctcataagtttcaggaatagaccgcccaactaatcgaaacattgaaccgaaatatttcagcttagcttgcacactgacgacctgacagggatgcagtcaattcggcaaaaatatgtttaattcaattagccaggtcatatgatctgacttgtgttttcttatatatacaacatgaatatgtagtacacgaatgttataatattgtcaagggacaaacgctagaaacctggcctgagctcactagatttgattcatgagatagttttcagtgacagtgctaccatattactatattgctaactatgttctgtttcatccgatagatcttcctttttgaattcccatatctgaattccgcaacactgcctactcttcgttttgaaagcaaacaaaagaggagataatcttagaaggatctttccatgtgcgagagccatttggccaaacttaattaagcagagtgcatgttctcatgaacatgggatgcgcttcctgttagctaaagtaagatacatataagtgcaagtaattaataaattgtattgattcaagtgactactcttgtatgatatctgatcttgggctttgtccattcagaagggcaatgtgtatatttgcattgaatggaaagagactcagtattcagtatttgcaaaccacaggtaaaagcaatgtctcatggcatgggccgagcagatc

SEQ ID NO: 43986 - DNA, 1501 bp, Oryza sativa
tgcttcacagccagaaagacaggaataaagtaaagctacaccagcactttctgtgtatcaaagtgctcgataaggaagtaagaaaatgtgataatgacaatagtactccactcatataaaacattatcttcttttctaattttctttctctgtgcataaacattcttctgtacagcagcataattatggtcttaactcttgactaatgactacagctggtaacagacagtgcaagattaggtcttagagttataacaaacttacatatcaacagataatttctgtatgaaccagaaaaattgagcaagttgcaatttctcaacactgttatttagttctcatttctggggatgttgttattctaccattcaaatcgagcaagttgcaattttctcagcagtgctatgttatcatttctgggttgttgttactccagcattttgcacgaaagcatcttcgtcaagagaatcctagtagacttagttactctgtctgtgataagttctcaaaagaacaacgatcaagtgcgctttcatttcatggaactaatcacactatgagctaaaatgagaggcaaacctgatggtagtctgggcctctatagtacagattatagaaggtagcgtggttatttcacggacgactaataactttttcatcccactagtagtgattttgataaaaacgtgcctggtttttggaaatgtcgaagaatgatgcttaaatattttttcccaacagtttggtgtacaactcataattttttttatgagttgagatcgagccttgaaagtgagggaagaagggtattcagcaagtttgaagtgctgaaacaaaatgttatgaatgctgcagaaagtattacgcctaatgtttttccattgaagctatacaaagataatactgcaaattatttttgaaatgcaaatagcatatatgcatatcttatgatactgtaactaagatagttttgcattttaactctataaattgaaggaagagtgataacaatcaaaaccacataggctggcaggtacagcacacagtgataaaaaggcaatagatcgtattaagttacagaagaagcacctgaattacaatggtagcagctcaggtgatcactaaaccggtagagatttgagtgtaactcacatgttcctggccttctttgggctgcaattttgcaaagtcagcagtcaacatttaaaacaatacagacaaggaatcaaggttacaacagcaaatggaggcattagacctttggaagtattactatttcgttgcttcgcatcaaatagttgtttcaatttgcacccaagtttaactgagagtgtgctcagcaaaactcctcccgcaacaagaacccagtttggtcctccttggacattatctgtttttctcgccttctgtatgctcctgttagtctttgacttcatcccagcttgtacgaactaccgatcttcagcgaactgtacaaatgcagtagcttgacctagaagac

SEQ ID NO: 43987 - DNA, 1501 bp, Oryza sativa
ctgtatgaattacgaatggaggttctataaaaaaaaaatatgtagcgcaaacttcatatgtattacaaatatagaaactatcgtaggacaaagaaatgagcacttgacatttgcccaatccatttctatatcctacgtatttcaagtttacgctacattttatgtgaagtgagcataactcaatcggttatttttcttgtggtgaaaccaacccacatggtacttgcatttatagctaattattctttcagtagtatgcgatgtacctatctgtgtgtatacgctcatagaggtgagtgcacgcgcgttacggaaaatactttgggatctagaaatggacacctaagatttagctacgtcaccaataattgtttcctcggttgtgtttgagacgagaggaaaaaaagaatatggagaatatatgtaaaacgacgtgagttattaacacatgattaattgagtattacttcctccttttcacaatataagtcattctagcatttctcacattcatattgatgttaatgaatctagatagaatgtgggaaatgctagaatgacttccattctgaaacggagggagtaactcatttaaatttttttaaaaagtaatatgatcatttaaagcaacttttctatataattttttttaaagaacaccctgtttaataggtaagaaagcgtgggcacggataacgatataattcttctctcaatccgtactctctcctcttattacggcagacgatccggatccctctttcttgcttgtttctgacaagtggaccaataaaattatttattcgtcagaaccggttgcttcttctgaaatgtctttttcttagagcctcgtgttagtttctctactactatctccgtaccaaaataagtgcagctattagtttccacgctcaactttgatcgtccgtcttatttaaaatttttttataattagcatttttgttgttatgagataataaaatataaatagtattttactcgtgacttatgtttttaatttttttttaaaaaattttaaataaaacgaatgatcaaagtacaatatttaggacggagggagtacaatatttgagactggttttatgttcattctctctctagtaccaatccaaagcatacaaatgcagaaaaaaaaaaggcgctcttccagtttgcatggatgttctgtgatagacagaatgaatattgtgatatcaatggttaaatctagtttcagttaataagtacattcgagattctagtcccagtattttcccttgatcaaatattcctcaaacactaacagcccatagtaacgatctaatcgtccatattcatgatgctctggcacatttcaggaaccaataggacatcagaatcgatctcttacgaaggcacacatgaaataccttttcctcttgcattctactagtagttacctttaaatgtccaaatgtaatgataacagtgatatctgcaccgaatcatcaaccaaacaagt

SEQ ID NO: 43988 - DNA, 1501 bp, Oryza sativa
ttttggtttgaagcctaccaaagttgttgtagggcaagaattggcatcaaacaaaacaacccatagattagcattatagatcggcaaattttggttccaatccaaatggccacatagtaccaattgaagctaccatttataactggtagggcaagaatcggcatcaaacaaaacaaccctatatctttcggttcactgacattgctccaaaacttctaactataataatcataaaaccaaacgaaaatatcctagtatgcagccaaacagaggctaatctgccagctcaacacagtacatttgtgcacgataactaatttccccctacaattgcttattccaggaaccgtgtggttcattcccccaaaagaaaatgctttccatttagctcaagcagctaattgttgatccaaaaccttcacaccacgcgaattggatctatcagacggggccaaaagccaaaaagggacgcttacctgcggatcgccactagaatcggagaagttcacgagctcgccggaggccttctccccgtcgaggccgtacttggcgagggggagctccaggggcgtggattccctgcaaaagcatccagcgacgacgggtcagctaccgtaaggcgctggattttggtccttttgtggagagagagagagagagagagagagagagagagagaggctagggttttagaggggggacctcgtgagccccggcgttgggcggagcgcgtcggcgagggcggcgccgtagccggcggcgtcgcggacgaggacgaggaccttgggtgccacccgcatggccgccggtcgccggtcgccgccgccgccgccgcgaatgatcggagggagagaggagaggggagggaattagcggttgagcacgcgaagagccagagatagagggtagaacggtaataacgagggaattcgttagaagtttagaagtccatccaattatttgtagtctcttcaaatttgaattcgtagtagtatttggtatccgtgtctgaaaaaaattcagattcttgattgttttttattcatcttatattttacagcatataaaagtttcttggatttgttcacgtcaccgtgaacaaaattggttatgaaacgtatgaatttagggccctttgaatcgcaggattgagaaaacgtatgaataggaaaaacgtaggattttgatagaaatgtaagtgtaaaatagaggattgcaaaacgcaggaaaaacacaggaatgaccgtttgattaaaccacatgaaaaatacaggaattggatgagagatagactcaaaggaaagttagcaagaggttgaagctcttgctaaattttctccaaaatctctataggattgtccattccataggaatttcaaagtattggataggattcaattctttgtttcaaagggcttcataagaaattttcctaaaatcctataggaaatttctatatttttcctccaaaacaaagaggcccttaggtttttatgattgg

SEQ ID NO: 43989 - DNA, 842 bp, Oryza sativa
aaatgatgatgttaataacttgtttagctcctggtttggagatagaactgtgcagccgggattggttgttcataatggttgggcctatgcaacagggtatgttgtatagcgttggattaatattgtttaattgttatttaactgttttattaaattctgaaatatttgttaaatgctatttatgcaaatgatattatactatgccatcctttgttatcctgtgcaatttcatatttgctgcgtggcttgctgagtatgtcgtatactcaccttgcaatcattcatcagagaaggagttctacaatgatgctgatggagtggatgattaggcgtagccctggtcaagctgcctgtggagaggagtcgcctgcgctgtttcttttaattttccgctgcttagaactttattgattgagatgaactatctacctctgtaatgacattttattcgcttattaattagagtaataattgtactctattatcaattttttattgtgtgcctcggctgattcctggacgagggtttacacacatgtaagcgtttggaattttggatagaaattccgggcgtgactgagatgcccgccggaaatttctgggtctgttacgcgcggcggttttttggacttcagttcaaattcgctcgtgaccgttgggcttcaaatggtgttctcgactatgtcttgtctctacggtcctcgcactgggaacgacaacagtctcgacgctagaagttgtgaacggttacacgaactcattttaagcagaagtcgggggctactgtcagggttacgggttaggcataccctttacccttcgatatacgtcacatatcggta

SEQ ID NO: 43990 - DNA, 299 bp, Oryza sativa
cattcttgctcaatctttcccccccttcagtaagagaagctttggagatgaagtcctaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggactaatacactagcgttcgggaaaaggcaattttctcggtcgcgtcaga

SEQ ID NO: 43991 - DNA, 1501 bp, Oryza sativa
aaactcttagtccaaacaaatgtctctttggttaatcgcttgattttcttttccatcatcaggttggttattaactcgaggttagaacatagttcctctgaaatgagaccctaggtctcctttgacagtaaacaattatacacataatcccatatcaacatcttccgaaataatcctcatagaacttgtttttattacacatgtctcccttattacatgaatacaaggccttgccttaaacaaaaagggaaggtgcttaacatcggtacattgcatcctcaacatgaatcatccataaccataacaaactcattgtttataatcatgaatgtatttatttattacatgattgctgcaaactcccgattacacaatgataagtagcgaactgaaaaccacaaacgtggctgctcattttgattctggagagatatagctggcattgttctagtgactgcatccttgattggttctgtgatgatgtgttaggactgcatattgctatcattcacaggagaagcttccttctgattgctatttgaagcagagaacggtcttctgcttggtatcgccctcctgagattgattgccctttgctcggcctggagtaggtcggggagagacacaacttcttccatcgacaacaattctttgctgaggctgtcggtgcagagaatggttggtgctgaaggtattattgctatgatttgttgcagagtcaggcgcagcaggaggagcattggtgctgtggatgatatcgtcgatgttgctgttggagctgactagctgacgagacaatcgtagggttgttcgttggatttctgcggtcttgatcaacaacacactgagttggcaatccttgggcacatggtttgtacctttgcacagaaaacatgtgaccttgcgggtgggacactcccctggtggatggtcttcttcacaatgagggcagagtgtgagacacctgctagcaatgtgtccaatttctccacaacgggtgcatgcctttgattccatctcttcctcaccgagatgtcggggagactcatcttcatcatccgaggagacttgatctgacccttcactatcagatactctgccaccatggcttaggaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcttttggcttgcttagtacgtgaccccacgtggtacgaaaggctaggaggaaagcatttcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgc

SEQ ID NO: 43992 - DNA, 164 bp, Oryza sativa
cccccttacaagaatctcgtcccggagattcgaggaggctagcatgaagataggttgggcggtcttctcttcttgtctgacttcttccgtcgcgtcttttataacaaacttgcctagaaaaacttctccactctaggctgcttgtctcgatcccttgttgcaga

SEQ ID NO: 43993 - DNA, 623 bp, Oryza sativa
caagtctctaatttttctttaagaagccaaagaacaatttttgtgctttatttcggtttgtatatgaagtttagtaaagtaaagccttttctttccgtttggtcgtgtagacactcaagcttcggaagatcggctcttcgtgaaatttaaaccggcgtttgggaaagcaagcaaggcaagtcacatcatctttgaacatattgaatcccagtatgtaaaattatgttatttacttattgcattatcgctttatttaaattcccgagttatcactgttttatttagccatgcctatttacctttgttatgaccttattattattgttattgttattattaccttgttcaccctagaaccaacaaaaccccaactagtggacactctactcatggtaccactagtatgattttaggtagatgcttccctttaattaggtaacattaggtggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatataaggaccggt

SEQ ID NO: 43994 - DNA, 1501 bp, Oryza sativa
ggagttcctggaggatgaaggctttggtgtctagctcgtgcctgccgtcaagtgcctgtggtcgtcgccctagtcttccgctgtttctcgtttgtctttgcgtgtgctgggccttcggtgcccatgtaataaattaactatttacgcttccgcttgttaaactctgaattgtatcaacttttggtgtaccttgcctcctgggacaaggattaatgcacgcacataaggaacgctcgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtgggtttttctttctgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggactgtgacgatgcagagccccacgctggttgggaggtcactgcagtgatcctctctggctctcccgagcggacttcgctggcagtcaccacgggtggagattctttccccgccgcttgccagagcgccgctctcctcgccatcggcactcttcaccagcgatacccggacgagttgcagcactcgccctaccgctaccaccctcgccgcggaggagcccgcgactacgccaccttccgggatgctagctcggaggatgacgctaccctcgtgcacctggcgtgcatggtggaggcgtacgacgcggctcgtatcgacttccatcagatggtgcgccgtgggatggtcgagaacaacatgaagatcctggagctgcgtcaagagaatctgcagctcaagaaggacctagacgcagtggaggcgcagctgcatcagctcaagatcgcccagggagaggtctgccgccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccagcgttggtagcacggaggatgcgctgttgctcaccttccgttcctggcccgtcgcagcggtagacgagcagttagtaggcttgcgcgtgtgttctttctcgtttgtcttcttgttgggttgtgtggggcatggttatgccggtgtgtggtataactgtgtcggagcctgtctttattttatttgcctaagcaacttgaactttaatgaaccaatttaatagcagtaataaattcaagaattatggtagtcgtgggtggttagctttaattgtcagctctctctgtttgctggttctgtgtggggttttc

SEQ ID NO: 43995 - DNA, 1501 bp, Oryza sativa
tgagcaccggtcgacgtcgccaccacctccctcgcctctgcgacgccgctctcatccccggcatcacctcctcctcgcccgaatttcgccggaacaaccgtgccctcgtcgcctcctcgccggctccggtcgtcgtcgtcgtcgtcctctcgtcgttcccggtttcgctcgttgtggcgttcgtccctccgtcaagccgttcttgtccgtcgtccgcgtccgtcaagtgtgccgctgcagccccatcgtcgtcttcgtcctcgcctccgcgtcgtcaagcctcgtgccggccgcgtctcaccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgttggtagtcgttcgcttgtgcgtgtggtgaccgtgttagtgtgcccgctcggtagccgcgtggtttccacgtgtgcagcccgtgtggtgtctagtggagtccgtttgttggcccctcgcctcggttgacacacggggtccgcttccgtcaacccgtggaccgtctctgtgtactcggtctaccgtggtcctttaggttgacatgtggggtccgcatgtcaacagcgcagccttcctgtcttttccaggctagcgcttccacatgttttatagttgcaaagcttaattacaataatccgcaaatctccatgtaacagcattaaacttcggatgatcatatcttggtcatacgaactctgaatcgacccgttcaagtctcttaatgtttgttataacctaaagaaccctgtgctttctttttatgtattgttattgcttctttataggcttgtagctttgcttgtgtgcttcgcgtagcttttgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgtttaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttatggtggaattggacatacccctctcttcctctttcaaagcccctaaaacctgtttttcggtggggtttgggtgcatgatagttgtgggaagtagcaccccggccactataaggattaa

SEQ ID NO: 43996 - DNA, 229 bp, Oryza sativa
ccgattttcccgtgcggacctattaagagagccgcatgcagaaatactaagtccctctttcctctctcacccactttaaaatttccactctttctctcctctcccctcccctctatccctttttccactttaaaatttccacgcagagcatctcctctcagtcttctctgtctcacgcctctcctctcctctctccactctcctctcctctcctcccgacggcggtagc

SEQ ID NO: 43997 - DNA, 499 bp, Oryza sativa
ctcaacaagttataccggaagaggaggtatgatgcatgatataaccaaaggaggctaggggttcttttgcataagctagcatttaaaaacagtagttgaaagtagtaaaacagttgtagtaattaagcagtactgaccaaatcactgtccaacgctacaccacgttgcaacaggcccaatcaaccacctgaactacaccagttcattaaactaaactaggggtgagactaatcacggtaaatctggttgatcgcccataaccgcgggcacggctattcgaatagttttactctggccagaggtgtacaactatacccacaagatacgattccacacatgtcaccatgccccgaagtatcaccatgatactgcaaagggggaaatcgtgacaagaccctccgcataaccctcccctaactatccacaccacgctaaggtttcactcccaccactcaaaaggcagtgggcggtcccctcttgcgccgcggtgaatccggca

SEQ ID NO: 43998 - DNA, 1501 bp, Oryza sativa
cggatctgatggcgggtggcgcggaggccagcgggaggcaggaggcactgtggccatcgggtggaagcccaccgccggattctagggtttcgttttttttaaaaaaatatatgttatttcggatttttgttttcccgtgcgagtgcgccacccgcacgcaaaaatcatcattttcccagacccctaggtgcgtgcgggccacctacccgcgcgcaaaaatcgttttagccctcacacaaaaatcttggttgtagtagtgaatggtaaaagtgaaggtgaaaagtgagagctagttgtcaacatgaggggtagaaacgatttaaaggagttggcagtggtttgaggctgtgatcccacttgtacttcactcaaccatgtatgactggctgtctagtggccccatgtagatgtttcctaggagaagatgagaggtatggtgaagtttgggtgtaaattggactttcactccctctctctctttctttctctctttgaaaatataatttaggataatgagatgattcaccaaggttgtttgcaggtatttggacgacaaataggcccatatatagatgtttcctagaaggcttggagtggtagagtggcattttgggtggaaattcaatttaaacctttctctcaccttttgaaaaataaaagaagatttaaatgagagaagagcagatgatgtgttggctatggttgtatgatgagtgggccccataaggacttggtcccacatttaagagagatgtagaaggagagaactagaagctctaaattttccatctgttggcactatcacactaaactatattaatctctttctctcattcatttaatttagaattaagaggggggtgacagggagacaacaaggtagacaaggatttgatgcttcaaggtgccaagttccaaagtttaattacttttgcttttaccatggtttgttgtcactaatgactccatttgaaccaggataataactatgttattttatgcatgtggcaatttaattaacaacataataactatattcatcgatcttaatttgtatttctgaatgtcgccgtagcgttagcacgggcagattactagttaataataaattaacacacatgcttaattaggtactactccctctattccataatataaggcatgcatgcaagcatgcaattaactatgacatcttcttcattaagttattacttttttaaatcctttactctcatgttatctaatcctattggatgcatgcattatatttattaggatgattcaaactacaagatgataataattttttcttggtctttgagttaagggtggttatactttatattttggaatggagggagtagctgtcaacaagttaattagggcctgttcactttgatgccattttcaaccatatcattttttgccaaagttaccaaaaaatatctacgtttagttgttgccaaatctggttaatacataagaaatcctgccaaaattt

SEQ ID NO: 43999 - DNA, 164 bp, Oryza sativa
tgatacataaacctgatgaaaggtgggttgtgagtacatggttttgatggtcgtgctcataacaattaaggactggttgacgagctactgttgtgaaacatttaccgtgccaaccacaagccagcgtgagcaacggctttaccttttgtatagcatgattcatt

SEQ ID NO: 44000 - DNA, 1501 bp, Oryza sativa
ctaacgctacggcgacattcagaaatacaaattaagatcgatgaatatagttattatgttgttaattaaattgccacatgcataaaataacatagttattatcctggttcaaatggagtcattagtgacaacaaaccatggtaaaagcaaaagtaattaaactttggaacttggcaccttgaagcatcaaatccttgtctaccttgttgtctccctgtcacccccctcttaattctaaattaaatgaatgagagaaagagattaatatagtttagtgtgatagtgccaacagatggaaaatttagagcttctagttctctccttctacatctctcttaaatgtgggaccaagtccttatggggcccactcatcatacaaccatagccaacacatcatctgctcttctctcatttaaatcttcttttatttttcaaaaggtgagagaaaggtttaaattgaatttccacccaaaatgccactctaccactccaagccttctaggaaacatctatatatgggcctatttgtcgtccaaatacctgcaaacaaccttggtgaatcatctcattatcctaaattatattttcaaagagagaaagaaagagagagagggagtgaaagtccaatttacacccaaacttcaccatacctctcatcttctcctaggaaacatctacatggggccactagacagccagtcatacatggttgagtgaagtacaagtgggatcacagcctcaaaccactgccaactcctttaaatcgtttctacccctcatgttgacaactagctctcacttttcaccttcacttttaccattcactactacaaccaagatttttgtgtgagggctaaaacgatttttgcgcgcgggtaggtggcccgcacgcacctaggggtctgggaaaatgatgatttttgcgtgcgggtggcgcactcgcacgggaaaacaaaaatccgaaataacatatatttttttaaaaaaaacgaaaccctagaatccggcggtgggcttccacccgatggccacagtgcctcctgcctcccgctggcctccgcgccacccgccatcagatccgcgctcccctccagccgcaacgccgccgacacccctcccctccgccggatctagggagggaaggaaggggagaggagcggagctggatcccgcgcggggagaaggcggccggctgccggatccgtgcggggatggccaccaccgctggattcttgcgttgacggccactgccgctggatccgtgtaggggctaccgccgcccgccagatcccacgccctccaccgccgccacatggaggaggccggcgcgctcctcccaccaccactacgccgctgctatcgccaagagtggagagaggagaggagaggcgtgagagagagagaggactgagaggagatgctctgcatggaaattttaaagtggaaaaagggatagaggggaggggagaggagagaaagaggggaaattttaaagtgggtg

SEQ ID NO: 44001 - DNA, 1501 bp, Oryza sativa
ataaatgcgagaaagataccccgaggagaaacccgggtcgcgtcctccggttcggaatagtcaaaggctagatgggcccgagcctggagcggctggatccgcctaccaacgaagtctgcagcgacttcataccccgacaagcctcgtactcggagatcgtcaataatgtcgataaacgactagagagagggggtcaaagggggctttgcggtccaagacgaaatcttgtccggttgttctttgggaacaacgaagacagggtctgaatctttgatctgaagatagaaccacctattccgacatttgctgcgagaagaagggcactggaaggggatataacgcgacttcaagccatcgcgaagtcggaacacgacgcaaccagataccctgttggactccatccaacgcagctcgtagtagaagcgaaagagatcaagaaaaggctctaccccaatgtaggcctcgcaaagatgagaaaagatgctaagaaaggtgatagaattggggttcaaatggagaagagaaagaccatagaagtttaaaaccaagagaagaaattcggaaggcggagggagaaaaccgcagagaatatagtcttcgatcgcaactggtggagaatgatttgccgagatccatcactgatcgaagatcgctggagaaagggcttaggtcgatgaactagggtttcttgtggcagcgaagaagacgaagagcaattgcaggcgggatgttttctgcacggtgggcggacttcaaaatggatccccaaaattcctttaaatagacgcactactgacggtgcgaattccaaggaacaaagagagattgtcgcaccctaaaaatcccaaatatataaattgttgtttaattggaattattagattttattttaaaagcctagaagagaagatctaattttaaataataaaatccaatataaaattgggccagataaaattttattaaatactttgcttaattctatagtgcctagatttttctgggatttatttgagctaaggaagtatttttaataaatggaattgcatttcatgaataatttaaattgaaaaaggttttaaaaagttctcttctggctttgggccgaaagtcggcccaaaacccccctctctctctctcctcggcccaggccggcccgcagccaagccgccgctcacgcgcgcgcgtccgccgctgacaggtggggcccacctgtcggggtcgtcgtcttcctcgcgcccgaaccctagccgagccgcgccgccgccgcccatccaattccgtcgcccctttcccgatccgatgaaattgattgaggggaaaggatccccgagatctcctctacctttttccttttggaagcatcgtctatatcgctttggaaatcatcggatttgagctcgattcggattcccctttcctcccgaaccctaaaactttccttctcgtcgccggccgccgtgggacttcgccgccgccccctagcccctataaaaggacc

SEQ ID NO: 44002 - DNA, 1501 bp, Oryza sativa; identical to SEQ ID NO: 41929

SEQ ID NO: 44003 - DNA, 1501 bp, Oryza sativa
aaaatcgtgaaccggtccttaattgtcatgagcacaaccatcaaaaccatatgctcacaacccaccattatcaggttttggttggcaagttaattaattaatcaatcatgattaaccatcatgagctatcattaagccatcattaaataatagtgaagcataagttatcccaatagtgtgctaatgtttctaagcatggctaagcacttatatctaatatccagctgaacccatatataaagctcaactagtcaagttacaataacccaaggtatcaaggaataaagtactgaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgccagcgaactacggcacgacggcgctaacgaaaggcatctacgggttgcggacaacacggcgaactcaccagtgaccaaagtagcggtggaagatcaacggacggtgacggcgacgaggttgatacggcggcgaccttcggcttgacgacgacggcgatgctccggagacctacggcagcgacggaggggcggacgaggtcagccatggcttgtgatcacgatggcgaccttcccgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcgga

SEQ ID NO: 44004 - DNA, 658 bp, Oryza sativa
taaggttgtgatttattggtagatctacttgtggtttaatgtgcaagaatgcttggtagatctgattgttgttgaaagtgcaagaatgcaagaatgaatggtgtgaactaatgcatatgtcctggtatgcttatttcaaagtactgtgaatatgtgtattatacacaagttagcatgcacattgatctttgcatcttttgcggtaggccatagtatgcatatgtgtattataccatagtgtattatatacttataatgtgaaattatatgtggaatgctccactgaaaatttgatattggttaattagtttaggaaaaattgcaaatatgatcttgtgagaatttgtgaagtacatagaaggcaatttgttttgacaatgaagtatggattgttgtttgttgatatagttatccgtaaaactgcctaaatttaaatgtatgtttggtaaacggaaataagatatggttagtgatgtcatagttttttaacgactatttgtccttgtgagtaaggttgtcattcctcagctttactgcctttagtgtggctatatgtctcccaaacctgagaaaacgaggaatgggatagcagccgggaaattgactatgtttcctcccaccccccccccccccccgcctcttttgctttccttctagg

SEQ ID NO: 44005 - DNA, 1501 bp, Oryza sativa
ggcttgccctccgtttcccgcggagacccccggagttacgttcccgccggcgtccagtggcgtcgccggtgcgccgatcgacgccgccgtctcctccttcgacaccgtggcatcgttccccggtcgtcgtcgtcgtcgtcctctcgtcgttcccggtcgtcgtggcgttcgtccctccgtcgagccgttctcgtccgtcgtccgcatccgtcaagcaagccgcggcagccccgtcctcgtcttcgtcctcggctccgcgtcatcaagccttgtgccagccgcgtctcgccttcgtccaaggatcgccgctgaagtcgttccctcgccgttcgcctccgtcgtccccgagctgtcttcgccgcgcccgttcatcgttgtcgttcccacgcctcgtcgcgtggtggtaaggatccgtcttctcgctgccccgtcctcgtcctttcggtgtcgccccgtacccgttgtgcggttgtcgaccccggtacccgtgtaccggtgtcggtagtcgttcgcttgtgcgtgtggtgaccgtgttagtgtgcccgctcggtagccgcgtgatttccacgtgtgcaacccgtgtggtgtttagtggagtccgtttgtcggccactcgcctcggttgacacacgggatccacttccgtcgacccgtggaccgtctctgtgtacccggtctgccgtggtcccttaggttgacatgtggggttcgcatgtcaacagcgcagccttcctgtcttttccaggctagcgcttacacatgttttatagttgcaaagcttaatgataataatccgcaaatctccatataacatcattaaacttcggatgatcatatcttggtcatacgaactctgaatcgacccgttcaagtctcctaatgtttgttataacctaaagaaccgtgtgctttctttttatgtattgttattgcttctttatagggtttagctttgcttgtgtgcttcgcgtagcttctgtcgttccggaggttctcgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgacattattattgctattgttattattaccttgttcaccctagaataaataaaaccccaactagtgggtactctattcatggttccactagtatgaatttaggtagatgcttcgctgattaactaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgttagtagcacctcggccacataaggaccggt

SEQ ID NO: 44006 - DNA, 253 bp, Oryza sativa
aatcatcgtaggccttgggttaaggcaggttcgtgtgggttcacggccttgattagtaatactgtgtagctttaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcagtctttccccccttcagt

SEQ ID NO: 44007 - DNA, 729 bp, Oryza sativa
tattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaaaaatataccatttctaaacctattcggtcacttactcacattggggagcctaactaaactaacatggactcacatggcatgcaagccagccatggtactaactcgtctactacgccatagtacgctacaaacacaactaagttatcttatgaaggactactcaatagtacacttaaaacagtgttactcgttgccttttatcttcatctgacgggtatgagctaagtgtatctgaaaatcatctccttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattatccacatcatcacataacgcttctgcctatatataagagcagcagcttacattcaagaat

SEQ ID NO: 44008 - DNA, 1501 bp, Oryza sativa; identical to SEQ ID NO: 43800

SEQ ID NO: 44009 - DNA, 1501 bp, Oryza sativa
actttgggctgggcttggcccaaaggaggaaggaggatttatttttagtttttctttttagtaaactttgataattgtttttgttgcttaataattatttccggtgctctgaaaattgaagtaaaatttgagggctctttttagaccacggagaatttaacaaaaattctccggaccacattcgaatttttcttgtacgtattttagtgattgccaatttcttttcgaattttaattaattctattattccttttagaaaatgatttttaatttcgggatgaatttatcaggacgtgacacattacttgatataatagcttgatgattatattgttctcacccttgtttttgccgaagccaggagtttaatcatataaattagtttcattccaacttagttcccaagtgtagattagatagatggtttaattctatagcaaaatattagagttggctcatcctattgcttctacagtaatagttagccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatcaattaattatcataacacgattaaccatcgtaagctaccactaaatataaccataagtaatatcgtaatatgattaaccccattgatgagctaatgtttctaagcatggctaagcaattatacctatatagcacttagctgaaccaa

SEQ ID NO: 44010 - DNA, 1501 bp, Oryza sativa
tcgaggtgtcaaacgtcgaatatttcactacgacagaaactaaaattggagacatcactacaaacgtacacactcatgctcgtccggtgtatataaggcgcaccccctcagttctactataaatgtacgcactcttgctcgtcgttgcaccgcacaagtacatagagcacttgcatgtgtataataggtcagggggaactggacaatatgcaaataatctctctggaggattcatcaagatcaatgctttgctttgcttgcccggtctcctagctagctaacagtctccatttgattgatgcttttatactaattaactaccgctactaatgctcttataccaattaagtatatgtgtatcaacatagttaattaattcaccttggagactcttgcttatgggtggtttatatatatgtgtctcatgagatgatcaaaactgtgaaggcagattgatgtttatttatccttctggctaatatgttatggccgattgagaggcacagttggagaagattacctaccacaatcctctcatcttgcgatttttgtccgttctcgtaggccaattagggatgcaaggaatcggggacttaatctaattaattaatgaaatggcaggacagtagtagacccttgctaatcccggccctctggccaattattcattgataattttgatattgacacaatccctaaaatttaactttgagacctgatcgagtgtcatgatcattgtattgtggaagtgttttagacaaatctactagcactattatatttttcacatatttccatcttcacatgtatgctcgtgtatatatatatatatatacacaacaaattaaaatgaatatttgcctgtggttaattagcacctcaactctcatggttcattttctcgcttgagataaaaattgggaataaattaaccgatattttccataccaaaattaagctaatatcgtcaacaatttttaaaatgaaaaaaatcatcaaatattgcgaatatactaatggatcaacttgcatgccctaattatgagcattcttaaaactgcaaggaaaaaaaagacgaaaacgctgaggtgtgatgcatgcatatgtacatattgctcctctcaaatggccgggagtattaatttagaaccgaaagatatcatttttgtcagtctcgtatttttcatgtaaatccgacacgcgattacggttggtgaattgaacttggtcatctggagcacttttcaaaaagtttcatttctgtacagactctaaaaaaactagttggcaagtgaaattctttagtttcactattatgaaaaggattattcctactgcacctacatccgaccacatcaagcagcatggtccagaccacgttgagcacatttgatcctaacgtatataggtccgataaagggaagcagcatggtcgacgatgtgccagactctaaaaaaaacctagttggcaagttgaattcttttatcttctctaccccgg

SEQ ID NO: 44011 - DNA, 1501 bp, Oryza sativa
acggctttaccttttgtatagcatgattcattatggggtgccagactgtgaagcggcgagaagtccgtgggggtcgctggggagtccattgcctctggttatgagggggagattatgatccaggaacggtgcactgtggtgagttgtgttgtgtgagaggtattgtcacagttcgtttccaaggtaccgtggtggtactgaggcgcatggtgacatgtggagttgtgtcttgtgggtacagtggtacatctctgatcagagtaaaactattcgaatagccgtgcccgcggttatgggtgggtctaacaatgtttttcgtaccaccataaatgaaaatactatgataactaaattgactcctggtttggaatggtatattcctggtttggaggtttgatttgtacaaccaggggttggttgttcagataaggttgggcctatgcaacatgggtgtgttgtatagtgtttatttaatattgcttaattacttaactgttttgctattctctcaaatgtttattaaatgttgtttatgcgaatgagcttaattatgccatcctttgttatcctgtgcatttgcatatttgctgtgtggcttgttgagtatgtcatatgctcattcttgcaatattcattctttagaggaggagtgcttcagtgaaggtgatgatcaggaggattaggctttgttcaggtcgagttgcttgtgaagtggagtcgccatagatgtttagtcttttgctttttttccgcggcgtagaactttattctttgagaggaactatccacctctgtaataatttactttgcgcatattaattagttatttgatagtactctattatcaatttgttattatgtgcctcggctgattcctagacgagggtttaacgcacatgtaagcgtttggaattttggatagaaattccggacgtgacaagttggtatcagagccaccttgaccttaggacaagccaaatggtaaaccttaagttgccttctaattattttggaaaatagaactgcccttctctattctcttataaattaattaagttggcagcacatgcaaggttatgtacaaaatttattaaattctactttaccaaaacagaaatttgttcttttattttgaaagaaaaaaaactttactgttcagggtattaaatagtttaattttctgaatttcattggttagtcggcactgtacatctattatggtatcgattcaatcaagatggcatcagtactactcatccctgttaatggtgacactgtaccgtgctcctggtagatcctaaatattttagttttaatttattcatttgtgtaaagttatttgtctctgttcaaggttgatttatgttccaaaaagaaaaaaaattgagtcatgtttgttccttttcttttattttctttttctttgggtccaatttaattaagtctagtttgtgcagctaacttaaaaatatgcattaattccttcctttccatgttgctt

SEQ ID NO: 44012 - DNA, 1501 bp, Oryza sativa; identical to SEQ ID NO: 43825

SEQ ID NO: 44013 - DNA, 1501 bp, Oryza sativa
gccggcggaggccgaccggcacggctgcgtcgagcggtgcacgatgcacgacacgctgcggtccatggcgcaggtgctctcccatggcgagaacctcaccggcgatgcgcaggcgcagcggctgcccagcgacggcgacgcccccttcgcgccacggcacgtctcgtttccgaggaaccaccttgctgcaataccagaggaggttctgaagcttgagggtgtaagaacgctgctgctccagagaaatccactgacaattgggagcaacatctttacaaggctgctatacctgaaagtcttggaccttactgaaactgcaatggaggtcattccagagactttggggaatctgttatacctgaggttcttgaacctgtcccagacaaggatcaaggcgcttccagaaaccatttgcaatctgtggagcctcaaattcttgctgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttcaccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattgtggacatggagagccttgaggctgttgagaacattgctgcactgagggaactgagtgtttggaacacccccaatctgaagaaaatatgcaacttgccttccctcgaagatcttgacatatgccattgtccgtcgctggagactgtggacaacatcaacaggctgcaagaggtgcacatcttcgatcatgaattgcaggagatgccgagatggatccaggcacat

SEQ ID NO: 44014 - DNA, 1501 bp, Oryza sativa
gcaggtgctctcccatggcgagaacctcaccggcgatgcgcaggcgcagcggctgcccagcgacggcgacgcccccttcgcgccacggcacgtctcgtttccgaggaaccaccttgctgcaataccagaggaggttctgaagcttgagggtgtaagaacgctgctgctccagagaaatccactgacaattgggagcaacatctttacaaggctgctatacctgaaagtcttggaccttactgaaactgcaatggaggtcattccagagactttggggaatctgttatacctgaggttcttgaacctgtcccagacaaggatcaaggcgcttccagaaaccatttgcaatctgtggagcctcaaattcttgctgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttcaccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattgtggacatggagagccttgaggctgttgagaacattgctgcactgagggaactgagtgtttggaacacccccaatctgaagaaaatatgcaacttgccttccctcgaagatcttgacatatgccattgtccgtcgctggagactgtggacaacatcaacaggctgcaagaggtgcacatcttcgatcatgaattgcaggagatgccgagatggatccaggcacatgcatcgaagctctgctcactggaattcatgagcacaactgaactgttgaagaggtgcttgattgatggt

SEQ ID NO: 44015 - DNA, 365 bp, Oryza sativa
ttgtgaaaaactctaatatatgaatgatagttttaaaaatatattaaatttaatacttttaaaaatttttccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 44016 - DNA, 151 bp, Oryza sativa
atatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctc

SEQ ID NO: 44017 - DNA, 654 bp, Oryza sativa
tgtagttacatatatatatatatatatatatgactattcaccaatatttaaatccgtgtctaaattttgcgcgcatgcacgtacattttctatagactctaataacaatctccgtaaggaaagaaacattgtgtttggtgtacacgtcgtctttcattaaaaaataattttgaagacaaaaggttgaaaataaacctgcactactaattttaatttaaatgaaaaaaaagaatcttctcatgagccatgcatgatccctctttattttttcaataaaataaaataaagatccatgagccactccaccttagctcctataaagactccccccctctcccctcccctttcctctaaaccccttccaataatccctcaccaacccatacccccacactccctctcacactccactctagctagctaagctaccttcttactccatttgagcaaaccaaagctcatctagagagagagagagagatctagagagagaaaccagcaaccactcttcctccatctccatgagcaagagaccagatcgttcgttctagattgttctagctagatagcttcatcgtcaaccttggcaacgccaagaaaattaaccagcaagaacacaagaagcggcggcggcggcgatggaggtggcgacga

SEQ ID NO: 44018 - DNA, 747 bp, Oryza sativa
cgctagattttcttttctgctgcagttttcttcgtggtgaggactaagtgcctcatatgtaagtatttaatcactttagttattatgatgaatctatatattataaattgtcagtttgtatacctcgggtgattcctggacgaggatttttaatacacaaattagtttggaaattacttgtgaattttcgggcgtgacacacatgcattatgatcaaaccttgactaaccatttgcatttcctttcttcttcaggactgcaaagaccctgagaaacgaggcacagattgattgcacaagaggtgtgagtagggagcaaagagccataaacagaaggaacaaacttgattcctcattgctttcaagtaggggtgatgacaagaaagacaagccaagccgcggcttaaaaaatatgagaaaatgtgcgtcattgattttgaattttttggttcttgtttttctggtacatgttgctctaataaaacactcatagttgtgtatacatcatgttcgttaatcagatcaagagattcggaaggcagtggctaattattacaacaatctgtgtgctatagaggaggaacgattcgacaaagatcttcgtgatcgagaagtttcgagcattgcttttgaagagaaatcatttggccatgttgtcaatcccggtcaacaaacttatcgaatcagtgctaatgttgatgtagatttgtctaccattgttgtctcccttgctttgtttgatggtgag

SEQ ID NO: 44019 - DNA, 391 bp, Oryza sativa
agtcacttagacatcttaatcttgtacacattcacacacaatgcagtaattacttgttgctgtcgtaattcacacattctcaacaaagttaaatgatgctgtgatagggacagatgtgcaatgttggtccttggtttctgaccttacgctgttggatgttccttctatgtttttttgcagaatataggatttgggaagaggagattgagaagtggcaaaaccccatactcaagaatgaaaaacttccagaatggtacaaccttagttctatatttctttctgaactgatgtgttctacttcttcagtaaagaactttggcagtaaacatctaaatctcccaaagaaaaacaaaatcttaactagaatatttggggtttcatggtgcttgca

SEQ ID NO: 44020 - DNA, 1385 bp, Oryza sativa
tacgttgtatacttaaacatgagacatcgtacactctggcgatctaaaaattaattactagtgacagtgctggtcaacagtgacgaggattatttgggaattaaggatggtataaaaataccattgtattctctatttgcagctgaaaaaaatcacaaaagtacaatgcatttgattctcaatttacaaactgaaaaaaaaatcaaaatgaaaaaaataccgggatcatcataaattcgctgcaccgctggatcgatcgttcttgattgatccaacggccggtacacgtgtggggatggtttgaagtacatggttaatgttgtgcaggtagctcaagaaagccttgagttgggtttacctgtcagtaaaaatggtccctacaaacaagtgatcatcagtaatttctagcgatgcttttgtctactgtgcatcatgttctctggtcacacgccattcaatcggtccgagctactaccacgatcagatcgaagagttattgcatgcgtttcctttttcttttatttgtcatgggtttttattttttcttttctgattatatatatagaataacacaacaaatatatagtaccaattatatgcatgcactttatatgctcacaagtacacaaccatggttagtcagtgatacagctgtttagataatggagctagttagtactactgcttaattaagttaggtctctttctgttacctttctattttttgtgcagaaaaaagaaaagagctcctgaccaattttagctatcacttcccccaaaaaagcgcagtactgaaattaattaccagtggtggttaggaaattaattaagaaactgtgtgaaagtaggaataaaatgaagaaaggagccgaggtaaaaaaaagagtacacaccaaattaattagatgtttacaaacattttacaaattaatcacaattctcaaataaaagggagttatcccaactatccttattaaatctacttcatatggtgcatattagtaaactataaagatgcttgtgcatgtactattatcatttatcatacagcatgctacccttattaaatctactacaagtagtgcatattagtatactataaggatgtacatgcatgtaccattaccatttaggcattgtttagttccaaactttttcttcaaacttccaacttttccatcacatcaaaactttcctacacacataaactttcaacttttccatcacatcgttccaatttcaaccaaacttccaatttttgacgtgaactaaacacacccttattagaaggcacgaattttggtccattatatatatatacatatagagagatattcgttttgaaaatatcgtattagactgtttccgatcgtcaaaatattaag

SEQ ID NO: 44021 - DNA, 263 bp, Oryza sativa
aagctttggagaagatgtcttaggtggagtcctggcttataccccagttgagcgcctgtgaagatggagccgtaggcccggtagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgagcgggaaaaggcaattttcccggtcgcgacagg

SEQ ID NO: 44022 - DNA, 1501 bp, Oryza sativa
cggccgtgttgtcagaaacaccagtcggcagcggcaaaggcaagccggtcggtgaagacgtagacatctagcaacggtagcataataggccagccgtgttggcagagacaccagtcgtcggcggcaaaggcaagccggtcggtgaagacatggacgcccatgaacggtggtgtgaccaaccaaccgtataggcgaggacaccagtcggcggcgacggaggcaggccgtggtgaagtcgtagatgcccaataacgacggcataataggccagctgcgtaggcagagacaccagtcgacggcggcgaaggcaagccagcggtgaagatgtagacgcccaacaacggcggcataataggccaaccgtgcaggtagaaacaccagtcgacggtggcaaaggcaagccggtcggtgaagacgaggacgcccatgaacggtggtgtgaccaaccaaccgtataggcgaggacaccagtcggcggcgacggaggtaggccggtagtgaagtcatagacgcccaacaacggcagcataataggccaaccgtggaggcagaaacaccagtccgcagcggcgaaggccagccggcggtgaagatttagacgcccaacaatgatggtgtgaccaaccaactgtgtaggcgggtagaccagtcggcggcgacggaggcaattggcgcgggtacatttacctgtagctcgaaccctagatacatccacgcatcacccgaccaatccatgctcatgcaatctagttgtgaaaacgtgtccttttatgaatcggactcaaccgttcatgagacttgtattttcggcgacggcgacaaagtccgaactaattgtagcatgtattatctgcacagcttgacctgatctggttgaaaaattgcttgtgcttgatgaagtgctcctgcttgcatgcatgtgcatgtatacgcatggatccaaccagatttaattaaattaatgtggttcttgctggtatgtacagcgacatgcaaagccagtcaaacattcacgtccaagataggaactgaattgctgacggctgaattgcactgtataaccgtcgtgtgggacttggcttgatagtgatcagattccgatgacagggcatgtatctgattaatgatcttgaataggtgatgtcgaaaatcaaattgaatccgagatgaatagaacttgagcatagtccttccggcgtgttcgcccagcatctcgaccgatgtctctttggtagattgatttttgatcagaagatggtgtcgacggcggcagaatccatgaaactcaaagcgaggatgatgccggcgactcaggatgattccatcacacttcttgacagaaaaactcgacgcacacctacctggcgcgccaactgtcaaaacatgaattcggcaataataaaaggggtagcgcacgagacctaaaagtggatggatgcggagacaaaagatttagacaggttcaggccctctcaatgagaggtaataccctactcctgtt

SEQ ID NO: 44023 - DNA, 1501 bp, Oryza sativa
gatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtatattcctggtttggagatagaactgtgcagccggggtggttgttcagaatggttgggcctatacaacagggtatgttgtatagcgttggattaatattgtttaattatatacttaactgttttgttaaattttcaaatgtttgctaaaagctgcttttgcaaatggaaccctattaagccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaataataaagatgtgctttttggtatcatgtttgtgtggtgtaccccggcttttcctgggacggggactaatacactagcgttcgggaaaatgcaaattttctcggtcgcgacaatgcttttgatttattccgagtaatacttagcaccttgtgttactcggtccatccaacgagcccccgggtgcttggaatcaacccaaaggcaactatccattgacaaacccaacggaaagcataggaagatagaacttcataactcgataggcactttactgttactggattatttc

SEQ ID NO: 44024 - DNA, 1501 bp, Oryza sativa
cgacttccggtcgctcgcccggctcgtcgtctggctgcgctgccaccgtcgtgggcatcgctgcggcgtgtcccacgccgtcctcacctccgtgcagctgctgccggctgccctcgtcgcctcctcgccagccccagtcgtcgtcgtcgtcgtcctctcgtcgttcccggtcgttgtggcattcgtccctccgtcagccgtcctcgtccgtcctcggtgtttcgtcaaggtcgctgcagcccccgtcgtcgtcttcgtcctcggctccgcgtcgtcaagcctcgtgccggccgcgtctcgccttcgtccaaggatcgccgctgaagtcgttccctcgccgtccgtctccgccgcgcccgttcgtcgttgtcgtcccctcgcctcgtcgcgtggtggtaaggatctctcctctcgctgccccgtcctcgtcctttcggtgtcgcccgtgcccgttgtgcggttgtcggccccggtatccgtgtatcggtatcggtagtcgttcgcttgtccgtgtagtgtccgtgttagtgtgcccgcttggtagccgcgttgtttccacgtgtgaaacccgtgtggtgtctagtagagtccgtttgtcggccactcgcctcggttgacacacggggtccgcttccgtcgacccgtggaccgtctctgtgtacccggtctaccgcggtcctttaggttgacatgtggggtccgcatgtcaacagcgcagccttcctgtcttttccaggctagcgcttccacatgttttatagtcgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccagaggttcccgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatctagccatgcctatttacctttgttatgaccttatcattgttgttattgttattattaccttgttcaccctagaataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 44025 - DNA, 390 bp, Oryza sativa
ctttgagtgtgctgggccgttgttgcccgtgtaataattttatatacgcttccgcttgttaaactctgtattgtatcaacttttggtgtaccttgcctcctgggacaaggaataatacacgcacgtcgggagcgcctgttgggtgatttccggtcgtgacagcatggttatccgactggttataggggataacttatatctatgaaatatgtaacggatcatgacttgggtattacgttttcttgtatattatggaacggcctaaagtcctggtttgataagattgtaaagtagatttaggaaaccaataccgtattggttaaggtttctatcttgtaatcctaccccccatcttatataaggtgggcaggaggcactctagggggcaca

SEQ ID NO: 44026 - DNA, 164 bp, Oryza sativa
ctcaacggcacccgctgattacgcacgagcgttgcaagaattttctgccgtcagtatggtgattcccggccaggcaccgccacgtgtcagtttcctttccaccgggcaccgccaattgtcagttgcctacccccacacaacacacacaaatcccactccccagc

SEQ ID NO: 44027 - DNA, 1501 bp, Oryza sativa
aatcttgggtattcatttgaatacccttgaattgagctgggcccgcccattcactgatcaattcctgaacaatgcatacaactagctaccattaaaagcaaaagtttatctctatgagccgttagttcaaacacgttgatgcagcaacactcctttcgttttctttctgccccaagaattaatcaaacatcatgtcaatatattggttttagtataacatgaataggcatatgtgtgccacatgcacatgaatgagtgaaagagtgttgtaattgattctttttaacaactactcactctgtttctaataaatgacaccgttgacttttaacatacatttgattagttgtcatacttcaaatatttagctaaatatattatattttattgtaacttggtttattattaaagaaacttgaagcattacttatatcttttatatattcatactgaatattttaaataacacaaatggtctactgttatgataaaaatcaataatgtcatatatattagaaaagaaaaggaaagagtactagtttagtgggagaagccaatgggtattctctaatttgtgctattatgtaaaactaaaccatttaaacctctctccttttcatcaatttccattatttttttaaaaaataatgtaaagctcctttcagaaaggagatttggaaggagagacgtcgcttcaaacattttctaagaaaaaaatataagtgtgttaggaattgaacacgaaactttggagttaaccacacagccttactaccatggttattaagaccagaccggtgattgaacggttagggcacttggttcactggtctgtaggtgggaccggtcaaaccaccggtttaaaattgtttaaataaatgtgtgttacaatactacatcaacaggctatggattagtgttttcacgggaacatggaggtcttgggttcgatccctcgaggcagcggttttctccttattttctctaacctcacgtgatggctgtagtttctgctcctcgccccctcagcggtcgaaccacctccgggtttttgtgcggttcggcaaaaaaaccgcctgctgaccgatcttttagctaggccgaaccggccaacgtcctggttcaggtttttttctaggcaacccgccggtccggttctaataaatatgcttactactgcacttgatagtgcatattgtaaaggaaaaagtacgaattacaccccccctcaaactatcacggtcgtccgaattacccccctgaaccacaaaaccggacattcttcacccccaactatgcaaaccggacgaattacccccgtcgacccaatccgcggtggttttggcctacgtggcgtacacgtggtaatccagtcagcattttattttatttttaatggtgggacccacaagtcagacccctctttctctcttcctccctctgtctttctctctcttcgtcggtcagcggcagcggcgctcacgccggcggccggcacgca

SEQ ID NO: 44028 - DNA, 1501 bp, Oryza sativa
cagagatcaatctgggaacagaacgggaatcggctagagtccggatcggctacagtcaggatcggtagagtttgagtcagacagggctagccgatacagccgatttcaagaatacgacttggtgtacatcatcgggttgagttattatgcttcaagatgattgccacgcatggatagagtcctgagaaagcaattgtatctattaattaggatattttatgtaatttcattagagatatgtttaggcaaaagtctaccgcaaagacttatagtatcttagggttgttagagacaatagtcatgtccggtatggacatatcttgtaattctcgggtataaatagaccctgagccctatgtaaaagaacacacacacgttcaatacaatttcggcgcatcgccaccctttttgcttttgttttatctcgacgagttattgctttcgggttgagctgcattggtttcgatcttcaacaagaggtaaaacttgttttgacggcttgtgttctcgaagattagtgcttccatctttatgatactctaatcttgtttatgtaatccgtcaagttatcatatatcttgcataatccttgacaatatcattatttaacctacaatcggctaacatctgctaccagaaagcaatcagttaggttaaataacgatgttggcttagattatatgagatatccaccactttatgaaacatccagcagcttgattgtctagatgttgttcttcttttcatacttaatgttgtatcagttgagtttgatctattaagtcgtgcttagaatttcaatctctagcctgcctactggttgccgattagggtagtatcggagtttcagccgatcttatctgatctaattgcttttgctctatatgctcaattaatatgttaaatctgccattcatattaagatcttgttgcatttaagtatattagatttctgtttagtatattctatttgctttaatatcttaatataaagtagtatcggagtattagccgatacatgctagatatatttgatcggctatgctatgaatatgtataatctcattattaatatatatttcaatctaagtgatttatattgtctcggcaaggtgaccgatgtatcccaatcacttgattcaagtatatgtcgatataaggattatatatcattgatatctacagccgatcgagcagatttagttctgatttgtttccttaacaattaccgatagatttacatatgacatcggctcaaagataaatgatatgtcatcggcatttagccgatcggctatcatttatggatttaatcacggtttctttgtctttgtttcttgttgattgcaggatcaaatcaactagcacgctcatacatccgaaggcgagttttggacctacactggagttaagcagatctcccaggcctcgtgttttccatcaacacgcttttggcacgcccggtgggactgatcagaagtcagaagaacagcttccttca

SEQ ID NO: 44029 - DNA, 212 bp, Oryza sativa
tttacatgacaaacatcattagagaggggcattttcgtccatggaaaattttttcgcgaacacaaatgagaccaatctagaaaggactagattgattttgaattaagaagggggtgaggctcaaacccggaccggctagctcgcagcttgtgttgctagtcgggaagaccccggacctttctccatgggaaaattcagtccatctccagcca

SEQ ID NO: 44030 - DNA, 162 bp, Oryza sativa
gtaagatattttctagtagataagtgatatacaaccattattagatgagcttgacttgcaaatagctaaattgaatttgttggtattgttagcttattgatctggtatatatttctcacaagtggatgaattatcattaaccttgcttacgttaccaacagt

SEQ ID NO: 44031 - DNA, 558 bp, Oryza sativa
cgcgagcgccgccggcacggcgggaccccacccggggcgggagagcttcccgtacggcgccgacacgaaccggagcaggaacacggtgatcgggctgatcaggtacaggatcaccaggcatcgcgcgtacagcgcgtcgtcgccgccgccgccgcccatggccgtggcttccgtgcgccgccgctctcggtgcgttacccacgattcgtggatgggagcgtccctggtgcaggagcagctacgccgcggccttcgcggctctggctagagacggtgatgatgctgtggcattggggcagatccgcaggtggcttctcatcggtgttgtatggaaggagttgatagaaaacgtgacggtaatggcacggttttaattttataaaatactagtggcatgactatgaatagacgaattgtattgtcatttttcttaataagcaaatttacaatgatccaattaacccttcttattatgtgcatctacatcttctacatgaaaggagaacaaagggcgtaattatatcatcatagttgctgactaaacctgtaccaagacct

SEQ ID NO: 44032 - DNA, 1501 bp, Oryza sativa
tatagtactatataaattttgattttcctaatttgtttagcgttgttttggtattgacactgaatagttaaattgatgaatatgctctattcccaaccggctgagaatcattttgaatatatgttgcaccgtttcattcctatttctatatgcatttgcctatgcctctttatcctcgctgccccatgaaagtccctacctctttcctaatccatactcgtcgttgcccatttctctacaccttcttgatttgcatgttctcctttgttccctcttcgtttgcaatgtctatagattgcagttgatttgtggacagtcgttgatgccattttgtttgcaccaagctgttgtcctccccacccagttctttcccaccatttctgcaccggtaaccacgacggggctcctatttgccgctgattatgacaccggattgagaaggggcacatggcattgtgttcgtcaatggtcatatggactacatgttacgttaacgagtccaacaacggccgggaataatgttgtatgtccagattcataatattataaaatatcttatttggttttagatttttatattttaggactaaggggagtagtatttgattgaatgtagagattcttgtaataggattctttgtttggtttgcttgtattcttaattcgccgagctagatttgtccgcttcacctggtgcttgctgcagagtgcagaccacctctgaatcaggttggttatctgtttctgcagatgctttgaccaaaggattgtgcacagtaattgacaagacatttaatcagttattagtcaatattggttatgaatggttcaacttcaatttttagtaatatgttgtagtagtcagatactcccttccctccgtccttaaaaaaacaaacttagaattgaatatatcatactccagtttatactagaacgtatctgaaaagatctatctaaatttagtaggatatgttacatcgagtcttaagttttttttttaaagaacggaggaaatagttctcatcgtgttgttttatttattatcctgcgggttaatgacttcagatagttctcctggtgctgtttttatcgtccaggtcttggtacaggtttagtcagcaactatgatgatataattacgccctttgttctcctttcatgtagaagatgtagatgcacataataagaagggttaattggatcattgtaaatttgcttattaagaaaaatgacaatacaattcgtctattcatagtcatgccactagtattttataaaattaaaaccgtgccattaccgtcacgttttctatcaactccttccatacaacaccgatgagaagccacctgcggatctgccccaatgccacagcatcatcaccgtctctagccagagccgcgaaggccgcggcgtagctgctcctgcaccagggacgctcccatccacgaatcgtgggtaacgcaccgagagcggcggcgcacggaagccacggccatgg

SEQ ID NO: 44033 - DNA, 171 bp, Oryza sativa
tatcgaaaatgtttggctaccgcgcgcccgacgaagagaagaaaatatcaggtgcatttcccaaccaccaccacctcgctcttatctccaaccgatgaccaaaccctcctccctcgcatggttgctctcctgacctgccgcgtggtcctcctcctccggtccaccatccaa

SEQ ID NO: 44034 - DNA, 1358 bp, Oryza sativa
tcaatgctcaatttcagccccagccaccagctgacaagacagaggccagtatctttttccccttttggggaccggggttttttttggggtttaaacccccttttttttgggaaaagttcccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaaacttagcaaccattctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggtttttagttcgctacttatcatggtgtactcgaaagtttgcagcaatcatgtaattcataaatataatcatgtctgtaaacagtgagcttgctatgtttagagatgattcatgttgaggatacaatgtaccgatgataagcaccttccctttttgtttaaggcagtgccttgtattcgtgtaataagggagaaatgtgtaatacagacaagttccctaagaggattcttttggaagatgcggatatgtgatcatgtgtataattgtttactgacaaaggagacctagggtctcgtgtcagaggaactatatactaacctcgagttaataaccaacctgtggatagaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcg

SEQ ID NO: 44035 - DNA, 1501 bp, Oryza sativa
gagggagatgacaggtgggccccacccgtcggcgagagtggcgggcgggcccgcctgtcagcggcgcgcgcgcgcgggggagaccgatgggccgcgggggaagagagagagagagggactgggccgagccggcccaagaaggaaggggggggaaaagaggacttcttttagggtttttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagcgaatgatttttatttcgggatgaatttatcaggacgtgacaacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgagaatatcccaaagtctagagttgtaaaaccgcctaatgttacctaattaaattgcgaagcatctacctaaaattaaactagtggtgccatgagtagagtgtccactagttgaggttttgtttgctctagggtgaacaagggaataataataacaatacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaatctcatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcct

SEQ ID NO: 44036 - DNA, 1501 bp, Oryza sativa
ccagatgaggagttcctggaagatgaaggctttggtgtctagctcgtgcctgccgtcaagcgcctgtggtcgtcgccctagtcttccgctgtttttcgttgtctttgagtgtgctgggccgttgttgcccgtgtaataattttatatacgcttccgcttgttaaactctgtattgtatcaacttttggtgtaccttgcctcctgggacaaggaataatacacgcacgtcgggagcgcctgttgggtgatttccggtcgtgacaagttggtatcaaagcctcccttgaccctaggacgagccgtagatcccaagccttagcaatattttcaaaaataaaaatcctttattatttgtgaaaacccgctattctctctttgtcttgctgcttcacttatcatcaaaatctggcctttaaaatgttgcttttcttttgtttttgtttgtagatggccggcagcgtcacccgtcgtggtttggacatgattggcttcgtcttggagctgcggggcatgtgcgtggtcttggggtatccacatggagtggattaccaggccaggccgctcccggagcaggagggtgaggatgcagagcctcacgctggttgggaggtcactgtagtgatcctctccggctctcccgagcggacttcgctggcagtcaccgcgggcggagactccttccccgccgcttgccaaaacgccgctctcctcgccatcggcacccttcaccagcgctacccggacgagttgcagcactcgccctaccgctaccaccctcgtcgcggaggagcccgcgacttcgccaccttccgagatgctagctcggaggatgacgccaccgtcgtgcatctggcacgcatggtggaggcatacgacgcagctcgtattgacttccatcagatggtgcgtcgtggcatggtggagaacaacatgaagatcctggagctgcggcaggagaacctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtaactatgtcggagcctgtctttatttgtttgcctaagcaacttgaacattaatgaaccaacttaatagcagtgataaatttaagaataatggtagtcgtgggtggttagttttaattgttagctccttctctgtttgctggttctgtgtggggttttc

SEQ ID NO: 44037 - DNA, 1075 bp, Oryza sativa
tgactttagcttcagcttctctcaggatatcagtcccgaacacttggctttctccagcttggtcccacaagagtggtgtccggcatttgcgcccatacagcgcttcataaggtgccatttgtatgctggcttgataactgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgaccctagcgaagtagagctccgctagtttattccctccataggtggtcttcacaggaatgaatcgagctaccttggttaatcgatccactattacccatatagaatcatatccaccttgggtttttggaaggccggggatgaaatccatcccaatttcatcccatttccattccggcacttggagaggctggagaagtccagccggtcgctggtgctctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaacatccacgaccaactatgtttaggttcagggcttccatctgttgattaagctcgggtggaatgcctcggacgttgagagtattgcaatggctcttccgacttagagcgtcggcaaccacgtt

SEQ ID NO: 44038 - DNA, 335 bp, Oryza sativa
  unsure (1)..(335): unsure at all n locations
gcttgnntttgtgaatgactangcnnnnnnnnnnnnnnnnnnnnnnnnnnnnnnnnnnnnnnnnnnnnnntgctcaaggaatgtaaggactgagaaaaaaaaaacaaatttttcatttccagccttataataactgcacataaatggtatggaagtgatgaagtcatctnnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaaga

SEQ ID NO: 44039 - DNA, 267 bp, Oryza sativa
ccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgacca

SEQ ID NO: 44040 - DNA, 468 bp, Oryza sativa
  unsure (1)..(468): unsure at all n locations
gcctggananattgatgacggtccttnnnnnnnnnnnnnnnnnnnnnnnnnnnnnnnnnnnnnnncatctggcaagttaattccagcattaacgtgttctaaaagccactctacttatgagaagccgggccaccacatttatacattacagccagaaacaacaaatccaggaagttaatacgtgattaagaatgcatcaaacaagcagcaggaatgccactatttagatcaccaagtcgaaaaaacaagcattttgaaaagcgttccaaatccaatgagggatcaaatcagccgtatcttagagtggaaagaacatatgcttaacgagaatccatcatcacagattagattaaggaaaggtctctagtagtccactgcctcaacttttgctcatgtgccccctgtgcccatcctcacaagaaaaaagtaaagttagaaacaaaattgaagctttgctttcaacaggca

SEQ ID NO: 44041 - DNA, 458 bp, Oryza sativa
cccgttgagtagagtgacgggaaaagagaaaaacactctaacaaacgagttgcaaaagagaggcaggatccttagatggttgagggaagtataatatcggtaagtcagaatgagtgaacatattttcaaaaaaaaaaaatcgaagtaaaaaagacaacatattccacaaaagggattcaaatattgcatcttaaatcttaatctcatagttcttcgattaaatttctcactaatcttgataatagttcttggtgctcaactgagtgaaatgagaaccatacaaagctaaaccttctgtatttaaactaataaagaactatattaccaccaaagaatattcacaagaaattagagaaataaaagttgcaaaactcatctatgtttgggggcgagtttggtaatcattcaaatagtcttatgtattgagaagaatatttcaataactattaatgtacaga

SEQ ID NO: 44042 - DNA, 1142 bp, Oryza sativa
agtacattagtacgatctagaagtgtagttctccaatacacttgtacgttgagttgagagacttacatcctctgcgttaaccctgtacctcccattaacccggaggaatttgcttgcgtagtacccgtagatgatagtgcccttaggttgcttgtgacacttcatgagatagaagaaagtagttaaattttgaaatgagtaaaactattgaaatgcattaagtgagttagtattacgtaccggccaatacatatatactagaagcttctcccttgtttttgtttgttctccacccctgaacttgtagtagttatacgcactgtatggaattttttaccgtttcgcattaaggaccgttatttaattataatacattaatagtaggcatgcaagtatgagaatcacttactattgtaagatttgtagaaattatttatatgtcttgtgagaataatcaagggggtccaagactgtcactatgccggtcttcgggtagataatgaaacatatgtaatgatcgctacataatggcgatgcagttagtcacatatgaaataacacaggtatgtacaatgaaatatacttgacttacttgaagttgtacgcaaccatgatgactcttattttggaagtgcaagaaagctcgtccaatatactgtacgacaataatcatcttctacttgtgcaagctcttcttgtattccgctatctctgtaggagtcttgtccttgagctgctcggagtttggtgatagtctcacggtatgctgagtttgacagatccttgttagatccagaaatccgataggtttccctaaattctcagcatccatgttttgcatactataatagcaatttgttaataattgatcacatacttattcatgcaataaataaacactcatactcacaagcaccatgcaacaacgtagtttacatccatcttttctcgacgatggatggcgtgcagatcattgaaatcaagccaaatgaatccttcacaggctaaagtttttgccagtgatcgaattgttagattagttaggcctttcttgctggcttccatgtaccatttatgtagccttatctcccatggagcctcatcaagtgcataatctggcagaaaagcttttgtcgacgagt

SEQ ID NO: 44043 - DNA, 1501 bp, Oryza sativa
gggatggcacgatttaggcctaggattcttttttctgttttggagtataagtagatttccatttttgtagtttacagataagttcaatgagaaaaccccagaaaatcgccacacaaagctagtgcgtttcgttgtttctctgaaactctccatttcttgttactctctgttcttctcgtttgcttgccggatttaacacagtgctgttcaatactggttcttctccaacaatgacgtgctccagcaacatcacatatgaattcacggcgcggtagttgagctcgatcattacatccacatggcaatgaggaatttcttctgccctttttcttctttttttctgtcaagtgcaaccattgtgccgaagctggtgccggcgttgaagctggtaccggcggagttccagcgcaagcacagcactggtgggtggctgctcaacctgctcacttgtagtggtggttcttcctacccatgagtggagagagaggagaaagagggggagctagaggtagaagaaacagtccaaactgaaacaaccggtaaagataggtggtttaaagtgaaaaaaaattgtttacccctggtccaaattgcaacattggcaaaaaagagtgccccaagatgtaatttactcttattcagttcattttcaaacaaaaagaaaaccccccaatgtgaaggtgttgtttagtttgacaccttatcaaatttgcaagctcttgtagctgagaagaaaataaatgaaaaaaaaatcaaatacaacttgggatttgatgatagcacttgaatacaaatgttttgttaccaacatacctttgatgtttttatttgccctgttctctcccttgtggttcttatcaagccagtttctttgatgccttgtgcgtctcgtgcgaacgtcctttttctttaagcgtgcatcacttagcatttcaatctgctgagcatcctctaggttaggacttcaccagaattttctaggattacttatgtgggaaatccattttttcttcaatttcctttttaaggatgttcagtgcattatcaactagcaaacaacattctggaaaactggccgcttgatgcgccaaagtgagaaatttatgagatagggatttgtagtgaagcatagcttccaactttggattttcgattatgtcgttcctgggtgtcccttatagttacatggcgtgcatcccatgtccatcgcttcaatatgtaatgtgttggcaatatgatctcttctttcaggatgccagggaatggtgcgatcgctggcaatctgttggatgggcaattggctcattgtgtgcaggcgcaggagtggttggtgggattgccgcgaggtacataaggcatgatgtcgaggcatatgttgatgggaagatagcgcaggtcgtatcaaaaaatgatgagttccgtgtggctgcgacaaaaactcattacgactttcaacagaagatcagtgacctctttctggagtatcaaagggagttaaaca

SEQ ID NO: 44044 - DNA, 1501 bp, Oryza sativa
ggctgaggcacggtggtgagcggcggagcgcgggctcgcacaggagagggcgcgaggacctcgggggaggagggggaaacagaagaggcacagcacggggtggctttttatagcgcgagggagcaacggggagccggggagcggcgaatttggggcggcaacagccggcgacgtggagctcaacgtgagcggagtgggggctcgatttggcgccaaaaattggggaaaagtgggggatttggtggagggggtggaggggaactgatcccacgtggtttgggcgcaagggcgcgagcgggagaggccagaatcgggggcgacatgggcggcaatggcagtttcggctggggagctagaggttgggggaggaaccgacatgtgggccccgactgtcggtggcttggggagaggaaggagccaagggggaggcattgcagacttgagggagagggagccgagcgggccaagggaggggaggcctgcccgagagggagagaatggccggcccgagaagggaaagaaaattttaattctcccattatttcacttgatcaaattgctttaacttttatttaatttctagaaaatgcattatgtaatgatttttaatcctgaacgaaaatcgggacgttacacccggctagcgagctcgacgggcttgatgcatctagccatgcgcttcagcaaagggatcaaggaagctagggatagagatatacagagaggggagggagagtatgacaggtgggccctaccgattttttaataaaaaaatgctgactggattaccacgtaggaccaaaaccacaccagactgagttaggaggattatttgttcggtttcaatagttgagtgtgtaaaatatctggtatttaagtgtagagggataattcggtcaaccacgatagatcaaggggtaattcgtacttttttcctagaaataattacattatgactgagttgaaataagaactatgtagagtaaattcacaagcaaagtgcagagaaaatttttaagtaaatgcatttatgaaagtaaattcaataaagtataaaagtaatttacataaatcataaaaacaacttagcacaaaatggaagtaagttgttacacattagaggtaaattcgttgtagggagaaaaatatggtatatctaaaaattaaatttagagtccacaaattatataattgactaaaaataataataagcataatcaacttagagcattataaatgtataagaagtaatttaatcaaatcttaaattaatttatatatatggtaaaagtaacttaaaaatataataaaatttatttacaaatataaatatattttcatcataatttgatcatgtaatatcttgttacaaacttaatagtgtaatcgaattgtagattggatatgtaatttaagagaaaattttatagaaagaaaaaaaaaagacatgcatgcctaataaaaaaaaggcatgcacgtgtattagtactcctctcacata

SEQ ID NO: 44045 - DNA, 277 bp, Oryza sativa
ttcctcgtgttgcgccctaaaaatcgcctaaattaataatgcatattttaaatcatttttagaaattattttaaaagcctacaagctaaactctaataatctagcaaaattttcaacataaaattgagctagataaaattttataaatactttgcttgttcctctattttctagatttttctgggaattatttgagcaagggaagtatttttaataaatgaaacaacatttcacaaattaatttaatttaaaaagtataaaaaatcctcccctaagt

SEQ ID NO: 44046 - DNA, 443 bp, Oryza sativa
ctgcagcccccctggccgcgagcactccctctccagcctcctcatcgccctccccgccagcgccgcgcatgccggctgcctcagcctcacctggcagtagcagaatggcacgtcgcatgctgccgtcgtaccgttcgctcccacctgcgacgttggcggcagcggcggcgacgcacccaccggagcagagcgcgctccgccacgccgacgcactcctccgcgtcatcgggaagcaccggcaagtccaccgcaccgcaagccgcagaacatcaacgtcgccgtcgccgtcgacagccagtggctcaatggcgggcaggtcctggcgctggacgagcggtggtacgagatcggcgggtcgttccgcgtcgagtccaagccggcgtcgcgcgtgatgctgtacgtcatccaggtgcgcaagcgcgatgtggtggtgaaggtgaagg

SEQ ID NO: 44047 - DNA, 617 bp, Oryza sativa
gtattcgcttgaacatcaactgcagtagcttgggcatcaatggcaccctttgctctcttccttcctacatttgtttttgtcttcttgtttctcttcctgcaaaacattggttaggttaagcaatacattgtacaatagctaaaagaaagtaaatcatagctgaactaacctcttcctagttccagtcagttcacatcttacactacctttcctatatccaaactgttggcagtctggacattgaacttgccttgtggcctttcctttgcccttttcaagagcagatgggatcctattctttctctgcctacccattcctctcttcttgggcacaggtggcaggagcttgaaacctttgtcaacttttggccactgcttcttgtctgtgatgttagggataacacaggaaatttaactatttgccacttttacgtttgccaattgtcaaataccccttttaggtttgcacttaactatatgccactggagagagaagattaatgtgtattcagtggcagctcataatgtgtattcagtggcagctcataaaattttttgaatccgccactaatcttaggtcacatgcaatgctaatctgttatccttttcgtttcagt

SEQ ID NO: 44048 - DNA, 716 bp, Oryza sativa
tttagcatctagaattaacaaataggaaaaattggtaaagtttggggctctgccggtttcctccagagagggccggtctgaccgccatatgtgggccggtcagatctctgccagagggccggtcaaacaggcggcatgtggtcggtctgactggcagagtccgagtcaaactccgttttcgtcaggtctcgggtttccttgctcgggaaggcaggtttcgggtttctattggtttctagtctgagttggacgtggagaagggcatgtagagggtaagatcaacccctatataagggacaaggccggttcaattgtaatctatccaacaacacacaacctacttgaatcgctttttcatatttcttttactttttagccatgctttctactttattttagttttagtccatctttatctattttcatcgtaaatcgttcgccgtcaccgcgagagtgcgattatttctttgtaggtttgtcccgtaaaccttccgttcacccacgcgacgggtagttatcctcatatcaatctaaatcggcctagaggctggttttgatatctaaatcggctccgctagctggtttagctgtttttctacaaaatccatcttgatttgaccatttggctagattggggtgattgacaactccatattaccgcaaggcgtttagatgtcccgatcgtgattgttttcttaccaaagaagttgctaaca

SEQ ID NO: 44049 - DNA, 1501 bp, Oryza sativa
tgtggcaggaggggaggcaacgggctctcgccgctggcgcctgcccggcggaggcggtagcggcggcggcggcggcggccgcgccctcgatgggcggcgggttcccgtaggcggcagtgtcactttctccatgtttctcctcgtcgtgctcagatgctctcgatggatccatcgccttcctccttctgctacttccttcctttcgttctttcctctcggttttctctcctctcctccgccactcagcgacgccctccttctccgccgatccccctcctcgaccacccaccgacggcgcctctccctctcctcagctccccttcctcgtccccccaccgagtccgccggcacggatccaattcccccgagctcactggcgatggatcggccttcgccgttgggtggcagtcgtcatcgtaggatcgagctgccacgatggtccagttcggtgccgagcggattggggcggtctcgttctttaggcggagggagcggtcggagacgaggaggccgattgagtagtggatgccggatccggtgggtttttcttgtctcgtgatgtcccccatgatcactatttggtctgattggtatttgttttgttggatgtctcaggatatggtgcagtggacgaatctggaggtcgagttgtacaagcagagctgttcggtcgtccggataggagggttcaagttgtcggacgaaggtggacctctatggattttccaacgaggatgctgctgtggccgccggatccagtgacaattgacccccccgcagtagaggtgcttgaactggtgagttttcttaagttgatttgagttttcactattttttgtcagaataattagatcagaccctagtttatttgatttgtttggtttgagtggatcaaccaaggtaggtggagtagtgtaacaatattgattaaaaacttgtcctgttactctatattggttgaatgccgatgctttcatgtgatattttttgttgaaataggaaacaatggcatttcagcacatagagacaaatacatcttaactaatcatagatgagattcacatctgtaattttcatcagtttcaggacacatgcagtatttgacactgtctaattctgtatcttccaactgacaccaaaattttttttgcaggtcacaaatctaggttcactaaacccaaaggcttttgtagcaatgggatgcctggtgctagtggttacttgggcagcaatgggggtgatggtgggtatggcagtacaccaggagcccaggaagaaaatatatggtcaataggtaagatatatggtaagttcaattcccacaccacctctaatcgctgcgcaatattgctggttatagattgattggtttatgactggtactatatcaaatatattactgtctttgatatgttatctctgtaggaatcagattactgtcatggttcttatattgtgcacttccacttactgcaagcttaagcttgtatcctgtatattt

SEQ ID NO: 44050 - DNA, 250 bp, Oryza sativa
gacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactaga

SEQ ID NO: 44051 - DNA, 228 bp, Oryza sativa
tgctttcaacataaaggcctcatggattcttttttttaaatctctgaatgtataaagttggcatttctcttactcatacagtatttagtctaatatatcaatatatatgttatatctttccaaagctgtaagaacataccagttgcagtagcattggaatgccattttccccttcttttatggatcatgtatatttatttcgccgctgtgtgcattctaactggcagg

SEQ ID NO: 44052 - DNA, 1249 bp, Oryza sativa
caaggtatgttttcccccttaatgttttattctggctgcttatttgttgtaatgtttgtttaatctattttccccataaactaagatcgttattatgatcatttccttgctgggtggttaggatacagagcagcttttgaactacattggagctgagagctctggaaggcgcgtatttgataatctgcaagagcttattaggatcatacaatcggatgagtatgtatacagttgatctattctgcggtaactgtattcttggagtctttgcgatgtagagatggtgttcatacacatgtaaaaatagggtttctttgtgttcttttattgtgattcttgccttctttcggtgtgccgagtttttgtatgcacaggaaagaggtgcattgggtgtttttttgctagatgaaaatgaatgaaatgatatttacatatgtggtatgagcctctagaagcacacactttttaagtttcttcatggtagcacccttagctaatcagatctggagtactccatattatataaagattcgtctttccccaaccaaatgtgctgtctgggacaaatggattgaattatcccctttgagactttgtcccaagcacatttactcatgactggttcaccacatgcccattattccaaagaaaccaaaaaaagcgtgttgcaatgggtgaagattattttaatcttgtaattcttatccggtttagctagggtgaaattcaccgtggaaattcgcttggatattttagtttagaaaatcataagatgtagttaggagtctgacttttatctcaagttagcatgcaagtttttttaaagagatttcttatacgactcattttgtattttcaaaagtaaacgaacttaaaatctgacttaaatacggatatgtatttctaaaagcgaacagatttaaaaaaccgacctaaacacggatgacgcaccaaaataccggtaaaaaaataatagtagagattatcatgtgaaatgtgaacaatcaaaataaacatgatctcattgtcctccctcctaagaaaagaaaaggcacaattttcggtgttactaaacacagatccctttcgtctgttaacatcatcatgagcagcactgcattgacggagaaccacagaattaatagccgctaaaaagagagccttttcggcaccgtccatgatccatcctcacccccaaaaaaaaaaggccacagaaagaaagagagagagagagagagagctagagatc

SEQ ID NO: 44053 - DNA, 1501 bp, Oryza sativa
ctcttacctacaggggaacacaccgttatcataggctatgtcttaacctgtattttaggcaaaacacacaacaaattattattattgttttttcatccaaggcttaagccctggttgatagcctcatggacttaccatcactacaagcacgttctctaatgagataatggagaattattcttattctttttatctgtcactttttatgttttccatattctctgatatgcaaattcggcatttccatcttatgattacatcaagatatttcagtaaaactaaaatgtaatgaaagtttcagcgacaaatctaatgaaataattttcatacaaccaaccatgtagcttttaagcatattaatattcaaagtttgccggcataaattgttgaacaaccacataactcttatcatcctaattaaaaggatttttatctcaaaaaaagattaaagggattttgacaacatatttgtggaaatccaatatttcttccctttttgagaggagaagccaatgtcagtagcaggtaccctcatgtgtccaattaaagtgtatacttaagctctaataaattggttgatgcgtataactcaatgatttcgactgaacatcacataccttatgggctcttgtgaagtcagatttgtggtagcgattggaccaggagatgatcaatctcaaacagtgatcagcgtattatcatagcaattatttttctccattttgtttcatgatcattcagtcagttaggtcacttttgtaccaagttgcttgtagagaaatcaaggatgtctttgggaagatgtggcatcaacgacctgataagacgtgagaagacacacattttatggacggcgagcttctgatcaaagaaagttcagaagaatctgatcattcagaagaattcttttggacttagcacatttcacaagctacaaaatgcaaccatatctgcaactctgcaagcatgattgtgggggactttgttctgtttctccttgaattgtgtgacccaaagaggggaagatttgatgccattgaagcaagtgtagtgtagtgtacagagtacagtatactgtagcagctcacatggaaggctagtgtctttgttgataccatgctatgcttccagctgaggagaagaatcttggcacaggacaattgattctcaagtcccaactttctcttattgtagctggtcacagttccaggactgacttcagagttctagattgcgacagagttggaagaacgatatactccctccgttcctaaatataagcgtttctggctatgcacctgaaacaatacggcagatatgtgcaggtgtatagtcaggaatacttatatttgggaatggagagagtacaaacaaggagaaatcaagtgctggaattcacatttgtcacaactgttcaatattctaacctcttggatggaaatggaatatgcctttcatacttacttacactgaagatttatgttcaaaagaatgatatgtg

SEQ ID NO: 44054 - DNA, 319 bp, Oryza sativa
tcatgtaagtggctgataggtttccagttttccgctctagggctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcaga

SEQ ID NO: 44055 - DNA, 416 bp, Oryza sativa
gtaatccttttgcaacacctagaataacttggaatcttgtgtaccagtccaacaccttcacattattaaaaaggtgacaatctagagaaccatttgttggcaacttttttgacaagtcgacgagcacgatcgcaacacctaaacgccttgcggtgatatggagtcgccaaccacctctatctagccaaagggccaaattaagatgggtttcggagaaaaacaactaaggccctctttgtttaggtttataagccaacttataagtcgaaaagtctaagccaaaacaaaacaggcaagttttttcatttggcttttttaagccataagccactctaccactattaagccaaaagctaggttggagaagctttttttggcttatatgagataaatgtatgactctaccattaaactta

SEQ ID NO: 44056 - DNA, 1367 bp, Oryza sativa
cggtatatccgtgcgcttgcggattctatctgtgatcataagaaataccaacagtagccataaatataccaggactattttgtcgccatttctaggaatgaatatttctagtaatatcgttaagaaataccaacaggcaaccacgttggatcgacgaccagcgatgtcacatcgagaaatttagcccaaatttccagactattttgtgtattaaatctttgtccaggaatcagccagggtacacaaaacgacaaattaatatacagatccaaacatcaataaaagcgtaaatactaacagaagaggcacttagtcctcacactgaaaagagagcagcagtaacggaaaaggcgatcctagtggggcttcagctccactccacaggcaaaactcaagtggggtctgagcctcggtcctctaacttcgtctttagctcagaagcgctacacttctgaaagggagaaatagaaagactgagtacaaccaccatactcagcaagccacaccaatgatgcattcatgcaacgggaggcaaaggatgtttgtggctatttgcataaaggcagttgtaaagcatttatagttgaaaatggtaaaacagttgattaattaagataataataaatctctactgatcaacgctacaccacgttgaacaggcccaaccaaaccacctgaactacaccagttcattaaccaattattaaggggatgagcactaatcatcgcgaaggtgaattccttgtcgatcgcccataaccacgggcatggctattcgaatagttttactctagccaaaggtgcacaactgtacccacaagacacaatctaccggcatgtcaccatgcctgcgcgggcacatcaccatgtcgagtgattgtgacaagacccttcgaataaccctcccctaaccatccacaccatgctaaggtttcaccccgacccctaacccggagtaggcagtcccctcgtccgccgcagtgaatccggaagctggacaaccggacaccccgggcgacccaagtccatcacacccaccctcgccaccggcgacaaattaatatacaaattcaaacataaataaagcgtgcatacttacagaagaggcgcttagtcctcacaccgaaaagaaagcagcagcaacggaaaaaggcgatcatagcggggcttcagctccactccacatacaaaactcaactggggtttgagcctcggtcctctaacttcgtcttcagctcaaaagcgctccacttctaaaagaaggaaatagcaagactgagttcaaccaccgtactcataaagccacaccaatgatgcattcgtgcaacgggaggcaatgaatatggcttcgcgacgacgggcggcga

SEQ ID NO: 44057 - DNA, 682 bp, Oryza sativa
cccaaactgcttcgcccggcactcgccaaccgctgccaccgccgctccgctcccgcgctcttggcacccgtcgccgcgctcgaccatcgcgtgcttcgctcccgcgctcacccaccgtcgctccgcccgccacccgccacccacatcgcgctcgccgatcgccgctccacccgccaccggttccttcaccgaagaagagaagagagaagagagaaaagagaagagaaggagaagaaaagaggagataacggctgatatgtgggccccacgtacttttcttaatttttttactgactaggatgccacgtccgcaaaaccacccatatatactgccataggaccctgagtgcacggtttgtgtgagattaggggtacacatttatggttttgtggttaagggatttcaaaaaatctcgctgttaagttgaggacctccggtgaacttattccaatcggtaaccgcccccatggccaagtgggcttcatttgaggctcatttgtctccggcccggcccacttcccttcccatctcaccagtgacgtgcttcttcatcatccctatatttccccgacacttcccatcgagccgagcaaaagccctagctttcttatccggggaaagaaaaagaaaaaagaaaaaaccctagcgatcgatcttggcggcgaggcgagcgacagggga

SEQ ID NO: 44058 - DNA, 1501 bp, Oryza sativa
ccttctcacaaagggggacggggatgtcgcttgccgttgtcgggccgttgatcatcagttggccgacgcagcgctccaccgtttcgctgttcaagcctgcaagtcaagaaccggaattcggtaagccaggaggagcatgcctataaggaggtcaaatcaaacacaagaaaaataccccgaggagaaacccgggtcgtgtcctccggcccagaatagtcaaaggctggatgagctcgagtctggagcggctggattcgcctaccaacgaagttggcagcgacttcataccccgacaaacctcgtactcggaggtcatcgatggcctcgacgaagaaccgaagggcgggggtcaaggtaggctttgcggtccaagacgaaatcttgtctggttgttccttaggaacaacaaagacaggatccgaattctctatctgaagatagaaccaccttgcccgccatttgctacgagaagaagggcactggaaggggatataacgcgacttcagaccatcccgaagtcggaatccaacgcatccagacactctgttggattccatccaacgcaattcatagtagaagcggaaaagattgagaaagggctataccccaatataggcttcacaaaggtgtgcaaagatacttaagaaggcaatggaattggggttcaaatggagcaaagaaaggccatagaagttcaaaatcaagagaagaaattcagaaagtggagggagaaaaccacacagaatgtagtcctcgatcacaaccatgcgacccaggacaggccggcgtttagtaccttcaacttctctctccatggctccatggccaggaagggtgccatcttcctggagcttctttagcgacgcgttggtcgaggtagacttgccgagatccattaccgactaaagatcgctggagaaaggacggagattaacaagctagggtttttttgcgggagcggagaagatgagatgcgcttggaggctggaaagttttttccacaacaggcggacttcaaaataaatccccaaaactctcttaaataggcacacttccgacggtgcgaatttcaaggaaaggagagagatggccgccggaaatttctgggtccgttacgcgcggtagtctttcagacttcagtttaaactcacacataaccattgggcttcacatggtgttctcgactatgtcctgtctctatggttcccacaccgaaaacgacatcagcctcgacatcagaagtcgcgattggttacacgagttcatttaagccgaagtcgggggctactgtcagggttacgggttaggtataccctttacccttcgatatatgttacatatcgatatggcatgcccgcgcatatatggacattctctacatacactaaggaaatcctttacgaagtttgcagagaataagagtcctactcggacaggactgggtcgtcaatgtatcgtgtagggtccgatgtctccgagttctacttggaaaccgcctgac

SEQ ID NO: 44059 - DNA, 1501 bp, Oryza sativa
cggaccctacacgatacattgacgacccagtcctgtccgagtaggactcttattctctgcaaacttcgtaaaggatttccttagtgtatgtagagaatgtccatatatgcgcgggcatgccatatcgatatgtaacatatatcgaagggtaaagggtatacctaacccgtaaccctgacagtagcccccgacttcggcttaaatgaactcgtgtaaccaatcgcgacttctgatgtcgaggctgatgtcgttttcggtgtgggaaccatagagacaggacatagtcgagaacaccatgtgaagcccaatggttatgtgtgagtttaaactgaagtctgaaagactaccgcgcgtaacggacccagaaatttccggcggccatctctctcctttccttgaaattcgcaccgtcggaagtgtgcctatttaagagagttttggggatttattttgaagtccgcctgttgtggaaaaaactttccagcctccaagcgcatctcatcttctccgctcccgcaaaaaaaccctagcttgttaatctccgtcctttctccagcgatctttagtcggtaatggatctcggcaagtctacctcgaccaacgcgtcgctaaagaagctccaggaagatggcacccttcctggccatggagccatggagagagaagttgaaggtactaaacgccggcctgtcctgggtcgcatggttgtgatcgaggactacattctgtgtggttttctccctccactttctgaatttcttctcttgattttgaacttctatggcctttctttgctccatttgaaccccaattccattgccttcttaagtatctttgcacacctttgtgaagcctatattggggtatagccctttctcaatcttttccgcttctactatgaattgcgttggatggaatccaacagagtgtctggatgcgttggattccgacttcgggatggtctgaagtcgcgttatatccccttccagtgcccttcttctcgtagcaaatggcgggcaaggtggttctatcttcagatagagaattcggatcctgtctttgttgttcctaaggaacaaccagacaagatttcgtcttggaccgcaaagcctaccttgacccccgcccttcggttcttcgtcgaggccatcgatgacctccgagtacgaggtttgtcggggtatgaagtcgctgccaacttcgttggtaggcgaatccagccgctccagactcgagctcatccagcctttgactattctgggccggaggacacgacccgggtttctcctcggggtatttttcttgtgtttgatttgacctccttataggcatgctcctcctggcttaccgaattccggttcttgacttgcaggcttgaacagcgaaacggtggagcgctgcgtcggccaactgatgatcaacggcccgacaacggcaagcgacatccccgtccccctttgtgagaaggaggcggccgatcgtgaaaccgcaatcaatgtga

SEQ ID NO: 44060 - DNA, 229 bp, Oryza sativa
cttgagaggggtatcgaaccagccaccgctaaatggttggatcgatcgaagttctggtactatgctcatggtggaacgcttaacccagttgatggctccctggtcttcagcgatcagatacgcgaggctaccagtcgactaacggacgcagtggaagcctcttctcagggcacgttccgacccgacagagagaaggacgagctgtcacttgccctacagactcccgagc

SEQ ID NO: 44061 - DNA, 1501 bp, Oryza sativa
gcgacgaattgaacgcttttggtagaagcaaaagcaacgtaaactgccgtaaacaagcaagcaagcaagcttttacgactgctattgcttcactacctcaaggccagagcaacaagcaagcaaagaaccgagccgtttcttgcagccgccgccgtcgtcaccggcggccgcggcgacgaactccggtgtgagcagttagcttattagctacccacctttcttaaatcgttaaacggtctaacttttattaaaaatattttatgcagaaatgtcttgctttgtaaatatattttttaactttcaatgtttaattagttcttttatactcttaaataatgtcacaaaatcagagtaatctattgctaccatccactcaccacaatctgagcccatgtacgtttcatgtctttttttcatatttttgtcacgggttatttgctccatgtttctaaaaatatgatttctcaaaaaaaaatcttctgctatattgtttaaattaattgttctaggaagtttttttcttaaaatattaatttatcgtgttagttatgtaaatttgtcttaatatcaacgtaaaaatatgtttcaaaaaaggactaaagttgactctgaaatctgaatgggtctactttggaggacttcttttgaaaaggaaaattattgataatgtggtcagttttttttcagagaaacataatgtggtcagtggtcacgactttgaaggacaagtgaaaggagtaatgaagatcggaagcccatcttctctcttaattccgcacattaaaatatgtaaccacttctataccatatcatttgaccaactgtaaaagaatgctcatttccctaccaccttcttcttgaaattatttactttatttcctccatttatgtcgttttagttttgctctgaatcaaacttctctaattatatctaggctttgttcttttcttcaacttcaaacttcaccttcatcatttttagttatttcaaatggttcaattatgtctttttagaataaaaataaataaatataaaatttgttaaaaaatcaaataaatctattttttaagtttataatagtaaacaattaactaatcatgtgctaataagttttttctcattttacatgtgctgaaaatcctccactaataagaatgaatatatcaacctctacagtaacaaatagatatgctatcaagacatattcatgatggatttaatgatgaaatcaatcggatgttacagacgttggtgtgtttttctacaatttatgaaaaaactaaaacaaattacaatatgaacatggaacgcggtgagtaattaagtgggccacagacacagaaaatatcatgaaaatatcagcaattcagtttttcttttaaaaaaatcaatcaaagtgtgactgtgtgaggcatggctggaagcctgaagtgaaagtagagaatagcctaacctgatcctctcccagaagcaagagaaagcgaaagtgacccacggtga

SEQ ID NO: 44062 - DNA, 499 bp, Oryza sativa
tatcagaggaagtatgacaagcagcaggagaagcattatgaagaacacgatgatggttttgatcctcattggggttgtgagttctttagattctgctggaatgaagggatgaggttactgtccatcgaaaactgccctgggtgcagtgttatcattgagagctcaagccagtcatataatatgaataatcggctgaggcaggaaagagtgtctgctcatcaaagattgggcccagtgaatcaaggtcgtggtcaggaggatgaggtagttaggacaaatcaatggtgtccttctggtattttcacgaagaaccagaagagaagggttcagaggttgaggaacagggagcattttcaagaagttgaacaggaaattaaccatcggctaaagaaagcaaagccaagacaggaatggcgtgttaagaaccaggttcctgtagccgatgatgttgcagccgaagaggcaaaaaggatggcaaaagggaagagtgttgtaacag

SEQ ID NO: 44063 - DNA, 195 bp, Oryza sativa
aattctgaattaatctgattgtgcatgtaactatttttggttgaactgttgatgcacgcaactcaaacccctctatttaaaccgggcacgcggtcgacgtcgtctcccagggaagcttgcttgacagacagctgtaggcggcacggcggcgagcgcacctcctccgacgatctgtcctaacggcggcggcgaagg

SEQ ID NO: 44064 - DNA, 1054 bp, Oryza sativa
tgaaatttggtaagcccaaaattactatcggcttagagtcagtatcgacttcaaagttttagaatcagccgatgggagtcaagttgccgcgatgtcgtgttcttggtggagtcggatcaatcagaggaatcttatccagaagagactgagttcaaagagaatgcagcatggcaagttatctattaatgaggaatagtttgttagttttcttttatctttaggaaagtgtgtttagtgtcctataaggactttatcttttccttctatctttaagaaagtttctttcttgtccgacaaggacttgtatcaacccatgggtataaatatgtacacccggggtctatgtaatctatcctcacgatcaatacaattcggcgcatcgccaccttttaccttttctactttattttatcgaccggcgggacttggcacctgacgcggggctaaatcggtgttcgatctccggcgaaggggtaagtccaatgttccgtcggtccaggcaattgtatcgtctacgtcggcgttgttcaaggctgcatcagggcattcaacctgttggattgctctgatttggatgatatatttgcctacctatttatcatatgtctctgttaatctagtcttagcatatcaatttagctctatcggctgcttctcgttttagggtttctgccggtatcggctaaatcacgttgctagattagattagcttagacatctaccaccctgaaaactcagtcaatggcttgattgtctagatattatgtttcttttcatacttagtgctgcatcagttaagtttgatataccaagtcgtgcttagaaccataatctctagcctgctctttgactgccaataagggtttcagctggtgagttatctggacgttgcatcggctcataaggattgcatatacatataagttggatttagccgatgacaacaaatgtttcactgtttaatctaatcttgtggatttcatgacatcagacctccagccgatgtatgctttaactatcggattagtgcttttttatcatatcaatgctagcc

SEQ ID NO: 44065 - DNA, 598 bp, Oryza sativa
atagccgatgccgtactagccgatagcgatatggtttaagcaatcggctatatgtccaatgtagataatgatataaaggcaatcggctgatgatgatgtaataaaataataatataatccagtataaaccaatcggctagcattgatatgataaaaaagcactaatccgatagttaaagcatacatcggctggaggtctgatgtcatgaaatccacaagattagattaaacagtgaaacatttgttgtcatcggctaaatccaacttatatgtatatgcaatccttatgagccgatgcaacgtccagataactcaccagctgaaacccttattggcagtcaaagagcaggctagagattatggttctaagcacgacttggtatatcaaacttaactgatgcagcactaagtatgaaaagaaacataatatctagacaatcaagccattgactgagttttcagggtggtagatgtctaagctaatctaatctagcaacgtgatttagccgataccggcagaaaccctaaaacgagaagcagccgatagagctaaattgatatgctaagactagattaacagagacatatgataaatagg

SEQ ID NO: 44066 - DNA, 169 bp, Oryza sativa
tatgacgaataagagtggcattattttgatatgccatatttgcacttttgcagtggcatggatccaattaaccaaggcccaaaccctacccggccgtctccccatctcctccccaccgcgccccgcaccggcggcggggacctgtctccgccgttcgtcctccccacga

SEQ ID NO: 44067 - DNA, 769 bp, Oryza sativa
ccctgccgacagttggtgttggtactgaacttattattgagcatttgatgcgatgcgaatggaggaacgctgtgagaaacggagatattcgaccaatgcatagtgtattaaatataaacgaaagaaacaaattacacatattatgtgtaaattgcaagacaaatcttttaagtctgatggtgccatgatttgataatgtggtgctacaataaacatttgcaaatgatagattaattaaacttaataaattcgtcttgcgttttacatgcagattctataatttattttgttattagactatatttaatattttaaatgtgtattcgtatatttgatgaggtacatccaaattttacaacctatctaaccacagccatatatgtgtgcgtcaacgcgtctaatcgaggaggatttggagctggagttgttggtgaggtggcgcctcttcatgccccctcgccggccaactactggactacgggagcaacgctttcagacttgtgcactaggcactgagacagtgactattaaatgaaaagaaaatacttcctccgtattttaatgtaacgccgttgattttttgataaacgttggaccttttatcttatttaaaaaaattatataattataatttattttattgtgacttgatttatcatcaaatgttatttaagcatgacataagtatttttatatttgcataaaatttttgaataagacaagtgatcaaacgttggttaaaaagataacggtgtcatacattaaaata

SEQ ID NO: 44068 - DNA, 1501 bp, Oryza sativa
ttactcaccgcgttccatgttcatattgtaatttgttttagttttttcataaattgtagaaaaacacaccaacgtctgtaacatccgattgatttcatcattaaatccatcatgaatatgtcttgatagcatatctatttgttactgtagaggttgatatattcattcttattagtggaggattttcagcacatgtaaaatgagaaaaaacttattagcacatgattagttaattgtttactattataaacttaaaaaatagatttatttgattttttaacaaattttatatttatttatttttattctaaaaagacataattgaaccatttgaaataactaaaaatgatgaaggtgaagtttgaagttgaagaaaagaacaaagcctagatataattagagaagtttgattcagagcaaaactaaaacgacataaatggaggaaataaagtaaataatttcaagaagaaggtggtagggaaatgagcattcttttacagttggtcaaatgatatggtatagaagtggttacatattttaatgtgcggaattaagagagaagatgggcttccgatcttcattactcctttcacttgtccttcaaagtcgtgaccactgaccacattatgtttctctgaaaaaaaactgaccacattatcaataattttccttttcaaaagaagtcctccaaagtagacccattcagatttcagagtcaactttagtccttttttgaaacatatttttacgttgatattaagacaaatttacataactaacacgataaattaatattttaagaaaaaaacttcctagaacaattaatttaaacaatatagcagaagatttttttttgagaaatcatatttttagaaacatggagcaaataacccgtgacaaaaatatgaaaaaaagacatgaaacgtacatgggctcagattgtggtgagtggatggtagcaatagattactctgattttgtgacattatttaagagtataaaagaactaattaaacattgaaagttaaaaaatatatttacaaagcaagacatttctgcataaaatatttttaataaaagttagaccgtttaacgatttaagaaaggtgggtagctaataagctaactgctcacaccggagttcgtcgccgcggccgccggtgacgacggcggcggctgcaagaaacggctcggttctttgcttgcttgttgctctggccttgaggtagtgaagcaatagcagtcgtaaaagcttgcttgcttgcttgtttacggcagtttacgttgcttttgcttctaccaaaagcgttcaattcgtcgccaggttcagactgacaggcgtgcccatgacgccatcatttctgttgccggccggccgaagcaaagagatggttttttaatggggaaaaaactttaccatcaccttggcatgttttatgcagtaccccatggttagctatatactactccctccatttcacaacgtaacattaaccacata

SEQ ID NO: 44069 - DNA, 1501 bp, Oryza sativa
gaccgcctagactggtccatgacctagaatcaaaagtcgagtatgtagtacatgtaaccatgtaaattcaagcttagttcatagtgcaatgggctggcctgagccttaggccaaggctgggtcccctgaaacagtccaaactcgatcaaagatacatgatcaataacaatcaacattaatataatactcaagcaaggatttcacctctaaattggcaacgtacatctcggaaacagatcctctggaaaactgctgatgcagtagcaaattagcaatggttgaggacccacatgttcgtgtctgctactgcaccagtagtactgcagacaatcctcactagttcacttcacactactaaattgatatagatgcttagagttccacttatattatcatatcttcctatatagttggtacccactaagaagcatttactcctataaagcaagatatgcaagaagccacatcatcaacaattttaagctattggattgcattagtatagagttatcagccgttggatcaagaagctagctactcatccatctaaattaatcattgattatttaattactcatccatttacctccctttagctcataatcatgcgtgacattgttatccattctgcacatccaaatcctcaaagatgataataatctcttttttttttctaaatacaactccaattattacataagatgtgagctttgttttgttataaacaattggataacatacaataattaggtatcattaatccaaactcatttttgaaacatgcttgagatgaagcaaagaagtgctacactacctaattgtgacgatatccaaattgtgcatgaaaattactttcatacatcataacaatattcaatgacgtttcaaaaaataaaacatgaattgtattgtaataacagaagctatatatgaagccatattttcatctattttgtatataccaagagttacatctaatcatttaaaacattgattttattcgatgataaaactagcaaatcccgcggcaagacatggggtgccaactagtttaatagtacttgtgtgtgccgtaaacactagtgaggcagcaataatttgccacatcactggctatgtcattgtgacgcgacgcgaatgacatgatatatagtccttgtcacaatatgatgttcttctacttaatacttatatactccctccgtcccgaaaaaacgaattaggacttgatgtgatatattctagtacaatgaatctgaacagaggtatgtccagatttgtagttgtagtactaggatatgtcacatctagtactaggttggttttttatggaatggagggagtaattgtgtatcactgtaaaactatcacaacaataagaataaagaatatacgtgacttaattaaagacatcctaaaagtaagttttcaaatgatttattttaaaattatatttggaagtttaaataaaactggggaaatgatgtgaccatcaagtata

SEQ ID NO: 44070 - DNA, 349 bp, Oryza sativa
gtttcaaagggcttcataggaaattttcctataggattgaaatcctctaaaattcctatatttttcctccaaatcaaaggggccctaaatagctttgttcattctcaaaaacaattgggttttgtttagttgaattttgccaagtgccattcaccttgtctatagttctatcgctcgattagtcggcgactattgattcagagcccccaatagctggtgtgttgatttgccgggtcgattagatctaccacttcaatcgcaactattcctttgtgcttaatcacctattcgcaatatttagattgcatcttatcttgtttttgtagtgttctctcgtttgcattgcagg

SEQ ID NO: 44071 - DNA, 1501 bp, Oryza sativa
catcattagcagatatttactgtagcatcacattgtcaaatcatggagcaattaggcttaaaagattagcctcgcaattcagcaatctatgtaattaattttttttatatatttaatacatcatgcgtgtgtccaaatattcgatgtgacaaggtgaaaaaacttgccagggaatctaatcaggcccgtatagcataataactaataatgtgagtttcagattttagaacggaaccttcaagtttgaaacctgaagaacttgctaagctggtggtaattccatgccgggtttgtttcaccgattagattatgtttgacaatgtgcttagcgcaagcttagtgagcctaattctgcagtattatattaatcatggccttgccattgtcatacgtaatacaactacagtcaggtcttgcttaattaggtgttgtcactgtcgacaaactcctcagatgtactattctatttgtggatcctgacacgcagatctatttgatgaatatgtttcctaattgttctccaagataagttaattagcaatatggtgaagaaaagttttggcacagcaaaccaggacacagtttcacaaatggatttatcagccatgtactcttaagttgattttatgcactttcaagattgtggatggggccatcacacagattcttggaattttaacttttattaagagtttcagaactgaactggctcatgtgatgtgagttttggattttctaaactgaatcctcatgttttagacctgatcgttccgaaaacactttcagtataggtgacttggccgatgtgtctttggagatgaaaataagataatggatggatctttcaactagtgtttccatgcttcacccttccgtttccaaagcagagtttaaaaaaagaagcgaatattagcccaccaccttgtggagctaaccagagatctgtgggcgttttcccaaagcagagttcttttcccttaatttcagaatgatggatgtcttggtgttatttgcttaggtgttgtttggatcatcggatgtttgacactaatttagagtattaaaaatatactacttataaaactaattacataaataagagctaattcatgagacaaattttctaagcctaattaattcataattagagaatgtttactgtagtatcacataggctaatcatgaattaattaggctcaatagattagtctcgtgaattagtcaaggattatggaatgagttttatcactaatctacgtttaatacttctaattagtgtcaaacatccgatatgatagggactaaaaaatttaattttagttccatccaaacaactttttttttttaagaatcaaacagagtatgatcaaatctgtatggagtgagtactaaaatactattcattgcagtctcgtctagtcgctcagatttctttccttatttcttttcctgcaacgaatccggaattcaccatcaccatgaaggggtggtacacacttac

SEQ ID NO: 44072 - DNA, 1501 bp, Oryza sativa
gaggttttgaactcaaaatcttcgacggatttttctacagtgcttagatctatgcattccctctcttgttacaatttttttatttttgtagtccttaattttgatggatctatacatgcaaaaaagttaaagcagcatgtgtaatttttttttgctttttatgcctttttatgcattgattatgatggatctatgtatacatcaaggtgccatattgtcctctcatcccttatggttaaatgtgatgtttttattagccaaaatatgtattatgcccacttttccaattccctagatctagataggagagattaaataaatatgtattttgcccattttccatcccctagaggtacatagtagaaaacatatgtattttgtttacgttacttttatagatcacaattctacagttattaatatttctctttcccatagcgagccaagttaagtattttataaataggtatttttatgcaatttaaatttgttaatataattataatgaaatattctcagagatatgggtaggcaatggatgtatcatacgccaagatatatgccatcatatacaaatgaagtatcaaaatttactgatattattaaggcgcgtgcagcagcaacaacacaacggagatacattgttcatatgataactgtaaaaatgaaaaagtaagagagaaataccactactacttacctatttgtaactatgccattgcaatgcctctaaaattgtatccatgccattttatatgcagcagacgtgttttttaattatttctctaccgtatttttagatgaatcaaaatacccaatcagcatgtaaaacccatccgtcagttttccatctcttttttccttttcctcccctccactctcatgcatggggggccatgaattatgtggcacaatggcgacccacgttgaaagggcgagcggcagggacgggcaatggttgtgcatgggcagcgagagggcgaggtgatggtggcgtgccatggctgtgtgagggcgaggtgtcgttgagaggatgaggcggccatggcatctcctttccccgtcgtcgacaagctttttcgacagatccggttccttctcgtccatggcgcctacgaggccgctgaggagcagctcggcgacgcctatgaagtcggcaaggagcagattgggctcattgacaggatgggaaaaatctgcttagggagattaggcttgccgatggcttcatgctcacgaggtcaccgtcactactaaaaaacccattttcacaggcggccaaaaagcattttcacaagcggatagttgctccgcctacatgtaatcgactgtgaaaatcaatcattttcgcaggcggggcctgcgaaatcaattttttaacaaaaaaaaaaacctcacaaaagtcgttccaccaaatagcagcagaatggattagaagatttttcttagattcactaacaacagccagcatcacaatgaaaaacagcagcagaatggttta

SEQ ID NO: 44073 - DNA, 310 bp, Oryza sativa
cccgagcttatggaatgggttttgtaattagtatatgtttaatactctaaattagtggccaaacatccgatgtgacagggacttggaataagtccctgaaaaccaaacagcccctaaactactcctaattgctccctccccaaccataaatgcaaatgatcgtaggctcttttagaaatattaagattagtgtgaaaaaactagagtaaatttcatcttgaaccacctatattgaccaatgtggcataatgggctagggctaagtttctcttttcacttaacaccacctaattttacaatcttttccagg

SEQ ID NO: 44074 - DNA, 456 bp, Oryza sativa
tcacacttgtcgatagcatttctgggacttagacgcttgtcaatggcatttcatggattatctcttaactaaaagatttgaaaacacgtgtactgaagatttttaaaaaacaaataaaaaaagtgaaaaaggaaaaacgcgccgatgggagagtggcgccaaaatcggagaaaatcgtgaaaaaaaagagaatcacgaagcagggggtgccagctggcgcgcgcatgccagatagccaccctttttttttctcccgtccactctcttttccctcccacaatttcaaaattttcaactcctctccctctctcttcctctcctctcctctcctctctctctcttcctctccgagcaggagtgagcgccacgcggcaccaccatttcatttttttcaactcctctccctctctctcttcctctcctctcctcctctctctctcttcctctttgagcagg

SEQ ID NO: 44075 - DNA, 220 bp, Oryza sativa
agttcacacggagataaaatgagcagatcgatcacgccgtcacggcagccggagagaggcaacggcgaggtggccgttgagtggtgacgctaattaacaacagaacggagcagaggatgaccgatccccttcgacacactctctgtgtgtgtgtgcgcgcccgagtacccacccaatataatttttcctcgttcttgcaatctcgcctcatccgtccagg

SEQ ID NO: 44076 - DNA, 1501 bp, Oryza sativa
cagggtttgtctttttttggacggagggagtattgattaaaaacatattacccgttgtaacacacgggtattttttttctagtcaatatctaaaataaaacaacgtaaaaatgattttgcattagatttctatggtctctcatgaaaatgggacaactatactaatttctcaacatcttcgtggattataaaatccaaatgtcgtcgctcgctaccacatcatgaacacaataatgtcgaaattatgcagtatgtgcttgataacaaggaaaaacctagtatcgaatatttaaagagaaaatataagcgtgttatatatgaaacaaacacatgaactcgggttggcaaacctcaaaggtcctcaacttttttcctttttttttgagaacacaaagtcctctcaactatatgtatgcttttcaattacgtactccacgagacatccgaagatgtgatgcgccgaaaatgcgctcacgagtacacatgtagaaaagcaactccttctagatgctatacacacagaaacactagggacctgatttaagcaagcgtctgacaactatagtttctcataaaatctctagaagcttctcactagaagcttctcaaacaattcagattttcattcagattttaaaaagttgtagttatagaattaaaaaataaactaaaatctacaagctatatttcctaatttatatagtactcctatctcgtcagctgctttttagaattttagggcccctttgaatcaaaggattttatgtaggaatttaatatgattcaaatcctataagaattttttctgtgtgatcatttgattcaaaggattgaagctttccaaatcctatgaaattcttatggaatggttaattgcatatggattttggaggaatcttagcaagagctacaacctcttgaaaaatttcttttgagtttatttctcttatctgattcctatgtttttcctgcggtccaatcaaacggcaatttctgtgttttgcaatcatctgttttacacttgcattcctatccgaatcctatatttttttttcttatttctctatttttctaatcctacgattcaaagaggcccttagctttcccaaacgagacctcctcgtcctcgtctgcttctcagaattatttccaccgcatttccaaggctcctcgtccatgtcctcgtcttctttcttccacaccaaacgaactcgtcaactcatggtggaagcaacaagtggaggcatcggaccaaacatttcatccaacgcaaccaccacaacacgccatgcatcccatcaaaccggaaacagatcctctgacgtgaacttccctcgctaacatggtcaccgacaagtgggcccacgagcgatggggcctacatgtcagtcatgaagtcagggagggatcccaatccctccaaacctacataaatacatacctgataccaccaaccttcctcgccgcgccattgccaaccaataatctaacagttaattag

SEQ ID NO: 44077 - DNA, 1169 bp, Oryza sativa
tccggccaaaaccatcgcaccggtgtgggcctatatatggtaatattggcactaattgacaaaagttcgtcgcgcgaatcacgaagagagttttttccacgaacgcacccaatacactagaatatgtgcaaaaatcatgttttgacattttttgaacttttttcattccggtcaaaaacatctcaccctcgtgtgccaatattggcattaattgacaaaagttcgccgcgcgaataacgaagagagttttttccacgaacgcacccaatacactagaatatgtgcaaagctcatgttttggcattttttgaactttttcgttccggtcaaaaacatcgcaccctcgtgtgccaatattggcactaattgacgaaagttcgccgcacgaatcacgaagtgagtttttgccacgaacgtacccaatattggcactaattgacataagtttgccgcgcgattcaagaagtgagtttttgcctcgaacgcacccaatacgctccaatgtgtccaaaaatcatgttttggtgctgttaaacttttttattcctgtcagaaaacatcgcaaccctggaggctcaacatatgccaatattggcattaattgacaaaagttcgccgcgcgaatcacgaagtgagtttttaccacgaacgcacccaatacactccaatatgtccaaaaatcatgttcgggtgctttttgaactttttcattccggtcaaaaaacatcgcacccgtgggggctcaatatatgccaatatttgcataaattgataaaagttcttcgtgcgaatcacgaagtgagtttttgccacgaatgcacccaatacactctaatatgtccaaaaatcatgtttgggtgctttttgaacttttttattccggtcaacaacatcgcatcagtgggggctcaatatatgccaatattggcataaattgacaaaagttcttcgtgcgaatcacgaagtgagtttttaccgcgaacacacccaatacactgcaatatgtccaaaaatcatgttttggtgatttttgaactttttcaatccggtcaaaaacatcgcacccgtgggggcctatatatgctaaatattggcacttattgacaaaagttcgtcgcgcgaatcacaaagtgagtttttgccacgaacgcacccagtacactccaata

SEQ ID NO: 44078 - DNA, 1501 bp, Oryza sativa
cgaggtcaacaatggaagtagaactcacatctttagatactgccacagttgaggccgaatggcttcgtgagctcctgatggacttgccggtggttgaaaaaccagtaccagcaatcctgatgaactgtgataatcaaacagtggttattaaagtgaacagttcgaaggataacatgaagtcatccaggcatgttaaaagaagactgaagtctatcagaaagcagaaaaactccggagtgatagcattggactatgtccagacggctaaaaatctggcagatcagtttaccaaggggctaccacgtaatgtgatagactgtgcatcgagggagatgggcttgagacccacttagagttgcacaatagtggaaacctgtccattgtgatcggagatcccgtgaatttagatggcaaaacaaactattgtgtagctgagagaagagaccctaaaatgagcctatcttcatgatgcacttcacttctaatctgtatggtaggatggtatacaccttaatgtgatccgagtggcttttcataaagcagagatgttggcctacagaacattttagaaggaacacacttatatgagtccgactgttagtcacagtctatgagatctgggtgatctctagatactcatgaaaaggccaggagtatgacttatacgctccaaacagaggggatgcaaacgacagcctagtaccagttaagggtttgagtgaaacctgaatcgcacaagactgataattcaaggcatagtccattgttcagttgtgatctggtgtagctcttttcctaggtggaagttcaacttaacagtctccatcgaaacaccggtataactaacaggttcagttttgagaacatttcctgtgagccatgaaatttggtggggattgttggaataaatgggctaggcccaatttaattcaattaatatctcaagagcccacaagtaatgttagagagaataacactggcttgaaaatttaggtggaagaacctcaaattaaatagggtgatattagagattccctgttgaccagttgaggtgatggttggactgccacacgcatgcgcgcatgccgagtcggcctcggccgtgggcgtagcgaggcaaggcggccgaccgagccgagcctgcctgctgctcttccgttttgaaacagatgagaataaagtcaccattaacaaatgaaattcattgtgttgtaacctccacaacaaatgagagattcattatattgtaacatccacaacaaatgagagatttatttgttgtaaccttcacaacaaatgaaagattcattatgtggtaaccttcacaacaaatgagatttattttgtggtaaccatcacaacagatgatatttatttgtgtggtaatggagatctctctctctacatataacgcaaggcagaggctctcaaagtgtgtatcttcctcctactattgttccttggcgatactctccttctgttcctgcgctgtctctctgtt

SEQ ID NO: 44079 - DNA, 1501 bp, Oryza sativa
tacttctttaataagaaggcctgaacctgtataaaattccttgtctccaaacccatacacttttctagcttgatagccactcccttttattattgccgaaatcttgtttcgacagatgggattatgcgggagagcatacacatggatatggctgtgaaagcataccagccggcaacggttgcgacgatttggttaagcttaggaaaagcatggcatatcctgatgcaatggttccattttcttgacgaagtctaaattttaaatcttcagtatatgaaatgcgtgttcgcatcgtcatgcatcatgcatgagtaatagatatcagaggtggttatgattaccatcgaatacttatcgaaatgaaaaaaaaatggtcgtttagccagatttagtggaggtgaagggaaaaaaagagatgagaatgtcgccaaacatatcagaacgcattgcattggattcactactaggaaaattgttttcctagacaaccaaaagtagttttttcaggcaggagaaaggaccgcattgtcgatggtggatacccgtagaccggatatagagggtattggggtacactgctacgaggatctactagtacgacatcaagcaaacaggaaacagcaattatactggttcatgcccctagaaaggtaatagccctaatccaattggtatgggattatatgatgataaccacagattacaaagggaatagcaaaactcgatgatactgatgagaccgtagtcgagtaggttcgactagatcacccggcgacttggctcctgtaggctccgacttcataggctgtggtggatgtgttggcggtgagattcgatgtcttaggtcctcccggggggtccattttataccgcgggtcagttggtctccaagtagaactcggagacatcggaccccacacgatacagtaatgacccagttctacccgagtaggactcattccatccgtggactccgttttggttacataatgaacttacttaacgtgtacaggaaatatccgcacacacgcaggtataccatatcagtgtacaacgtatatctaagggtaaagggtataccttatccataaccctgacagtagcccccgacttctgcttaaatgaactcatgtgagcgatcgcgacttctgatgtcggagtcgttgtcgttctctactggtcgatctcggtgtgagaaccgtagagacaaagagtaatcgacaacgccgtgtgaagttcaacggtcatgagtgaatttaaattgaagtccgaaaactgctgcgtgtaacggacccagaaatttccggcggctatctctctcctttccttggaattcgcaccgtcggtagtgcgtctatttaagggagttttagggatccattttgaagtctgcttgcagcaaagactttccagcttccacacgcccctcgccttctccgctcctatagaaaaaccctagtttgttcatctcggtttgatctccggcgatctccggcgggga

SEQ ID NO: 44080 - DNA, 329 bp, Oryza sativa
cactaccatgtttactgacgatgcataaggattaattagctaaaaggatgtaaagaaacctttgcaacgccagtaaaatggtgatttgaatagactgcatgaaaatgaaacaccatatacctctgccagcaagataggagtgcattgtcaaccacaacagcctcagagtatgtataaaacagacaggaaaataaccaattaaaggtgatatacagtagatagcattctgatagcattccaggtttcctctgtagataccagctatagaaaaaaaaaactagcttcttaccagcacagatggccgtgctactgtgctagaagcctagaaa

SEQ ID NO: 44081 - DNA, 247 bp, Oryza sativa
aaattgtgtacttttaggtcatgcattgttagattttttttggaaatgtgtcgtgcttgtcgctcataaattcatgatgtctggttaggacttgtgattatgtgttctattatagaaggcatagaactaaagacgaatggcacgcaaatgctcacttagcatgctatgtttctggcttaatgtcattgttctattatattggcagttggcacacaggagcttgtattaactcattttacccggtagt

SEQ ID NO: 44082 - DNA, 1501 bp, Oryza sativa
tgtttggacgcggtgatagcatcctcggctttggcatactcgttggctttttcgaacatctgcttaaccgtcctgggaggtttacgtccgaacttgccgactaggtcctcgtggagaatgcctttagtgaaggcggcgatgatgacgttgtcggtgatgtcggagatcttgttgcgttgttcggagaagcgtcggatgtaatcccgaagggattctccagacttctgaacgaagttgtagagatcaaactgtgtgtcggggcgttcaaaggtgccctggaagttggcgatgaagtgatcacgaagttccgcccatgatccgatcgtgccacggggtagtccgtggagccaggatcgggcggagtccgctagggccacaagtagatagtttgccatggccttgctgtctccacctgctgcgcggattgcgagtctgtagacggtgagccaagactccggattggtggtgccgtcatacttctcgattccagtcagtttgaagctgactggccaatccactcgacgcaggtcattagtgaaggcagctactccatccacgtcatcgtcataacgatttggtgaatgacggtgacctcgtgctgcacggcactggttgatcatgtcacgaaggtcgacgggacgctgacgaggtggagaacgaggtcgttcagctcggcgctccctgtgacgttcgggaagcgagtgaacagatcgttcgtcgtgacccctgctcctgcgactagatcttgtgccagtgacgctgaggcttggctgatgatgagggactcggctaccagtcggggtgcgggtgcttgcggagttgactggaaccgaggcagcgatcatggtcttcgtctggttcaagatgttgacaacatgatcggcttgattgagtgcgtcttccttgaggagggtgtcgaggagagtgattgctgcaaccgcgttctgctggggggtgcgaaagactgctgtcccgtcgacgtcttgttgcccaatgagctctctcgctcggcgcccagattcccaggcgcggtgctgtcgatcttcagcttcctttgcaatccgttcgcgatcttgttgctcccgctgtagtcgttctcactcctgtcgctgtcgctcttcctccagtcggcgacgttcagcttcttgccgtgcgcgatcttagtctgcttctcgggctcggcgctgttcttccgtttcgttgtcagccatgaatacgccgaagaagaggggtgtgtagttatcctcgtagctgtcgtcgaagttgtcgaagtcgccatggtcgtagtggtagccgaagtcatcgtagtcgaggatctcggttggtcgagaactgacgccgggggagctgaggtagccatccaactcttccgtcgagactgtcccaagaggttggagtataacgccaacctccctggatctagactggatcggggccgatgccagagctcgcctagatctccgagtgggagatgttttggctgtgaagacggcggccaagt

SEQ ID NO: 44083 - DNA, 390 bp, Oryza sativa
gttatacagtagaggtatatttatgcaaatatttttcatgcaggtatataaatgcaaaatattaatgaaaatatatattttctttttttttcttgttaagtactcgacaggatcaaacggacgcaattgaccacgcatgacacatataaaaccaacactacgtgaacaaaaactatactacaacgattacgacggtttgatatctctccctcgttcggcgaacaaacctgcctgaaccctacacgttaattacaaattacaccacgatttagtttaaccagtgcgtgcgtgcgtgtgcatgtggacacgtaatgcaaaacgtagtagttttcgtaaacaatcttttaattgcggtctcgtgccgttgacgacgccttaatctgcacacgc

SEQ ID NO: 44084 - DNA, 1501 bp, Oryza sativa
acgggtgcctctcatggctggacgcgcagccggagaagagcgtcgtgttcctctgcttcgggagcatgggctcgttccccaaggagcagctcgcggagatcgccattgggctggagaggtccggacagaggttcctgtgggtggtgcggcgtccgcacgccggcgaggcttcgctctcaggtttgctcgccgggtgtcacggcacgcacggcgagctggacatcgacgagctcatgccggaggggttcttggagaggaccaagggcagggggctcgccgccgggtcgtgggcgccgcaggcggacgtgctgcggcacagggcgaccggcgcgttcgtgacgcactgcgggtggaactcggtgctggaggggatcgccgccggcgtgccactgctgtgctggccgctctacgcggagcagaggctgaacaaggtgttcatcatggaggaggtcggggtcggcgctgtgatggcggggtacgacggcgaggtggtcagagccgaggaggtggaggcgaaggttaggtggatgctggagtcgaatgaagcgtcgccgatccgtgagcgagtggcgctggcgaaggagcgggccgaagaggcgacgaggaaatctggctcgtcgcatcaatcatttgtcaagtttctgatagactttggcgtgaccaagtgaccggtcatgaatcttgtttattggtgacaatgtaaaacgggataagtcaattaagaattatagttattataaaatttaaaaataagtttatttgatttttttaaaatttaaatctatatggaaagtatttgaaaaaaaacatattgtttagcaattcagagaacgtggtaacggtatatgagggattagctaagatgattaggcagtttcgaagggcgtggctaatgcgcgcgcgcgccagcaacagccttcccacgctgtttttttctccgcttttctctctttttttgtgatttttttcctttccttttgacttttttttctgattttttaatctttagcacacatgttttcaaaatatttgagttgaatatttttaaatcttgactttaaagttttcaaattttaacttaaaagttttcaaatcttaacttaaaaattttcaaatctgtacttgaaagttttcaatcttgagttgaaagtttttaaatctcgagttgaaagttttcatattttttcaaatcttaacttaaaaatttttaaatctgtacttgaaagtttttaaatcaaagatgaaagtttttaaatctgagttgaaagttttcaaaatttatcttgcacatttaaattttgagctgaaaattttcaatttttaaaatttgacttcaaaagttttcaaatctaacttgaaagttttcaatcggttagtagaaaaagtctttcggaaaaaaataatatcttaattactgtcattatctactaataacttaattagttaggctaaactatccggaaacgcaaccttaatatatatcttataccacaacaagagc

SEQ ID NO: 44085 - DNA, 1501 bp, Oryza sativa
tcttataccacaacaagagctagtataaaaaagaccatgtcaaaaaaattatacaatcaaaattgacaaagccatcttctcttatgcattgtatctgttacaaccatagccactatttgttccacatttccgctgatcatgtcgctgatggaagagaggataaatagagaacaaagcaaaatctgaaaaaaaaaaaaccaattgcacgttggcttttgaaaatcgcaatagtcatatgtcccgaataacagatccatataactgctaaaaaaaacatcggtgaggctacgcctcgaataagatctgttcttacactgccatccatggacacaatcacacctcctcacaaccggatagaccaccaacgagagagagagaggaccgtcattccaaagagcttcatcatcaactccacccagacaacgacgccatggatacgaaaacatattcaaacgtgcctctatggatgaaacaccgaagcaagatgaccacggaaccaaagattagaagatccgtcatcaccatcaccattgatgaagatgatgaaagataactaaatttatttggatgaaaacctaaaccatcacctttgaattgtaggatttagaaaacgttggaataggaaaaagataagatattgatagaatgtaagtgtaaaacagagtattgcaaaacgcaggaaaaacataggaatgaccatttgaataaaccgtaggaaaaacacaagaattagatgagagagatagactcaaataaaatttaccaagaggttaaatctcttgctaaacttcctccataatctctataggattgtacattccataggaaattcaaaggattagatatgattcaatccgttgttttaaagggcttcataggaaattttcctataggattgaaatcctctaaaattcttatgtttttcttccaattcaaaagggccctgatactctttttgtttcaaaatacgagcgttcgttctggtgagattgggtgagaaagcaaatcatattccgcgcgcacgcttcccaaactattaaacggtgtgttttttgcaaaaaaaaattatataggaaagttgctttagaaaataaaattaatccatttttgaaatttaaaatagttaatactcaattaatcatgcactaatggctcacctcgttttgcgtatcttcctaatcttctcaatccccttctcctcaaactcaccgactttatcctaagtcaagctcctctaaatttgatcaaattttaataaaataatattttctacagcaaacaaatatattataaaaaatatttaataatgaatttaataaaataagataagcaattgtccctttttcgctattaatttggtaaatttttttaaaaaattaacctaggttaaaatcaaaacaactcatgttctaaattggaagaacttgtcagacttaattggtactcctacaattttgaagcatcttctgacctaaatttcctagtcaaagattcaatgcgc

SEQ ID NO: 44086 - DNA, 661 bp, Oryza sativa
atatatatttttttcaaaaatagattaatttgattttttaagcaactttcgtatagaaactttttgcaaaaattgcactgtttagcagtttgaaaagtgtgcgcatggaaaataaggaaggggggttgggaaaaggggtgtccgaacacacccataattatgtacacaagtttctcatacacactctgtgtataccaactagtaaaagttataaaaaattagacacatacgtccaacagtattacacctacatttaaaaatcttatcttcaaatttattacattttaacctaaaaagacaaaattctaacaaatttttactcttaaaattgtcatattttttaaactttttaggctaaaatataaaaaatttgtatatgagactttgcatatatgtttaatactattagaagtaaatgtctataattttccgtgacatttgctggttgctaggatatattctctctccttaaaaaaaaaaggatatattctctctctacataatcaccgtgtcttaatacccctcgtctccatcgcttccgccaccaccgcagcggcggcggcggcgattccggcgagcccctctcctcccgcctccggccagtacgctcccaccgcggcggccacggggaacggcacgagctcccgcggcagggcgatgg

SEQ ID NO: 44087 - DNA, 1501 bp, Oryza sativa
ctccaaacaagatgtattcacagatattattgagtctgtatctagtagatcaatgggagaaaacttttaagtttcttaaatccagaaatggcatcaaaggaccagataactttttatacatgtcaagttcaagactgacaggagtagtgatctatagcaacaacaaatgccaatcctacttttgttttactcattgatgtattatagcatagtgaacttggctgaggccactattttagctcagtttttctccttttttttcgtaattctttgctcttttccttttttttttcgagcttaccacttcatgtactgaaacttgtatcacatcacatcacatcccaatgcttcagttgaaagcaacccaatcaaagtgcttcacttcaaagcaaagcataactaaatacaccaacaaataaattatgtgaagatagggcataacccaaagtaatttggactgcacatctgtcactttgattacaattcttcatttcactcagaaaagccacttaatgctagtctgtcacagcctgtgtgtgtcagtaataatgatcagtaattttcaaacctacatgcaaaattatactcacttaacatacataacacaaaaggggatacagaacctatgaacaagcagaccaaattgcattgtaagatgcaaacagaaaatataggatcgctaaaacaggtattcaattacggaattagcctgaacaatctagtagttagccaaactagggaggaaacagcaacacattatcaatcaaacattcacatcacgacgacgaggaaatcggacgaacacagtacatacatacctggagtctcctgaactcgtcggacatggcttccggccggccacacatcccctcgaagtactcgagcgcctccctgcatagaccgacctgctcgggcgtcagcgccggcggaggcggctcgtcgaggggcgcctgggacgacgacgacgacgactgcgccgcgcggcgagggacaccggcgaagcgggcggcggccatcgccctgccgcgggagctcgtgccgttccccgtggccgccgcggtgggagcgtactggccggaggcgggaggagaggggctcgccggaatcgccgccgccgccgctgcggtggtggcggaagcgatggagacgaggggtattaagacacggtgattatgtagagagagaatatatccttttttttttaaggagagagaatatatcctagcaaccagcaaatgtcacggaaaattatagacatttacttctaatagtattaaacatatatgcaaagtctcatatacaaattttttatattttagcctaaaaagtttaaaaaatatgacaattttaagagtaaaaatttgttagaattttgtctttttaggttaaaatgtaataaatttgaagataagatttttaaatgtaggtgtaatactgttggacgtatgtgtctaattttttataacttttactagttggtatacacagagtgtgtatgaga

SEQ ID NO: 44088 - DNA, 390 bp, Oryza sativa
ctcacttcgtgattcgcgcgggaaacttttgtcaatcaatgccaatattggcatatattgagcccccacgggtgcgatgtttttgaccggattcaaaaagttcaaaaagcatccaaacatgatttttggacatattggagtgtattgggtgcgttcgtggcgaaaactcacttcgtgattcgcgcggcgatcttttgtcaattaatgccaatgttggcatatattgagctcgcacgggtgcgatgtttttgactggattgaaaaagttcagaaagcatccaaacatgatttttggacatattggagtgtattgggtgcgttcgtggcaaaaacacacttcgtgattcgcgcgacgaacttttgtcaattaatgccaatattggcatatga

SEQ ID NO: 44089 - DNA, 1501 bp, Oryza sativa
cttccccgctggcacggaggcggcgagcatgcacaccatggactcccactggttacggccgatcgagtcgccggcgaacacgattctgccgttccggctcctctccagcatatcagttgcattgaacctaaacacctcaaatcatttggaattgaagattgagtggcaatgcaagtaactgaaaaatgtccacatcatgaaaaaccacagaaaagaaattactaatttatcaaagatgtcattggcgatggctacctacttcgggagctggcagccatgaggctgccatcgccagtagcggaaagatgagttgctccggccgttgctgatgcactggaaaccagggtcaagaaacgggcagtcctcccggtaagcagtcactgccgcggcgtccctcacccatttaccgtcggagaaaatacaatcgctggcatcggatggatgaggaaccctactgttgatcaggcgaggcggtggagatcggaagaatgactgcggtgatggcatgcgtggcactagtgtgatgatggagagcgccaggaggacgagcaagacggaggagagaagagcgtatccagaatgcatgggtatggatgtcccaacaaacggcgaccattggtcggttgcaagtcgaggtagagtaaggagctccgttgcaaatggagcgggtgatgtgatcgtctggtgggtaaatgccaagagcatgcgggattaatttgtggacatgcggataaactgggaaagccacctaaatttggcacgaataagaatgacgttgtgacgatgttgacgccggagggaaggtttaattagttgatagcccgcactttgctacgagatagttatgtagacataatccaatattggcattaatcgatgaaagtttgccgtgcgagccgcagagtgatttttcgacacggacgcacccaatacacttaaatatgtccaaaactcatgtttttggtgatttttgaactttttgttccgatgagaaaacatcgcaccacgtgtgctaatattggcattaattgacaaaagttcatcgtgcgagtcacggagtgatttttcgacacggacgcacccaatcaaatccaatatgtccaaaatttatgtttttgtacctttcaattttttcgttccgctacccacgtgtgccaatataggccaatattggcattagttgaaaaaaagttcaccgcgcgagtcacgtagtgatttttcgacacggacgcacccaatccactacaagatgtccaaaactcatgattagctgctttttgatctttttcgttccggtaaaaaacatctcacccatatgtgccaatgtagtccagtattaacattaattgacaaaagtttgccgtgtgagtcacggagtgatttttggacacggacgcacccaatccactccaatttgaccaaaacttatgttttggtgctttttgaacttttttgttccggttaaaaatatagcacccacgtgtgccatttgatgtgacca

SEQ ID NO: 44090 - DNA, 687 bp, Oryza sativa
tcgcagccgtggggctcaacatttgccaattttggcattaattgacaaaatttcgtcgtgcgaatcacggagtgagtttttgccacgaacgcacccaatacactccaataagtacaaaaatcatgtttgggtgctttttaaacttatttaatccgatcaaaaacatcgtacccgtgggggctcaatatgtgccaatattggcattaattgacaaaagttcgtcgcgcgaatcacgaagggagttttagcaacgaacgcacccaatacactccaatatgtccaaaatcatgttttggtgctttttgaacttttttattccggtcaaaaaacatcgcacccgtgggagctcaagatatgccaatattggcattaattaacaaaagtttgtcgtgcgaatcacggagtgagtttttgccacgaacgcacccaatacactccaataagtacaaaaatcatgtttggatgctttttgaacattttcaatccggtcaaaaacattttacccgtgtgggccaatttatgctaatattggcattaattgacaaaagttcgccgcgcgaatcacgaagtgattttttgccacgaacgctcccaatacactccaatatgtccagaaatcatgttttagtgctttttgaactttttcattccggtcaaaaacatcgcacccgtggggtctcagcctat

SEQ ID NO: 44091 - DNA, 742 bp, Oryza sativa
tattacgtacgttaattaatttccaaatatgttttaatattttgagtaattctcttttagtcctgtctaatacacatacacgcacgcgtaaatggttcttaatattcaaaataaaggaagaaaacataagagcatctcccttattttgaagtccctagctacaagttggggctgcccctatttcccaaggaaaaaaaaaacctccaactccagtagtagccagtagcccctatttcttagcctctattcatgtttctcttgtattttaaaatacacaatctatgtttacactatgtttaacaccacaataattcaaatataaatatttctaacacgtataatttaaccatacttcaattcaaaatttcaaagtatacaattcaaattcaacatcaaaattttcaaacatgtaaatatggtgcggacacaatgccatatactcatttttcaaacatgtaaaaaattttggagcaagagatgcaataaaattaaaatatactagtagcaaatgccaaatgctcatatactgtacactgctgccgcttcttttatgcatcagttcagtaaaaagaccttgttttccagtttttagaatattgagttattgatccaacctgtcactaactgatgcaattatcgatgagtaatgcacatcagcaatagaaggttgatttctgcaaattaatgattaaattacaagattcataaccatgaaaaggggcagaaggaagtggagcagcga

SEQ ID NO: 44092 - DNA, 163 bp, Oryza sativa
tgaccggattgaaaaagttcaaaaagcatccaaacattatttttggacaaattggagtctattgggtgcgttcgtggcaaaaactcacttcgtgattcgcgcggcgaacttttctgaattaatgccaatactgcacacgagggtgcgatgtttttgaccggaa

SEQ ID NO: 44093 - DNA, 510 bp, Oryza sativa
ccccatgatcacgaaaggacctgtatatagttaattataagataatagggggacatatatattgcatcacatgaaagctagctagtagttaatagtacatatacatatgtgtctggttaaatatgaaaatcaatatgtattgcccctaacctttcttaaatatgaaaatcaatctagcctttctacaataatgcagaattaagtttataaatgagaaagtaaacttgtgaacacagctataacaatgaatatgacaaaatgtcccaaaaaattaacaaaaaaagtttagtgaaaatcaaatcattttgcactaattttattaaaaaaaaacttcatcaatgtgatacaaacgtttcgcattccttggctgccttttaataattaggccatgtttggatttgacgaaattccaaagaaatttcaagggattcaacttagtaaggaaaattttcactgttcaacttttttttttttgcaataactgttcaaacgtttggaacaaaggatttg

SEQ ID NO: 44094 - DNA, 1501 bp, Oryza sativa
tagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttaccctcctctcatcgaaagatcgggaacccccgttgctgcatcaagtggtatcagagctcaagttgctcggtgagagattttatcacttctttgtttttacctacagcccaaaagaaaaaccactaaaataggacagacccgaaatcaccaaaacatgttgagcctttgctgttctacttagtctttgcttgctgagttttcgattgcatcgattggttgagttgctggttctagtagtttagtcctttagagtttcgagttctgctcacgaattcgtcaccgcaaacacttccaccatcacttcatttatcttcatcccgctgccaccatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgttttgacttgttggctgaagctttgagcttgctgtacaaaaaaaaagaaagaaaacaaaaaaaaaagaaagaaaaaaaaatcagaaatgaagagaaggaaaaaaaaaaggaagggaagagaggaagttgttgttgttgctgttttgtttgtgttattttcgtgctattttgagtggctacgcttgtgactaggctcgcgtctctaaagggttttgcctaggaccagcacaataccatcgttgaatgattattcaacttgctttgattcatgtggttctagctgtaccttgatattacttgcagccacctatagctccacaaatttttatctactatatcacaggatcgtgcttgttgtcggctccggtactactaaccgttgttgctgttcttgctgtttgccaacgccttttacataacaaagtaagaacatgtaagaactcgtttgcacaagtttggtagaagtggagatggacaacacctagcttcaatagttgataggacatatttcttgtgaattgtttctttccattaacca

SEQ ID NO: 44095 - DNA, 184 bp, Oryza sativa
attcctgcagcccgtccccgtccttttgctgtcgtcgccggcgtcatcctctcgggcccggcgccccatgccgcatgcatccaaaaccatgaggtgcggctcgttctcatccctttcctcccaaaacggaaggagcaaagctccctttcctcctcctcctcctttcgctttttcccctcccagg

SEQ ID NO: 44096 - DNA, 1501 bp, Oryza sativa
ttgcacccgtgggggctcaatatatgccaatattggcattaattgacaaaacttcgccgcgcgaatcccgaagtgagctttttccacgaatggtgccaatacactagaaaatgtgcaaaaatcatgttttggcgtttttcgatctttttcatttcggtcaaaaacaacgcaccctcgtgtgccaatattggcattaattgacaaaagttctccgcccgaatcacgaagtcagtttttgccacgaacgcacccaatacactccaatatgtccaaaaataatgttttggtgctttttgaactttttcattccggtcaaaaacatcgcacccgtgggggctcaacatatgccaatattggcattaattgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatcacgaagtgagttttttccacgaatggtgccaatacactagaatatgtgcaaaaatcatgttttggcgttttttgaactttttcattccggtcaaaaacaacgcaccctcgtgtgccaatattggcattaattgacaaaagttcgccgcgcgaatcacgaagtgagtttttgccacgaacgcacccaatacactccaatatgtccaaaaatcatgttttggtgccttttgaactttttcattccggtcataaaacattgcacccgtgggggctcaatatatgccaatatttacattaattgacaaaagttctccatcggaatgacgaagtgagtttttgccacgaacgcacccaatacactccaacatgtccaaaaatcatgttttggtgccttttgaactttttcattccggtcataaaacatagcacccgtgggggctcaatatatgccaatattggcattaattgacaaaagttctccgcccgaatcacgaagtgagtttttgccacgaacgcacccaatacactccaatatgtccaaaaatcatgttttggtgccttttgaaactttttcattccggtcataaaacattgcacccgtgggggctcaatatatgccaatatttacattaattgacaaaagttctccgtcggaatcacgaagtgagtttttgccacgaacgcacccaatacactccaacatgtccaaaaatcatgttttggtgccttttgaactttttcattccggtcataaaacatagcacccgtgggggctcaatatatgatattggcattaattgacaaaagttcgccgcgcgaatcacgaagtgagtttttgccacgaacgcacccaatacactccaatatgtccaaaaatcatgcttttgtgctttttgaatattttcattccggtcaaaaacatcgcacccatgtgggccaatatatgcca

SEQ ID NO: 44097 - DNA, 1501 bp, Oryza sativa
gattggggaggaatggggaagtcgggtgggggagatggacacgatgctgactgggtctggtctacaagctgcagcgtccaggggcaatatggtcttttagaaatttctctaacctcttttgcctcggaaattataaaatattgcctctggtgtcctacagccaatttcacaactttcatagtgttcgtgagcagtggcacgattttgcggtgtctcacagccaattacacgatttttggatgtcctgcagtaaattttgccaatgcggataaacattacctgcacgagctttctgttggaataaatgggctaggcccaatttaattcaattaaaatctcaagagcccacaagtaatgttagagagaataatactggcttgaaaatttaggtggaagaacctcaacttaaatagggtgatattagagattccctgttgaccggttgaggtgatggttggactgccacacgcatgcgcgcatgccaagtcggcctcggccgtgggcgtagcgaggcgaggcggccgaccgagccgagcctgcctgctgctcttccgttttgaaacagacgagaataaagtcaccattaacaaatgaaattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtggtaaccttcacaacaaatgatatttatttgtgtggtaatggagatctctctctctctacatataacacaaggcagaggctctcaaagtatgtgtcttcctcctactattgttccttggcgatactctccttctgttcctacgctgtctctctgtttccccggttctgtttatcccacgtgcaagggtgatcggaacgagcaggtgcctccgaaactccgtccgcttgagaacctgcacgggtaggcgggcgatcaagtttttgggtggcgcttcaagcgcgactgctctgcatcatcttcaccaacatgtcgacaaccggtgacaacaccaacaatggagacaaggagaaggagcctctcgtcaacaccaacggaggcaatactgcctcaaactccagcggagggccattctcggggtataacgtttcactattaccgttcgttcttcgtttcctacaactgtctgtcgcagtattattgctttctcttatctatgttgttgcttattctatattaagcatgctcatgttgtacacatctagcactgtcactagatctactcaaattacaaatgtcatgtttattgtcttaatattttggattaaaatatgccgaattatgaccaaatttctaacaatccaaaaacttgataggtctttttcggtagttggctttgctgcattcctaaaaccacatgcttttgatggttcaaattataaaagatggaaagcacgtacacttttgtggttgacggcga

SEQ ID NO: 44098 - DNA, 1501 bp, Oryza sativa
tagtactccctccattccaaaatataaggtataaccacccctaacccaaagaccaaaaaataattattatcatcttgtagtttggatcatcctaataaatacaatgcatgcatccaatagaattagagaatatgagagtggaggattttaaaaagtaataatttaatggagaatgggtcatagttaattgcctacatgcatgcatgccttatattatggaacatctaaaaaaagtggttgtgtcttatattatggaatggagggagtatctacacttcatcgtccaaattaacacacttagatttgacatttgtggataatcaactggcttgtgttccgcaagcatgccatctggattctggagatggcaagacaggaatagaacttgctcctctccaatgcctagtgctgaagagcaggcatgtgtcttgcttgatgggcgcacggtggcagaggtcggagcctggggaaaactcttgtagattcatgatcagagcagactggagcttgtgtggcacacaggcatgttagtattctgtctagtttttgctaggactaggggcaggatttacataatttcccctgtgctatgtgctattgcaaggtactacatatgtactaattaggatttaggactgcgattctaccttcaagtagatatattaatttaggtttgtgtagagtagtttgtgcatgtgctggaagttcactagtcatatagtgaagagaaagacatagctaaaaggagccacacatccactttcccattgggaactaacaaatgcctactgtagacagctggatatattgttctgatcgacctgacaactctgactacatttagaacatgggctctcctatactttatataattggtatcaatccggaatatattccggtctgcaaccgcaagctactagcttgggttgtctgctgcacgcaatttgcaaaagataataggtagtaagatgttcatcatgagagccaaacgcatagattatattcgagtattcctaatgtgaagtgctatgtattaatccattaagcacccatgtattagttctctccattttccttcttaaaagtacccttctctccagagtagaccatatccagtgcgccatttcattatgctgcataggatgctctggtattagcatccttctgataagataaaacgattatattctaataaacacccttgctgacaatgaaataccattgacttccgcgaaactgctttgaagaataccagcggatgatctagactcatgtttttttttaatatagctatatttttgtgtaaatatatataattagaaaggtaacaatcagacacgtctattgttggagtatattattgatttagtttattactacaattagggagccaagacaataactacttggtttctcccatcgaatccatctgcttggtttctcccttatgctaaggttgctgctgtgctgctgtcgctgcggtcttcggtagtccatgaga

SEQ ID NO: 44099 - DNA, 156 bp, Oryza sativa
tgagctccgtcgccgctggctccctcgtcgcttgcccgcgaggagacgagaaggcgagaatgatacgcgaagccgagacggagtgtcggtttcgagaaaaataaggagaatatatatgggagattgggagtgcgacaacgaggccgccggggacga

SEQ ID NO: 44100 - DNA, 1501 bp, Oryza sativa
ctgatacaaaacagtgcgaatgtagcagtctgcattcaatgttcacgttcttcagccgcaattttcaatccacaatccagtctgcatttagatcctgaaattgagaaaaagtttgacagttggtagtttgaaaaaaaattagagtttatgtgattgtgatgtgatgaaaagttgggaatttggaggaagattgatgtgaactaaacagggccccaatccacgtttagttcacacacaacttcccccaatctcccaactttccatcgcatctccatcacatcatggtaggttcatggtaggttgttgtatccacagatgcagcactacagcaagatcagttcacgctcaagtttaacacaaatagaaagacgggctgttaagatagacaaaatcagagaacataaattatatcaaatatggcaaaataaataaatctttagtaaccgtttttgagatgggtgcgtaaaggccgtcagttaggagcgaaagactatttattcaaagtaatcataaccactagggtttgatcatctgaactatgcatttttgctcatcactcgaccttgcaaccaatttacatccacatcggcatcaaacctcttaaaaaatcatagtttttaaaaccatatcaaaaatcaaaataagatttttagtcagatccaaacaatgataagagacctcagaaggaaggcagtagtagggtatgtcctcacaagatttcagagagaaaggtttccacattgatcatcataggcctcaaaagtaaacgaaaaggataaagatgacgaaaaatacaacacaatgacatgcatcaataaatctgacctcatagagaagattaggcttttccacatgaaaattcagacatatgcttgtctatattttaatctaatcatcggccaatataactgcacaatgaatccaaaagaagagccaaacgaaagaaaatcaccaaagaagatctgatctcatgaggaatcgaaaattgatttggttacagaggactcggaatatgggtggtgatatatcaggatggtcggcaaggcaaaaacaatttgccagttacgacgaacgagaccaatagatacgatcttcaccgtcctcgacaccaaaaacacaaatcaaatcccccactcgaacaacgaaaaagtaaattaaccattgcaaaatacctggcaaaggaaaaaccaaacggaaagaacaagatctgaaatcgcagatcaacccgagacgagcgaacaagaagaggaagcagatgcaaccatgcgaaagaagatagatagcggcgtggaggatgaagatgatggagacgacttctcttgctcgtgcttatatagaggcatctggggaattagggtttgactccttgacggcgggggagctcgactcgtgcagttctcgggagccgttcgattagtgaatcgcgaccgtccaatcgtgatcggttggagtgggcccaaaccgtcatgttcggcccacaaggcccaaacatatgggccca

SEQ ID NO: 44101 - DNA, 1501 bp, Oryza sativa
acatctgatttcgaagggtagcaggggagataaatactctcaagaagaattggcacaaacgttgtccagttgaagataccatgttgggagggcatgtactgtatgtacagtggtgtagtcgattattccccttttggggtggctaattaatgtctctatcttatatgcaaataccaaagtaaataggatgtgtgttattacctcatgcattcaagtgtttgctcaaaggcactgttcatggtaatcacaaataaatccttaacaagataggtcggatacatttatattgtgtgtgcatgtgcaagaaactgacttgcagatgcagagatgttcagggaacatatgtctgaagcgtatttgatggacaatcttcaagaatttagacattcaggggacatatgttgacattgtacataatatttgtactgttaatagggaaaagttacacaagattgtatacaaaactccatgggaagatgtaccttttcctttgtagccagtcgatctcaagaagggtactcctggagttttggcatgtaactcctggttttccttgctttaataacagaagtcatttaatgggtaaaccaagcaagtcagtaggaacatgcatgcatataacagctaaagcaggcgtaatttgttatctcaatatatttttccacctaatgtaaagcacgcttattaagtattactcatgatacaatacatgatactactatctcgtagtagtctacaatctggaatgtgttttcaccttgctaaagtaattatgttggagagtttgtgttctatgaggcatcaacactagcctatagtaataaagctatcatttcgagaacagtagggaagttcacaactgaagtaaatttattaatacattaataacagtagagtcctccagacccaagtgtctaagagaagcacactgtctaagagaaaaaggattttcattaaccaagcatgaagaaattagcatttgaccccaagtgaaacagggacaacgaaacatcagtaatgaagaattcactcattcagagctgataggcaaagtaattgcatatcaacattttggagtagttaagactgcagaaaatattcatgcatgaataataatggagcaaatcctaacaagacaatatgtatattaaaaaaaaatattaaaccaaaatattttgcttcttttggaaggctattggaactgcacgtcgaacccaccattatcacccatagctgacagacatcatctatagatttgtggcccatatcttatgaatgaccttgtagagcaacttgtcacaccccaatctgataccgccgtacaacggcacctgacaggagtgtgtcgtagggaaaacggtgcgaaccgcttcctacgaaaccgcgatctcggtaccagtcccaggacatagtgctggtacccacggtgacaaatatgaatcatagcaatctttaaaataaatagaggacttatttaccttaacttaggctgcagctcaga

SEQ ID NO: 44102 - DNA, 178 bp, Oryza sativa
ctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgacgaactcatgtcactcatatgtc

SEQ ID NO: 44103 - DNA, 544 bp, Oryza sativa
tgtgtctcttatcctgttgtagattaggggtttactggtgagatgtaaggtggaaaaaatatcactattgcagtttatgtgataggatatgcttcattgttgtgtttgggagctaggataacgatactatgcccatgtttgatgtggtgaacccagttatttcatattagtgatgagctcacttgcttgatatatggtatggtattgctcatttagtctgcttagaaagtaaaggtgagaagtcgcagcttcagttgatattaccacttgaacagagcaagatgttatgtaaattatttatttggttatgatatttggaaattcctaaacctcctcgattgctcaagtgaaccgcaatgacagctatttttcaaaaaacattgttcaacaaaaagttccaagtgtaacgtttatgttcttattcctgcttttcgcatctgatacttgccttgcacaaaaagtatgctatacagatttgacatctctcctcatattgttgaagcctgataatcccatgttctgattccctttacgttttctatga

SEQ ID NO: 44104 - DNA, 1501 bp, Oryza sativa
aatataatctgtatgcttaaacaaaagtatgctttatctatactctattagccttaacatagacatggaagaaagaatcttgaggatatgcaaacagagaaatttagatagtacatgccaaatttacataataaagacatacaaatttaccaatcggaatacatcaactgaaactcccatcccagcactcatcagcccaacctgttcaaaattgaaattccctttagtgtactactaggctattaggagaaaacaagataatatcacctgtaaaatatcacttgagttccagaaaaatgctaacagaaagaaaggaacagggatataagaaactttcttgtgcaccgtttattttaactaggagtttttgtgattacatctatgttatagaagttaaccataaggtcctaaactcctaataatcaaaccaaagaactggagatttatatgaccacaaaaatataccgtacatctaaataactgaaagaaggattacttacattcacccgctctattctccgcatttcattctcaaggagagaaagctgtgcagcagaagtccagtgaatacagttgactgggctggacatggaaatataacacacatgaataacacattcagtaatctgttatgaacagataaacagtcctagtattatgctgggttgggtttcagagcatcaccaactatcaatggcctcctgaattagctctgtgctacccgattgggaatatactcttgacctcccataatcctcctcgattctaaatacattggggcacacattggcacaatatttgcatcctaaatccacatcaacaaggtgaaatatatcaaatctctttatgaagaaccaaatagcatcttttatagctctattcataccaaaaaatgtcagtacctatgcaggtaaactcatcaacgaacacctgatccttgggtgcactgtcatcgaagaaagggttggtcgcggttgctgtatacccatggatttcatcatacactgcacgctgcaccggatcactcagcacctgctcttcaacacctcatgttagcgttttgaacaaaaaagaattcaatgcaaaacacatcttccaagacaattgccatatgcaatcacaaggacccaaggtttcattgaagggttttaccgtgtaaacctcgttgatgaacatgcagaagtttgttacttcggggttgtccccactgaggtcgggatggcacgctttcatgcaactgtagtatgctttcttgatttcctcaggggttgcatctggcatctggagatgcaaaaatcaggggtcattattagcagcaaatccgtcgtctcaaaggaaaaccactatcagagtatcactcatcactcatcagaagttcagaacaattgtctgagtccactctgaaaaaaagaagcatctttcctccctcaccaaaagtaggatttttttttttacagagaagaaattgatctctaatgattccagtctaaaatgcacagtt

SEQ ID NO: 44105 - DNA, 513 bp, Oryza sativa
ttcctgcagcccggcagaggctgcagcagaggctgcgccactgctgtcagcgtcctggtcaggcacagtgctgctgtcctgtagcgtcgattccagtgccgcctccccatgcacgatgttgccatgcacgtccccatgcatggtattctccatttcctgctcatgtgttgtaccattttctccagaaacaacatcatcagcatcagacacaattaaattattactaggtaatggaatattagccactggtgtaactacatgtgtgccccctggactagtcgtattataatttgtcatggaggaaggcaatagaagaatttcagacctaagtcttgctcctgcatttgagtgaagagtagaaaagggaaatatattttcatcaaagataacatctcttaagatgtagacatggcctgatgacacatcaagacatttaaatcctttgtggtgagtactaaaacctaggaacacgcactgtttggaacggaattggagtttatgtgtgtcgaaaca

SEQ ID NO: 44106 - DNA, 1501 bp, Oryza sativa
tctgtcggcagtctgcattgccttacttaagtaggattttattaatagggtatccacaattcttcactgcactgaacaaaacgatgattgtgcctatagtcttgttcaagtcagtgcaaactgtgaactcagattgctagggtggctcatactgagataaatttgttaaggttacattgcacagcactagcagccttgtacacgaattttaattacggttcctagcaacgaaatgtagcatgggaaaacatattaagcagatatatcatatttcttaatgcacataggttcagcagaattaaccactttatcgggcgtcccattgcagcatcaattcaacagtgcggtgaacaagcaaagtaaggtcagaccacatcacctcgcggaaggtgaaccgctcgttgaagagcaatgcgagcacgaaggcagcggcgacgagcaccacatggcggaaggtgtcctgatccttgtcgtacgtgcgccgcacctgtgggtggcgccgcatgcaccacacgatcgccgccgagctggtgatgaaaaccaccttcatcaccgagttgtagagcgagatgtagtccgtgaacaggtccatgtacctcgccacgaacaccagcatgtacagctcctgcgtcttcctcgacacccctgcgccaacacacagatccgtgagcggagaatcccccccacccccaaccaagcggccgaaaccctacccccactgtacggctcgggctcacctgagcaggatttcgtggcgtagatcttgagcaggaggacgaggaccgagaagaggtgggtcatgtccccgaggaaccgaaaggcgttcatggctgaagcggcggcggcgggccggcggcgaaggcgacggcggggcgcagtggctagggtttgggttttagagctccagatgcggcggaaaaatggcggaaaggatgcgtgcagggcaccacgacgggaagggacgggaagggggagccggtgctgtgaaccgacgtggaccggctgggatgtagggcccacatgtcagcctccgttggtccactgaaccgggaccacgaagagcgggaagcggagggaggcgcgatccccgtgcgtggaccggcgtggggcccactcggcagcgacatctgtgccccgtcgcgacgtggaacaggtctaggcgggggaggatacgtgggcccgcggcggcaggtgacgtggcgggacacctcacctgcgtaggtgacgtcacctgagcagcagttgccttcttttttttttttctctttttccactggctttgccgctcgtatgccgctgaatttgctgctgctgctgatgctttgccgtctcctactcctactcgtccactttattaacccttattaaatccaccgtcctcttcctcgtctcccactactacaccccgcctctcccgccgcgagatccggctccgcttccggaagcttctggaagggcgtcccccccacatgagcgtctgatcgatcggccgtcgtcgcca

SEQ ID NO: 44107 - DNA, 362 bp, Oryza sativa
tgcacccctcttatttcgtgagttaataaatctttttcccttgatcccataaatcaattctctattccgaaatttcatgaatcattttccttataaatcatttcctttggtcccgcacgtcagagacggtcaataatattcttgagaatattatttctataaatttcatgaatcaatctcccctggttccacaaatatcttccttcgccagaaattccaattaaacttccaaaattcgtatctctcgatccaatcgtccgattgaccccgttccacttccagtatttccataaaatcgagatctatttaatggcactattatttagtctaaatagggtctttttcttggtctcttgtttagg

SEQ ID NO: 44108 - DNA, 997 bp, Oryza sativa
acaatgagaaccgtttgatgggtgtagctatatttatggcgccatatttttcatcaaagaatagtcggtatgtatttacattgtaagtccctaaattacatatgtaattttagtgtatttacaatgtaagtctcaaaattacatatgtaagtactaaaattacatatgtaaattcgaaaattacatactaattacatatgtaagtgggttgtaaatgaggtgtaactactgtgtaagtggctgaaaaaaaatcgactgtagcatatggcgccatatttctagcaactccgtagtttatttgatccaaatcggcatcaccctgtgttgccttttttttcttccaacaacaaaacttattggatatgtgcctgtcggtatatgtcagagacgtaaaccatttattccatcaccttaaagaaaaacacgaactaccattgtcaattcaaaatcagcaatcaaatttgacgaattaagttacacctttgacagttcacgcacctacgtgcttcacatcacattctgcacagcaacaacacaattcgttcaacatgcagtcaaatgcagatgtcaccactcacaaaatgcagcaatatctactaccaccagattatgataaaagtaaaattacttcaagactaagtttatacataaatacaaggaaaaagtatggattaccctgaactatcacggttggctgaattaccttctgaacccgaaaccagacataacgcaccctaaacttttaataccggatgaattacccccatcgatactattttgagcggttttgacttgagcttgtacacgtggcgccaacgcggcaatctagtcagaaaaagacttcttgggcccacatttcatctctcttccttcccggtctccctctcctcggtcgcgcgctctctctctctcccatgcacgcggctgcggacgggcggtgggcggcggtgcgcggggacgcgccgtgggcagtggcgcggggggacgggcgaggcga

SEQ ID NO: 44109 - DNA, 1501 bp, Oryza sativa
cttcttcagctgcagattctcctgacgcagctccaggatcttcatgttgttctcgaccatcccacggcgcaccatatgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgggagctgcctgccctggtagtccactccatgcggataccccaggacaacgcacatgccccgctactccaaaacaaagccagtcaggtccagaccacgacggttgatgctgccggccatctacaaacaaaaacaaaaagaaaagcaacattttaaaggtcagattttgacgataaatgaagcagtaggacagagagagactagaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtcccaggaggcaaggtacactaaaagttgatacagttcagagtttaacaagcggaagcgtaaatagataatttattacatgggcagcgaaggcccagcacacaaaaagacaaacaggaaacagcggaagactagggcgacgaccacaggcgcttgacggcaggcacgagctagacaccaaggccttcatcttccagaggctcctcttctgggtttgggaaaaattgagcaagactgagtacaaccactgtactcaacaagacacacccacaagtgcaggataaatgcaagggagtacaagggagttataatataaagggttagggtttgcagtaaacagcattaaaagacacttagttgctcaaagctattttgtaaacacgattccagagttataatcaaggccgtgaacccacacgaacctgccttaacccaaggcctacgatgattcaaaccgaactggcaacccgaccctgggtcccagctcgtcccaagccaacccaggccaaccattccacattttagttgtttagcaggttttaagaattaaaacactaacttgggtacattgctcggcttgcccataaccgagggcgcggctattcgaatagattatactctgatcagaggtgtacatctttacccacaagacacattttcctcacgtgtaaccacgtgccacataccaccacggtatacggacggaagacatgacatagtttccaacccatccta

SEQ ID NO: 44110 - DNA, 1501 bp, Oryza sativa
aaggattactcacaaagaggggaagccgttgagccacctagctagatccaggcgtcgtgaggtcatgggtagttagatcaggtgaccctgatcttggggaagatctgacacccctcgaggctactgcgatcgtatctagagggagcatgagctccacaggggggtggcggtgatggtgcttaggaggtggagggggaggcaccggtcgtcctttgtagagcgagaaagatgtgtcgccaaaagcctggaggggaggcactagattcacctacccagagttagggcaactggatctggtgtctctagcatcctgtgtcccctcatcatgttgtcgagaggctcacactattgcgagctacgtggaggacccgagcttcttgttgggccttatgtcgagccttgcatcatcggacggatgaaccacctggccctcgtgtcatcgcacctttgtgtggtctccactctctcgattgaggtggagaggataagggggtgaaagataggagctgagaagacgaccgagtcttctatcaagaggagccatgtaccctagagtctgggatacaaccaaattatggttatccactactacagaattgattttttctggatgatatcccctttagattgcatgtggaccataactgctcccgcctgcaaaaatcgctccatcatgatcagttcaaggcatgcggccacttaagagacctgcttaggaaaatagtcttattttcccaggtaggcctcttaaatgaccgcatacggaagtacaacttcgcaaacggacttcttaaaagtctgacctccctcctctcttttctcttagcatcttcaaaatttttcaagtctttatccttatctcctaccttctctctctcacctctcatttctccacaacctcctctttctctccccgctcatttcccccccccctctctcccacttcctccaaatccagcccagcatcaagagcaccagctgtcccgggtgcgagacagccatggggagcggcgagcaaactcgacggttccccatgagcaggacgcagcaagggagcggcgaggcatggagcagggctccagttaccaggtgaccactagccatgactcaggtaggcgacggtgacgacggcagcagtagggagctcgtggtgggagcgacgccagcgagcggatccgccgtcattgccctctggagcaacaccggcatgcagatttgacagcctccatcctcaggaatagcggcggtgggattaggaggcgggagcaagcaggcatgacgacggtggcaatggcggtgacgacgttagtggcagttctgacgacgatgacaagctagggtttcggtgtttttttgggatttttatttttttccaccaaaattattttttttcacgcggtcggtataggtgaccgcatgcgaaaatcctgtttttcatgtgattaggctgcccgcatggaacaatattaattttcacatacacctaggtgcaggcgggccg

SEQ ID NO: 44111 - DNA, 1501 bp, Oryza sativa
acatgattttttgaacatattggagtgtattgggtgcgttcgtagcaaaaacattgacgaacatttgtcaattaatgccaatattggcatatattgagcaccgacgggtgcgatgtttttttgaccggaatgaaaaagttcaaaaagcaccaaaacaagatttttggacatattggagtgtatttggtgcgttcgtggcaaaaactcactttgtgattcgcgcggcgaacttttgtcaattaatgccaatattggcatatattgagccccaacgggtccgatgttttttgaccggaatgaaaaatttcaaaaagcacccaaacatgatttttggacatattggagtgtattgggtgcgttcgtggcaaaaactcacttcgtgattcgcgcggcgaacttttgtcaattaatgccaatattggcatatgttgagcccccacgggtgcgatgtttttgactggaatgaaaaagttcaaaaagaccaaaacatgatttttggacatattggagtgtattgggtgcgttagtagcaaaaactcacttcgtgattcgcacgaagaacttttgtcaattaatgcgaatattggcatatattgaggccccaccggtgcgatgtttttgaccggaatgaaaaagttcaaaaagcaccaaaacatgatttttggacatattggagtgtattgggtgcgttcgtggcaaaaactcacttcgtgattcgcgcggcgaacttttgtcaattaatgccaatattggcatatgttgggcccccacgggtgcgatgttttttgactgaggggaggagtttaggggaggagtttcctaacgaatccaagggagagagagagggaaaaatggggggaaagggagaggggatcatggggaataattccccccactttattgcacgcggggacggcgggaggcggcgggattcgcggcggcggcggcgatagggcgcgggggaggcggcgggagcggcgggaggaaggggatgacgggtgggccccacccgtcagcgagggtggcgggcgggcccgcccatcagcggcgcgcgcgccgggagaggccgagtgggccgcggggagaggagagagagagggggggggagaggagagatgggctgggccggcccaagggagggaagggggacttttagggtttttctttttataaaatcattttaactttgtttatttcttaataattattatttgtgctctgaaaattccactaaaatttatttacgcattttaggcttttaggaaatttacaaaaatcctccaagccttatttgacttttaactttgcacattttaattgttggaggctttcacatggattttaattattctaggcatcatttaagggatatattttagagtcgttttgggacgtgacaattcttctcaaaaacagtcagagatgtcaacgatctgattgagaagaggctcacaaatacaggttggagcaaggaacgactccaaaccagtcaaacgcggta

SEQ ID NO: 44112 - DNA, 1501 bp, Oryza sativa
aggactatagcctaataaatttagaatggattttaagaacgatatattttagattggtttttagttatcatcttaattagcaacgatcatgaaaagagtttgcgatgaatgcgaccaagaaaatccggccctgtaaattaattataaaatcaaaatttagaatttaattaaaatcagcttcaaattattcttttttgtttgttctttagggtgatatcgatacaatttttaatgcatatatttgattgtttgtattcacatgaagcactaagaaacaacatggaaatatgtttcatgacgtacataataccatattttcactcataaaggttacatgccgacgacgtacgtcgttttgtatgaaaactatgaactaataactcaattgatggagtattccattatcgaaaaaaaaatcaattgatggacattaagaactgattcaatttgatagctttccatgcaccgaaacctaataaacacttaaatacattgtatgccgtcatcgtctcatatatagatggctcatttcgccttcgaattgagaagctagttgccaagaaattaattaacctgtgcgcagtggtgattttgctacgtgttacatggtgcggacactggtggagaaaccatctttcgtcggtcggccgatttccacaatagtcccggatgcaataaaaaccagggttaaagatgatctttagtcccggttcaaaagggtaacgggcatatttgatctttagtcctggttggtaacaccaaccgggactaaagatcatctttagtcccggttcgaatgctgttagggcatgttaggcccccccgggatctttagtcccggtccgggactaaagatcgtaactttagccctagttggtattaccaaccggggctaaagatcctggtgatctttagccccggttggtgctactaaccgggacaaaagtcccacccctatatatatgtcttcttcctcctccagctgcccgagcaagcttcaaaatttcttcaaaaaagaggggaggtcatgccaaaaattctattgaatttattttggtgattacatacaaatcggaggtgcctaaaaggtttgcaacttattcctccaatgttttttttgtcatactacatttgcacctatgtttttcacacttttttttgtctccaaaatttaattgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttaaaaatagtttttaagaattatttggtgtaatattttatgatttttgtatgaataaagatatcttataattattgtatgactgtcattattgtaagaataattatttgtgtacggttttttttgactcatgtaga

SEQ ID NO: 44113 - DNA, 1501 bp, Oryza sativa
aaaagcctagaactagtgacatccatcatcctaccttggggctgttgcataagttgcttggtttcatgttgtttcttagagctgatatccagatagtttgtgaagacgaactagtcctcttgtatgccatggttaaaaaaaaaatcaaagtttcacctgttcaacccatgatcaagcaatggttagaaaatatgaagttgtctggtccttttgagtgtatttctttggtgactcgttcagcatgaagagttgggactatgctttataagcaagtattcctatcacccgctcttatgttgatgaggcctatttagttcaatgccacatactcaaacatggtccaaatgattatcttatatttttgtttcccggctatacaaataagattcctttacctaacccggagtttcatttgtgtaattgccgagaactaaccattccactccaattggagttgcatcgtgatgtcccacgcagggtaacatgacgaatgtacagagaagcacctcaggaggcgtcttcctcttcaccaccagtgtaaatgtatggggactattgggacgctggtggttcgtcctggcagagtgccagcgacggccgatggcatgagccgtaggagctgcactggggatactcgcgctcctccaattcaagtggtccaccttcatcctcttggatgtgtcgctgtctcctctcgaggggatctgggagaactcacccggaggatggatacacttgaactgtaggcagggaacgaacaacacaccttggaggataatgtggtacagtcacgggaatggcaacagtctgttgatgcacaggttgcaaacttcaacactatgatgcaacaatagcaagctgactggcaagcgtttcaccgctaccagggatttgatccccgccatgagccatagcaagaagcaagcttgggggggagatgtctctccccccactaaggtaacttgtatcatattgcatatttccctttcaaattacatgtttaaatttttgcattgcatttataaacctgaaaacaacataaaaatttgcaaaactaaaaataccaaaaagataggttagatttaatatgctaggtaagacatgcttagttcttcatgttgaaatgatgaatagttgctctgttttatatctctcatatatgggttcatggttaagtactctctcaaaatttgaataagggtagcctacaattatccaggaacctgaggtaagtgagctgcactttgctgatctgagtctaggttgttgcgagatatgagatagtaaataagagttgctataaataatcatgttctaagtttgacttgaattccggatgttttatttttcaaaatgataattttgaaagttcctcatttgatatgaattcctaccagagccaaaatattcatattgattaagccatatacattttggttacttgtaattccattaaattttgtcaaatccttgtgacttgtgtagatacttttcatgctct

SEQ ID NO: 44114 - DNA, 570 bp, Oryza sativa
ttcgtgattcgcacgaagaacttttgtcaatttatgccaatattggcatatattgagcccccactgatgcgatgttgttgaccagaataaaaaagttcaaaaggcatcaaacttgatttttgatatattggagtgtattgggtgcgttcgtgttaaaaactcacttcgtgattcgtacagcgaacttttgtcaattagtgtcaattttagcacaaattggcccccacgggtgcgatgtttttgaccggattgattaagttcaaaaagcatccaaacatgatttttggacatattggagtgtattgggtgcgttcgtggcaaaaactcacttcgtgattcgcgcgacgaacttttgtcaataagtgccaatatttagcatatataggcccccacgggtgcgatgtttttgaccggattgaaaaagttcaaaaatcaccaaaacatgatttttggacatattgcagtgtattgggtgtgttcgtggcaaaaactcacttcgtgattcgcacgaagaacttttatcaatttatgccaatattggcatatattgagcccccacgggtgcgacca

SEQ ID NO: 44115 - DNA, 1501 bp, Oryza sativa
ttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaagaacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgactttttaatatagtcatggtgctgtttgggttttaaagcaattgattggttacaatatcgttgctttttgccacgtaagtgtgcatttttattgaccaatattatggcttaggctgattatatattgtggtcatttttcaggcggttggtaaatcctttatgagtttatttactcggattttataccacatatgccgtatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggccttggagtaatctggttcgagagaagattatcttttcgactgtgaaggtctcaggggctactgtggagattatgggtacc

SEQ ID NO: 44116 - DNA, 1501 bp, Oryza sativa; identical to SEQ ID NO: 33031

SEQ ID NO: 44117 - DNA, 1501 bp, Oryza sativa; identical to SEQ ID NO: 33030

SEQ ID NO: 44118 - DNA, 1501 bp, Oryza sativa
aagtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctttccgccatttttccgccgcatctggagctctaaaacccaaaccctagccactgcgccccgccgtcgccttcgccgccggcccgccgccgccgcttcagcca

SEQ ID NO: 44119 - DNA, 1501 bp, Oryza sativa
ttgacccatccatttgtcttaattttgtaattcttgtccttcttcttgtgtactagcaacctgcagattgtagtcgattgagtagctgccaagacatggctaatacaagggtggctgtacttgtatgagcgagagagcgaagtttatttgtttttcattatctaagaaatgtgcggaagttgctctgatgtttctttgatggtttaaatgaagaagatgactaacttgactctcttacatgaggtttatttcctttattaaaagacgaggacgtcgtatttgtcttgatgactgtatttacatgacatgcacatcagatcaatatgttcgaaaagctaaatcatacatgatgactaatgttactaccgatttactgaatctacacatggagttgctctgcctttgcatgcacggcaaagtgatttctggtttgagataggagagtgacagatgacaagacacagtataatgtacgccagttggctgaattgccaagtggaaagtaacacccaaatcagggttagaaattagtattccctccgtcatataatataagggattttgagtttttgcttgcaatgtttgaccactcgtcttattcaaaaaatttgtgcaaatataaaaaacgaaaagttgtgcttaaaatactttggataataaagaaagtcaaaaaaaataataattctaatttttttttgaataagacgagtgatcaaagagtacaaataaaaactcaaaatctcttatattatgggacggaaggaaggagtataagagatggcgatgcatgtactgctctcttctctttggcttcccagagtgcacaccttatgtggccactaaactctgatcgatgacacgcatcagcatgactatataggtagctaatccctccgtccaaaaaaaaagacaaaccgtgggtttctgtgccaacgtttgactgtccgtctcatatgaaatttgtttataattagtattttcattgttgttagatgataaaacatgattaatattttatacgtgacttatctttttaattttttttataatttttttaaataagacgaacggtcaaacgttggacacgaaaatcagattttgtctatttttttgacggagggagtacctcgactccgataattgcagaagacggctgtcagggaaagcaggaagcatggggtccgctgtcagcttcagagttaattagagtgtggatctcattctcaaactgtcaatcaagcacctactactgctgctgctgcacacgcccgcatgcatgcatattcatccactataaccaaattaaagcagctaaagtgattaaagaggtgtggacgatcgattttgctatttgctccggtttcatttcgtgtactgcacaccctgcacttattaccatgttttctgtggccaactggccatgcatggagctgatgtgttttagccaccaattctagatctacttccttcgtactaaaataacttaacctaaaatataatg

SEQ ID NO: 44120 - DNA, 1501 bp, Oryza sativa
ggcatggccttttgatttctgtctgctgtcctgtagatggactcaatagtggctctgttatgctgttatctacaagggtgattcctgtttttcccctggcggaaattacaaatagaagagtgcagataacaagcatgaacaggttaatccatttttcaggtcctaaatattcatgatcgagtaaaatagacctgagatcaaataccacactggtaattgattgcagaaagctaaatatccaccatgctcgaattataaacggaagctttgcggatttcgtcttctgaaaactgaacactactagtgataatattatccaggatagcacctgcacactttcacctagaacaaatgctggatatttgcagtcacttatgcttccttgtaacaacaaaactactatcttcagagtatgacttgctaagttaagcaggcaacaaactttgcttgcttgatatgttatacccagctttttgtctgtgttcttctgttcctgatatgaatgcttgctttcagcagttgatgtcttaaatctctgcctgcaccaccttattctcttatacagaaactgaaccaagatactcatgatgaatatcaggtgtatcagtgcaaaagcgtccatccagaagcaaggtgagtacatttcttgccattcttgcaaatgttgcaatttagtggaatctgtaatgttgcaatgtaaatttatgtgttaagaactaacaggagaatagatttgttcaagagtcatttttcatatacccttttatcaaaagcttttactacaatgaaccaacacaaagtattatcgttggcttccagctaaagatacaacttctcctaggaatccagtgtactgaaaagaatattccatttccctaatgacaccataatatttcttttaatccattcaaatgttttgcaaccataaatccatgatatctagtaatgttatgtaagagactgtaatatctaataatgttctggatcgtttcctgtagttatatggatttttcttttaccaaagtagttatatggatatgagaacagaaagttaatcactgattgccatgctgagttttccttaaggaacatgtgtatggccacaagcaaatgtatacagctgttctcatagtaaacatgtaacttctgcgtgttatcccacctatcaacatgaatacgtttaacagaaccacgactgttatgaactgcaaccacgtattggtccttgctgtttcctgtctgctaatggttacagatgcttggattgttcatttgttcacattcttcttatccatgtgaagaatgtatgaactcacccaacatgagaaccccaaacttatcatgaacctttcgttttttccagttcccctaatttcttttgcaaacattttgcagaggcaggaaaaaagaacaagaagggaaaaaggagaaacaaagataatagcaaagaaaacccatgcagtgcaatcaaactcatggatgtctcggcggggaggaatca

SEQ ID NO: 44121 - DNA, 827 bp, Oryza sativa
ttatttagacttcattctcctagtcctattcctgattgttatttcggattctgtgcctgggtggtatcttcttactattgattcaacctcttcgggcaaacgttgtcacttcctttatttgaaaaaaaaggggtctagaactacagtgatctgataccttcttcccttggtctgggtaggtaggttatgtaggctacaactgttcataggttgttcgatcgcaaaatgccaaataatcgattactagtatgccggatattgcctggaggcccttctccctatgtttgactcatcctagatgggttcacacttgtcgattccggtcaaagaaaaaagctttttcacggtcccatcacaccaatctacgccaagataaggaatgctgggttgccaggaacaaaccctgtgattcaaggttttgcctagaattgccttaaaaaaaatgcaccccattaattgatccctctttagggtagtataagtacatcctcgactatagcacgagtagagtcgagttctcgtactaacctaagagcagatatgccgaaatatttccacgttcaagcagctaattagtaaacgacttctccataacagtttgaagattggctcgcaacgcaagtagcggcaagaaaggagagcaagacttccttttctaaaagaagaaagaactagacttctataagaagattttgataatcgtagatcgtggaatattcatctatcttattaggtaactactttagctgctctcgaaactgaaccatcgtgaatagaactagcgcttaaggaagagtaggatctgttagcaagtcatattcaatcac

SEQ ID NO: 44122 - DNA, 1501 bp, Oryza sativa
aacgaaacaaaccaactcacaaactcccaccgccgaacagaggccccctagtagatctgttgccgtggtagtttcaatcgggttatgtacttaaggtgtgtgtgaaactcacgaagatgaatattaagttagcgtatgtaaaacgaaaaagctattagcatataattaattaagttttaattattataagcttgacaaatgaatatatttgatattttaatataacttctatataaaaagttttcgtactaaacatatcatttagtttgaaaaacatgctaacaaaactgaaaaacgtgctaacaaaactgaggtaaaatctactccatatgtttacgagaaaagaacaggcctgagtctgtgatggttctgttggagatagaaaaacttcgagttcagaaagttaaaaaacacgtttgtctccctgcgcaagaaaggaagcataaaggaaaagacacgtttgtttcttactccctgcgcaagaaagagggagtcgagagttaactcgaccacctccaccgagtcccaacgtccaggactccggggcgtgtcgtcccgtgttcagttttccctcattacgtcaatcttcccgtcagacactttcgtagtaatttcgttttgtcgggtttttgcacaaacggaatccatgcgaagtgagcattccattctcgagcggttgcgacatgagggatagatgtctctatttgcgacatgagcattccattctcgagtgtccaatcttctgataggccggttcgttttgtcccgtgttgatagaagtctcaaaaaaacgtacggagtataaacgtctttacgttgttaactcgaaccggcctattagatttagacactatccgcattaaaatctctatttgtttagctgagtttctaattttaatcgacgtctgcatcgaattgtaggttgtttagtttaggatacaacacgcaaacaacgtatagtcgtttattttgttgccgtacttatgatatgcttgaaaaatacagttgtttaccctcatagtcgataataagttatacaattccacacttttagctcttatatacgaagatttgttcttcttcctttgctccaaatagataaattacaccctttgtgttaaatatgtgatccgaattttgggcccacaatattatcggattagtttcctagtagaagtcctattaggtgtctttcttttatcccctatatatactcttgtaagccgtacgggaaggggtgacgttcccattacgattcccctacgtttataatcatctcctctatagtgatcattgcctgtcggcgcccgtggttttttcccgcaagggttttccacgtaaaattcgtgtctccgttgtacatctatttttataacaagtagtatcagagcattggagatcgatctactgcagtcctggccaccggcgatttttcccgatcatagaaatcgatctaatcggcggcacacatagtcgtgttcgtcgttccgtcgaaattctg

SEQ ID NO: 44123 - DNA, 1501 bp, Oryza sativa; identical to SEQ ID NO: 33824

SEQ ID NO: 44124 - DNA, 1501 bp, Oryza sativa
ggcttttaaaccagtaatttgtcacaatgcttttattagatggatgcaaaaattctcagatttcattagatagtggtattaggataatttatgataaacaattatggatagtttactgaccttggtttttgtacactagctttttggttccttacaacagtgagatattttacaagctgcatttttcatgtgtttgcatcctctgaattggattttaattcatagtaaaatattaaggcaagttgtttaatgttcatctcaattataaacatttgtgttccctttcctgtatatgtagataatgcacaaatattgttctactacttgcaggtgtactgaaattatacttcatttttctcgtatacttgtcagtgttgtgtacttttgaaaaaatcagctaacttttagttaaaattccatattgtttgttagagttctaaattcttctaattttacactttataggatcctacagcgagtttactgcagatcaatgacatcacctgaagtatctgttgaacatccacaaggtaaaactgaagaatcatttgttcttttcattttacttgtcaccatgcaagtgttttctgaattattttctgttcttttcttgttacctgctatcatgcaagtgttgttgtcactgtctaactctatgcagatgtttaggaggagttggatagcttatagatgcagttaccattgtgcctacacagctactagatgtaatgcattgtgggaattagattaattctgaacttctgcagtccattcttaagttctatatagtttactgcctgtgcaacgcataatgtggttttaatgatttgttgctagtaaatagtggaacaggacatctttaatatgccttggaagtaatatcttttcgcttttccaaaaatactatggttaattacttgttgtgtcatatctttaatatgttttcctttcatttctaaagatggcttttaaatctaatgtagactgttctaatcagtctgaagaatgggacacagaggaagactgctgtttttgatgcatcagaactagaattttggtgagtcatttttatatttatcatactcatttatatgctaccattaattggtcataattgatttgatactagtcatcttatgccaaaatgaccagctttgtatttaagaaactagaacatactgaaggtacctaatggcttgcaagatttaaggaaattgtctctgtttcttaaagatgtcctgaaacttaacacatacaaatgtgctcccttgttatctgaagctacatggcatgcttgcgttctttgatctagaaattatttttcctagatatctgaagctacatggtatacatgtattcattttatcttagatgctgaaactctgcacagaaatgtgcttatccagttatctgacagctgcctggcgtgtgttctttttatcttggattcattattgaacctaaacatggcaaaaatattggagcatttgctaaaggtcca

SEQ ID NO: 44125 - DNA, 1379 bp, Oryza sativa
ttttggacattttggagtgtattgggtgcgttcgtggcaaaaactcacttcgtgattcgcgcggcgaacttttgtcaattaatgccaatattggcacacgaaggagcgttgcttttgaccggaatcaaaaagttcaaaaaacgccaaaacatgatttttggacatattggagtgtattgggtgcgttcgtggcaacaactcacttcgtgattcgcgcggcgaacttttgtcaattaatgccaatgttggcacactagggtgcgatgtttttgaccggaatcaaaaagttcaaaaaacgccaaaacatgatttttggacatattggagtgtattgggtgcgttaatggcaaaaactcaattcgtgatttacacggcgaacttttatcaattaatgccaatattggcatattttggcccaaacgggggcgatgtttttgaccggaatgaaaaagttcaaaaagcgccaaaacataatttttggacatattggagtgtatcgggtgcgttcatagcaaaaactcacttcgtgattcgcgcggcgaacttttgtcaattaatgccaatattggcacacgaaggagcgttgtttttgaccggaatcaaaaagttcaaaaaacgccaaaacatgatttttggacatattggagtgtactgggtgcgttcgtggcaaaaactcacttcgtgattcgcgtggcgaacatttgtcaattaatgccaatgttggcacacgggggtgcgatgtttttgaccagaatcaaaatgttcaaaaaaacggcaaaacaagatttttggatatattggagtgtgttgcgtgcgttcgtggcaaaaactcacttcgtgatttgcgcggcgaacttttgtcaattaatggcaacattggcacacgagggtgcgatgtttttgaccggaatcaaaaagttcaaaaacgccatttttggacattttggagtgtattgcgtgcgttcgtggcaaaaactcacttcatgattcgcacggcgaacttttctcaattaattgcgaatattggcacacgagggtgcgatgtttttgaccggaatgaaaaagctcaaaaagcgccaaaacatgttttttgggcatattggagcgtattgcgtgcgttcatagcaaaaactcacttcgtgattcgcgcggcgaacttttgtcaattaatgtcaatatagctagttaccccttcagggtttctcaggttttgtttagatgaaagtttagccattgctacttccttgcagcgcgcgtgtcggctagaccgtccgtctgcttgtattcggaaccccaacttatcatttgtattaaattcctttttgcaatatcagattgcttttatcttgttattacttgtttcttcgatttgcttgcag

SEQ ID NO: 44126 - DNA, 324 bp, Oryza sativa
gtcattcggacggcgaacttttgtcaattaatgccaatattggcacacgagggtgcgatgttttgtactgtaatcaaaaagttaaaaaagcgccaaaacatgatttttggacatattggagtgtattgggtggatacaaggaaaaaactcacttcgtgattcgcgcggcgaacttttgtcaattaatgccaatgttggcacacgagggtgcgatgtttttgaccggaatcaaaaagttcaaaaaacgccaaaacatggtttttggacatattggagtgtatcgggattgttcgtggcaaaaacacatttcgtgattcgcgctga

SEQ ID NO: 44127 - DNA, 992 bp, Oryza sativa
attcctgcagcccgctagggacgagtgcttggaggctctcgtcctgacgggatggggcgaggcgtgcgtcagaccgcctgtcgccacctaacccacgatttgaccggtctgtgactgatcacagaccggataaacgagcgcgctgcactgcgttacatgcggcgtgacgcactcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgaccccccccccccccgagggggttaggccacgtgggtgatcgtatctgcctcaagtctctaagtcatgatactctcggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtaacacgcgaatcgggacgagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagtgtgggcgcgagaaacgagggggcagatagagggcgcgagaaacgaggagccgggcatagcgttggcaagggtataaagtcaccgaggaagagatttgcttccttcttttcgccattattccccttgtcttcgccgcttgcgccctgactccttgtttcctgtgccctaccttcgccacacgcgctc

SEQ ID NO: 44128 - DNA, 1501 bp, Oryza sativa
ctcctgggcatccgaaaaacgtgacaaggttcgtggacactctaaaaacctggtaatttattaggggacaccatcatcattattttattattattcggttaaatggagaaaaaagcatttataaaagacaagcttaccctttgggttcgtaacttgggtctgttttcaaactttcaacttttttgtcacaccaaatgttttaacacatatatggagcattaaatatggacgaaaaaaaccaattgcacagtttgtatgtaaattatgagacgaatattttgaacctaattacgccataagttaataatgtggtgctacagttgtcggtgacatgggaccgggagtatcatgacttagagacttgaggcagacacgatcacccacgtggcctaaccctctcgggggggggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccagtcaaatcgtgggttaggtggcgacaggcggtctgacgcacgcctcgccccatcccgtcaggacgagagcctccaagcactcgtccctagccggagccggcgtgttagctcctagagatggcacattggttccggtcagatatatgccaggcttcatcctaaccattacaagcaagacattgtatgaagaggggcgaacatgcagattgataaactaacgcgtggtggacaagaatgaccgatttgtgaccggtctgacactggtcatgtcgtctgcagacagccatgttcccacgttgcgcctgcttctggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagtttagaacctcacccagggcccccggccgaaccggcaaagggggggcctgcgcggtctcccggtgaggagccccaagctccgtcatctggcgcgccaggtaggggactctgcgtgtgttcttctaagctctcacactctttcgtgtgcgccaagctttttctgttcagcccaa

SEQ ID NO: 44129 - DNA, 213 bp, Oryza sativa
cgcacccaatacactccaatatgtccaaaaatcatgttttggcgttttttgagcttttttattccggtcaaaaacatcgcaccctcgtgtgccaatgttgccattaattgataaaagttcgccgcgcgaatcacgaagtgagtttttgccacgaacgcacgcaacatactccaatatgtccaaaaatcatgttttggcattttttgaactttt

SEQ ID NO: 44130 - DNA, 1501 bp, Oryza sativa
tcaataatcaaaggacggaccctaatcactatgagtaaaacgctgatatatcctagaaaattcgtttctaaggggagtcgaacccagaacctcagatgcttctgaggtttgaggctctggtaaccacaaggctacaggcccttccacaatttgatgcgatatgttgcttttcagtctgcactgttggacatgacaaggccgtttgattttgtttcacaagttactatcaaagggaagtggagatagcgtgtacaaccagcctattagtttgtatgatatgatcccagttccatcccagcctatcagtatattccctcctgttggaaatcaaagcaactcacgcgaacacagtggacacgaatcacaattgcacgtgaagaacacagggaagaagagaacacagtaccgagcatatttgtggcaccgcacatatacaactagtgccttttctcttgctatttcttcacaaaacaaacgattacaaggagcagctatttacaatccatgcatactactaatcgcacatacgcccacgtccggtttacttggccgcaaaactccacaagtatcgcaactgcttgactcaggccgcatctccactacggaagatgatgttgaaataaagattaagtgttcacacaaagcgagtggtaataacatgtgattaattgagttttaattattataaacttgaaaatagattaatctgaaattttagaacaactttcatatataaagtttttacacgaaacacactgtttagcagtttgaaaagcgtgccacttttatccaaaattttattcacgtttttaattggattcgaacatgagtcctcccagacgtcgttgcttgcaccaaccaaataatatgcatgcatgcacatgcatctgcaactaactaacactaccagagaaagcgtttttcctctcggtttgtagccccctatactcctagttttataaccagaagtacgaatccgggactaaagataggtatctttagtcctgggtgaaatacctaggactaaacatccatctatagtcccggttggtgatacaaaccgggtctaaagatggcaacgccaatcccggttggtcaccatttctttcttttttttttcattgtttctttccaaatcgagttgtaactgcacaaatcgagttggaacggcacaaatcaagatgctccctatatccccaatcatatccccaaatcaaaatcaaagtatcaacacaaacatagattcacatcacaaattcttaaaaaaaatacatctcaaattctaaaagaaatacatcacatatccaatgaattacaacatctaaaagttctcagaccaacgaatcacaacttctaaaaattctgaaatccaatatatcacaaattcttaaaaaaaaaagaacaacaaaatcgagttgccgctgccgcctcccgcctccccttcggcagaggggagggcgccgctggccggcagctcccgccgccctcccatccgcccgcc

SEQ ID NO: 44131 - DNA, 1501 bp, Oryza sativa
catacaccgtgtcttccgaatgagcatcgtcatcaccactcaccacttcctcattggaaggtgtctccaacgcggcaacccgatcagttagcgtggatatctgcttgtccaacctctccatgtggttcaggaagccgattttagtgaaggcatcttggacagactttacaacggcctccgataccacttgatgtgcactagggttcccgatcttccgaaaggttctgataaaaaatgatttgggcggagtcgcgacacaaatcgatccggcttcttgaacgcgcacgctcttgagccccgcaatcgcaacaccacgtctcctctggttatcacccgtgtcgaaacgcggatgacctcgccaagaaggctaatccctatttgccaatcgaagaacacaaacaaaaacgagatagaaaacaaccaaaattgcagatgaatgataagctcacgagttggggtcttacaaaccgatctagcggcgaaactgttctcgacagaataatctaagcaaaactctaaaacctaaagatggtagcggtactgatatatagagtttaggctcgtgcaaccccctctcgacgcaaccctaatgggttccaacacgatacatggcccaaaggcccaaatacggtgacacagcaccgggacagattctggatgtcaacttgttcggtcgatacccattgactcggaaagtatttggatgtgggaccaaaaccattggaaaggttatcttcttagttttccattcatataaagaacgccccaatccgagcacgtatgcgacctgggcgcccgttttagtgcagactggtcctagactccgaattgcaccgaggtcgaattggtttgggcctccaccttgacttggacgtcctcgatgatcctccatggctctaagtccttctccaagtgtctccttgtcccctctattatttctaatcacaatatattcattaggtagcaatcttttctcgaattcatacaaagaagaacataggaacgagctcacctctaaatttaattgtcgcgcacgagctcttgctatcagtccttgaatgaccattggaggattgttgtgtgtatccgaggtagtgatgtccgtatcatgtcgcggagcttcggcgtcttccatcgagatattagctgatgaacgagtgctagacccgtcatgatgacttgatgaagggccggaccctttgaacagttgagacaatcgcctcctcattctgcacaatgaagcaagaacggactaactcggcgggggttaggaatgataagagtttcacctgccggttagtttcaccaaagcaacttgtatatatgcaactaaagatttaaatttgagggaaaatatcacagcttgaatgaactagacagcaaactttgcagagggaatggaaatgtgttgaaatggggtggagtcccctctcccggccggttggcttaaatagtgcatccacaacggtcaaaactaacctgtggggcccactagcctttg

SEQ ID NO: 44132 - DNA, 411 bp, Oryza sativa
cgttctcgctcctatcgctgtcgctcttcctctagtcgatgacgttcagcttcttgtcgtgcgcgatcttggtccgcttctcgggcttggtgctgttcctccatttcattgttagccttgaatacgccgaagaagaggggcgtgtagttatcctcatagctgtcgtcgaagttgtcgaggtcgccgtggtcgtagtggtagccgaaatcatcgtagtcgaggatctcggttggtcgagaactgacgccggaggagctgaggtagccatccaactcttccgtcgagactgtcccgagaggttggagtataacgccaaccttcctggatctagatcggatcggggccgaagccggagctcgcttagatcttcgagtgggagatgtcttgactgtgaagacagcggccaaatca

SEQ ID NO: 44133 - DNA, 703 bp, Oryza sativa
ggttccgaacaagcagacggacggtctagccgacacgcgcgctgcaagcgaagtagcaatggctaaacttacaatttatcaaaaccccagcaaccctgaaggggtatctagctacttataggggtgggagaatgaccatgaggatcctagggtcgtgctccaccggattggggcgcaccccacatgggccccacttgggccggggtcccaaacgaagttacaagcccaaaggaccatgacaggtgatgcaacaccttgttgcttcaattgcggctcaataagatggaatttcacaatgaggctggatccgttggaaagaggattccgagagctttctatcaagtactcacgggccaaaaacagagctcgtatggagatttggtggccgtttgaaattagcagtgcagtaggtggccgaatcggattccagcatttggaggccttgaccttgatgtcttcttgttcatctatgatgtgagcaatggttgtatccatagtagctatggtcacatcacaaaggctagtgggccccacaggttagttttgaccgttgtggatgcactatttaagccaaccggccgggagaggggactccaccccatttcaacacatttccattccctctgcaaagtttgctgtctagttcattcaagctgtgatattttccctcaaatttaaatctttagttgcatatatacaagtt

SEQ ID NO: 44134 - DNA, 1041 bp, Oryza sativa
aggtccatgcctcctccttacgagccactcggtccgcgagctgaaaaagctccgcggtagtctggggctctttggaggcgatcttttcaagcatgcggttgtgccgcacaccccccctgaacgcgtagatcaccgcgtgtgcagggatgcatggaatggtgttgcggacttgacagaactgctgaatgtatgagcgaagtgactcatcatcccttcgctggactgcatgcaggtccgcttcttcacctgggcgcggatatgtgccttgaaagttcatggtgaactgttggcacaaatcctcccaggagtggaccaacgcgggtggcaagttcattagccaaccccgcgcctgtcccttcagggccatgggaaagaaattcgccatgaccctgtcatcacccccggcggcttcgatcccggtcgtgtagacctggagaaactcggcggggttgacgctcccatcatatttttcggcgatggtgggccggaaccttgggggccaacggacattccgaaggctcgccacaaaggctctacagccgacaccaccaaccgggggcacggagggctgatccccgcgtccgtgttgaggtgacactccggacgaggaggcgccctctgttgcgtggggagcacgccgaccattacgtcggcgctcgatatcgatgcgggcatctggccccccacgctgatcttcctgggtcggaggcgctgacgaaggagtgacggccgaatggcgagcaacagccgccgctcgccgcgccctccgccttgacgacacggagccggtggtagcagcgccggaggtcttggtggcggaggaccgcccaccagcacctaggcgctgccgtgccgtcatgaccaagttggccacgtcgtccagccaacgttgggctggagactccgggtcagggacaacgggcgggtgacgtaggagcgcgcccgcagctcggagcgcgccctggggcgtgctgccgtcgccatagacgaggaggcgacgctccccatctcggcgcccttctccatcacccgtggatgtcg

SEQ ID NO: 44135 - DNA, 558 bp, Oryza sativa
atgttggaaggctttttaactttttaaaccagtcaaaaacatcgctccgcgcgggggctcaatatatgccaatattggcattaattgacaaaagttcgccgcgcgaatcacgaagtgagtttttgccacgaacgcacccaatacactccaatatgtccaaaattcaagtttggatgctttttgatcttattcaatccggtcaaaaacatcgcacccgtggggtctcaacatatgccaatattggcattaattgacaatagttcggcgcgcaaatcacgaaatgagtttttgccacgaacgcacccaatacactacaatatgtccaaaaattatgtttggatgctttttgaactttttgaatccagtcaaaaacatcgctcccgcgggggctcaatatatgccaatattggcattaattgacaaaagttcgccgcgcgaatcacgaagtgagtttttgccacgaacgcacccaatacactccaatatgtccaaaattcatgtttggatgctttttgaacttattcaatccggtcaaaaacatcgcacccgtggggtctc

SEQ ID NO: 44136 - DNA, 346 bp, Oryza sativa
tgaaaaagatcgaaaaacgccaaaacatgatttttgcacattttctagtgtattggcaccattcgcgcggcgaacttttgtcaattaatgtcaatatttgcatatattggcccacacgggtgcgatgtttttgttcggaatgaaaaagttcaaaaagcaccaaaacatgatttttggacatattggagtgtattgggtgcgttcgtggcaaaaactcacttcgtaattcgcgcggcgaacttttgtcagttaatgccaatattggcatatgttgagccccaggggtgcgatgttttatgaccggaatgaaaaagttcaaaaggcaccaaaacatgattttttgaca

SEQ ID NO: 44137 - DNA, 1501 bp, Oryza sativa
aaatcatggatatatacatgcccgctccaactgaacaacactacatgatgattcagattgaagagcagtactgcatatggattatatgaaaatacaatggagtagcagtaccacatctctgaacagagttaagcaacattattaatggatcagagaggaatccatgaatcccatttgaactctggaacgaattaattaaactgtaataaaaaaaaacttctctgataggttcatcggttcatgcatgtacagcacgcgctacggcctcgctctcgccgtgagctgtgagattagacagagagcaagggaagtaagcagtgcgttgcaatcatgcacgctcatggcgacgggcgcggacaagcgagtgtcacacgccgctgcgcctgtttttttggcggcttggcaacgggccaagcctcccaacactggcaatcccactggcttcacgtggccggttcgttcgttcccgcgcgcgccaacccacgcccccgtcgctcagtggcatggcatgcgcgcgcaaagctctcgaccattcctggccgctcgattgctcagagatggtttttcatttctcgacagggcatcatcatttcgtttcttccgtatctaaataatcattattaaaataacatcatagattaatatagaatatacaaatatgcaaaactaaattcagcttctataaattgtcataaaagaacaaattaaactaaaaataattactccatatgtcccaaattataatgcctatattttttaaatggtcttcattgatatactttgaccattaatttatttcatgtttagttaccaacaaatataaaattaacatcacatgaaaagcctttaaaatataaatctagtaatatagcatgcataatagttagcatatatatggttaatatgattattagtcaaaagttatcgagtttaatttttcttaaaaagaggacgccttataatttgagacggagagggtaacatacattaattcataattctacttgttattttcgttacaacttataaaagttgaattcgaagctacatgtgtttatagagtgataattcctccgtttcacaatgtaagtcgttctagcatttctcacattcatattgatgttaaaatgctataatgacttacattgtgaaacggaggaagtatattttatattaatttatctctaattttatataactatttagacgatgaagggcctgttcattttgatgtcaaaaaaaaaacttaccaaattttggcaatagttaccaaaaaatttagcaggatttcttatataattaacaaaatttgacagcaaactaaatatagctattttttttagtaattttactaaaatttagtaaggttaaaaatgacattaaagtaaacaaacccgaaatgcaagaagcaagtgatgaaaatactttcccggaccgctcgccttccccgcctataaaagagcgcgcgcgccacggccttcgcctcccgccacacctcgca

SEQ ID NO: 44138 - DNA, 159 bp, Oryza sativa
ctttgtgctcctgaaaatgcagggatcaggctggacaggcagttacatgaagcaatcaacaacaaggtgagtactaatatatgagcaattccaagttgttcttcctgtcagaaacaaaatgctcaaagattgctcatttctttgcatctttgttccagc

SEQ ID NO: 44139 - DNA, 1501 bp, Oryza sativa
ggaagtgttgggaacttgctcttgcaaacacagccccaagtgtgcttacaaaacaagcacagtttgcaagaatccaactgcatcatgcagaaatcatgttcacgcacaaatcgaaacgtgggggtgtggcaactccaaggacaccctctgcgtcgcgtagccttgaatattcttgtggtcgtagacaggcagctacagtcgtcgtcgtaattcagttcttttttttttttactatactcaccatgtgaatgctctctgctagacacccttctctatagaacaaagcacattgtaagctgatggccgccatattttgctgatattctttgtgcctgtagtaccaactatactaccaagtaacttgtgccgagaaagataccccttaagaatgtcttttgggatgcaaccagatgataaacagatcgaggaggcagctagatgacagtactagttcagaacactaagaaaccggatcagattaggatacaacttcgaaagaatctaaccagcttttagggcatatgatatgcatatactcaaggaaaaattggaatcatgccattataattttacaaaatttaagatatgacatcctgactcatatgtcattgatttatgtgggtcctacatatcattgagataccgatggcacatttcaaactttataaaattataatggcatggttcaccgtgagtacttcaattcgaaagagtacttcttatatcacagcacgcaaataaccgtgcaagaccagacctctgatctcttctgcagtggtttcgttctccgttactgccggcagaagcatctcggatcagcatagcaattgatgtatatgctattttagtagctaggcatctcccgaggtagcctatggcacaacagtatcccgttccccatacaaaaatgttgtatatatgatcgctttggcgtcttggttaacataatactccagtagttacatagttaacggaagttgattccacaaaattcacataagacagtagtcaaagttgattcttatggagcttgatggcttaattagctggatctgcatgcccttgagtatgagattgaaggattaattatagcccaaggcatgattatatttttaaagggaaaaacatcgctaatgttatagaagaacgatcttgatcaatatattcctgggagaatcaggaaactctcgtgcgatccactgagacccctcatgctaagggaaaaacatcacccatgttaacacgcgatgttagcacttaatagtacagtgttaaaggtatatgatttcaactccgatgtccgatatttaatttttaacatgttaataatttctttttaagatatgtttggaggaaggtctctcccaccaaatctcgttttttgctatccattgttaacaaaggggaagcttgagctgatcattctcaactctcaaattaaacgagttctgcgccgcgcgtcgtcgtgcgtacgtgtatgtaggcgctcaaaggaaaaagg

SEQ ID NO: 44140 - DNA, 1501 bp, Oryza sativa
aggcccaacttaaactccaccaggctttcatgggccggatgccattgggtaggcccatttaggcccacaatgggctgattgggccagattacacgtgcgacgtatctgtttgacctcccgtaagactgaccggaaataggaaagcaaagctgcatgcagaaacgcctggcgctgctgctatttatggaccagttttggcgggtgcaaaccgcggggcccaccctggaggttcgtctcctcgcgcattgccatcgccgagctcccgaaaatggtgcggtaacgggagcaatcgcagaagaggactggaggagatcgattccccattgaggacgtgaaattggattctgtggcagaagaaagatcgatcgatctggtttggtctggtctcctgtaaaagaattctcccatggcgccgccggccacctcgctcatcggcggcggcgtcggcggcgtcgcctatgtcgttctgctcttgttcctcgccaacgcctgcgtctcggatgctgggttcgaggtatccagccgtgttctgatgtcaggtgcgtgcagatagcgtatccatcgaccatggcttccttcttcaagcctgatcagtctgttgcaattcgtgacttgcaccatggtgacatccagatgagcaaggaagaagtgggttgctggctacatggaggcgattgatcgtcgagacaccgtcgccgggagccggtgctgacgctgctcatccaggaaccaaatctcttccgctggccgcggcgaggactcaccggagagaccccctcgccaacctcaccatgtacagcggcggctggaacatcagcgaccagcattactgggctgtaagtacaccaattcaattatttcctactcctgtaattcagtaattaattgcttctccatgtgaccattaattcttttgatcttgtgcatttctgttccttgtgcagtctgtggcatacaccgcggttcccctcatcctcgtcggcatgctgtggttcatcgtcttcgggatcgtcctgctcatcatctcctgctgctgctgcttctgccggaaaaagtacaacacctactcgccggcgacctacttcatctcgctgatcctcctcataatattcaccttggccacaatgtaattactcttaaaccatatttcagttcttatctccagttcgccattactttgatcgatcgttcttgccttgaactgaactgatgaagaatctttctccttttgttctccgtttggtgattaatttcagagccggatgtatcatactgcattgtgggcaggagctattccacagtagcacgatcaaaaccgtggactacattgtcggacaaggcaatctgacggtggatagtctgaggaacttctcaggtagcttggctgcagccaagaacatcggggtggatcaggtcttcctaccagttcaagtgcagcagaagatcgacgtcatcgaggataagctgaattcttctgcaaatgagttctccacgcgcgcgc

SEQ ID NO: 44141 - DNA, 1501 bp, Oryza sativa
cgttatgaattgaagatctgaactctgagaactaagtactcctacttactccctccgtcccaaaaaaaaaaaacaaaccttgggttttcatatccaattttgactgttcgtcttatatgaaatttttttataattcgtatttttattgttgttagatgataaaatatgattaatattttatgcgtgacttatctttttaatttttttcataatttttttaaataagacggacggtcaaatgttgggtacggaaaccagagtttgtctttttttggacgaagggagtacttcagtagtgctgaactgctaatgtcaacttggagtaactctgtactcatgcatccatgaagtcatgaaccctccacgatctgatgtctgatgagtgggcactgtggatggatcgtggctgatggttgtagaatcgtaatcaactttatgataaggtcataaggataatttatccattttaccatctagtcagagaccttgtccccttttttctctttttctgaaggcagaggttgacatgatcaagaaattcaagatctcttcctgttgtttcttcattgcttttgccggtacactgcgcaccaagcgattgtttccattttcgtccgggaaactataattgtggtatggctcttccagtcgagcactgtttcaaccacacgacgacagttgccggattcagtacacagtccgttggcaacatttactagttcgttgacgttatcgcgttgcatgtaatgtacaggatgaggtactcgaacaggtatgaagttttggtcaacaaatccagcaaatcttcagactggtcctccaacagacgtaggttggctctcccgttctcccagctgcaggttttcgtaacttctgaaactgcatatcctccactgccaccttgatctgaaattctgaatctacatcggtgacagttcttttgatctcgtttgatggctgttgccatcacctctcagtctcaggctctcaccggcgcgccactaaggtcaaccggcttcatcattctcatcgatgcatttaaaaagtcaaactcgatacattaacggctgcagatttggcgaataaacttgctgatgaaaagctcgcaatcatggggcatgcttagctagaaaccaccatcgacatgggcagttgagttgggaggtgattgcctcgacagagattggccggggtttgttgcgtgcgagctcgctttctcatcatctcggatggactcccatcatggcaggtgctctcgctctggtcgagaaaggtcgctacctttccggttaatcagaggttagctccgctagtgcggtggtggtggccgtggccgtcgtcgttgtcgtcctgccaaaagcttgcgatttcaccgaatcgcggtgagctgtgatgcgcgcgcgcgggcgtgtgatgggtggatgcacgaacctctgctcgccttgtgatcgatcgtgcgctctgcctgccggttgctgcatctcttgagaaaaaagaagca

SEQ ID NO: 44142 - DNA, 618 bp, Oryza sativa
cttcctaggaggaattctggaggagtaccggagctgtcggtacactctgctccgggtccggagaacttcttctgtaaagtaagcattcgtgtttctttcttatgttatttaataactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttagg

SEQ ID NO: 44143 - DNA, 1501 bp, Oryza sativa; identical to SEQ ID NO: 35252

SEQ ID NO: 44144 - DNA, 1501 bp, Oryza sativa; identical to SEQ ID NO: 33812

SEQ ID NO: 44145 - DNA, 638 bp, Oryza sativa
ttaatttctgctggtttgtttgcggcaatgaggctgacgacgcgttaatcattttgggtgacgttaccagctgacgtatgtgatcttcatcttgtgttccaagtttcaaaagcttcgctcgatcttgagcttttgatatatcgtggctctcaattagctcttgctgactggcagctctaaatcaacgagcacaagcttgttggctatagctcttatcctcttggcctcttggcgagcaaaatatatctaatcttagccgtttagtgataaaatcctttcaaaagtagtagatgtaaatcctcaatcaagaaaaagtaacgaaaattaacccaaaatcaaggcaaatcgatcgatttgtaggcaacgcaaaaacagatactccgctctaagtagtaggagaatcttctagtatagggcgtggagctagcatggaacaattcgaagaaattaatcaagaaaccggaaactaaccaattatgtaattaacaacaaaatccatcacaagaagagcaaaaaaaaaagctgcagaagcagcaaaagtaattcatataattggttgaggaattattagagaatactactcacatattgttgagtacccagctgcgcacggcgtgcctcgcctgatatgatccagc

SEQ ID NO: 44146 - DNA, 1501 bp, Oryza sativa
tagtagtgctaatctactgctgcatggacggtggagcccgggcaactgcccgtggtggccaggtcctggctccgccaacataacacaagctttttttttttcttttttcgcgatcgatcacacatgaaaattgaaaaggcagaattatgcatttttcatattagttttgttaacgtaaatctatgcaatttgatccctgttgccagctatttctgaaaggattccatggttataatcatgaaaatgatcctgcactggtccatactttttttctttggtctcaatcctgcacaatagtttctttacagagttttcctcctgacaaaagaaaatgatatataaaactggcacaatttattgacatttgcatcataattggttagtgccctaatggcaagtgttctactcaagggactgtcctgagtattaacttaagaaactctgaagttgccatcgattgcaactgttcatagtgaccacattcttaagttaatacatcatgagtttgttatatttctttccacttctctatatgtataaaaaaaatagtgttctctgaccatgcttttttgcgattatctgacaatatataaacaatgtaatgttttctgaagacatttgtatctctgtatccctctcccccatcctttttgttctgtggggtggatggatgggcctatcaaaaggttgttccattatcatttgaatgcacctataataagaactaacaattggcaaacaacagttttccttcagaactagggactgttgtttcaatccaaaaatagtcatagttttactgccatgtctcttatagcttttgctgctgtgcgactagcccatcatgatgatctgacttacaatgcttgtgtctcttgctcttgatctccttctatcagtcactctaggtgcagctaatttctgttcgtctcctgacatttctagggatgcaagatatcgaagatcgatggaaattgctgccgcctacaaggtgcaagaaatcatcacatccggcatttaagtgtgtgaaagactggttctgatttttttttttgctttgttgtgtttcttctctgtgccatagctagaagctagactgaaaacaactatggtatttttaggcttttttatcttagtgaattcatgtaaaaatatttagttatggttctatccagtttttgatggttgttcttgaagggtactagttactatttttagcaggagtgccataggagctaatttagctaaacttgttgcatcggttaataacaccatcgaatatttcatttgccaaccttttgtagacctgaattttgaaaaccaattagaaagtagacacgggctataatgagcgcctcttggcgcgctaattttttaagtatatcagtgcattcacatagtactcgatttttttaaataaatgttttgattcgtgcatgaatcactgttttgcagccataccacaagctgacttaaaaattgcaaattgctgaaaggtaca

SEQ ID NO: 44147 - DNA, 646 bp, Oryza sativa
ctgcgatagcactggcacacaaaagacgcggcggcagcggcggcgagaacgtaccatttcgccggagggggggcgctggagcttggtgttccgaacgggagacggcgaggcggggggtggagggggaggcggtggcggcggcgagaggtggtgacgcgaggcgaggtggtgattttatagaggaagagtcgggacgacgtgaatgcttccagctcgtcggatggcgcgagcttgaggggctcgggacatcttggccgtccataggattagggtttaggaggcgtcacttgggccgcggccgtccataggctactgggccgtcccggttgcttttaaaagtgaataagtctgtttgcctccctcaactcatgtcctttgatttgcaacactcaaccgcaaaaccccatatatatatatataatatatatatatatatatatatatatatatatatatataactctcaaaattgttgcaaatctactaccctggtggtttcggaagtggttttgtcccacgtgtcatctttgtccacgttgtctagcactctagctgagtcagcttgtgggacttacatatcagggacaaggataaaaaggaaaaacggttgggcccactgtcagacacacttctcttcttctctagg

SEQ ID NO: 44148 - DNA, 1501 bp, Oryza sativa
atttatacaaatcttgtgctacgcttgagccgggttcggcgagacaaaatgaggagggggctagcattggtagtctcaccgagttgtgtgcttttgctcatgtttgcaagtgtgaaacacagaatagctgtatgctgcaaactggcatggattgcatcactatcacctggtgaatgctgggagctgagttgattctgctgatggaatcagcaaaaatctgccaaggaaaaagcatatgacacagttgtgttgcattggcttctgtgatgcatccttgaacttgaagtttgggatcaatgaagtcgatctggaatctgggtgaagtacttccaaggagtagctaacagattacactggtaccatagaggacgcagcggcatctctgattctctgaatccatctatgcaagttcgttttagcaggattgacacataattgcaaaaccaactattacagtgtatcaaacctgagaggctacaaatatatgtcgcattgaatttacttgtagtatattcatctatccaaatgctcaaatgcaccttatgttggattcaattttagagtaaacaaaaagacagaattcttatgcactaaccaaattcagtgacaaccatttctcttccctcctatatggctagtactagtagtacttaaatttcagacaggaaactgaagtaagctacaagtctgttagtaaaatgtgtgatgctaatataaaagtaggactttgagctgtcatgaactctttgacagtgagacaaactgagtgaatctcaagtaaaatacaaacaaccaaacaggtaaaaatcgttaagctcctcaactctatatattatccaagctagctgtctgcatcttgtcctatggactcttgtcctcggttccttcgcctccatgtccaagcttgcaacctttcattcttttctgcttctagaacggaagatatgattggccaaatggtcattccaatgaggttacagccatttttcagaatctgttccccgtttttccaacacacacatgacaacagagagtatacgcaattaattatgcatgtgtatacgatatgtaagtacgtcgtccttgcatatagctaacgttgtcatgagtcaaaacatctctgtcgagcctggatgaaaagtccaaccattggtgtcgtcgtgtctgtatatctaaagttcaaatgcattctaatttctgtatagttttagccggcatatgctgcgaaactatgccgctgggttgtctgggagactacactactaagggcatttcttgtgtcctaatcactagggagagtccgtacgtcctgcaagcatcgttcttaactaaacatgcaagagcttgtgcttttcatctagagttagttctagatggtaatgtgacagactgacagttatggttgtaacagtgttgatgttttcattgaaatatattgttgagagaggtgtaaattttgtacagtgcttatcttatgaaatataaaaccagctaagctggc

SEQ ID NO: 44149 - DNA, 1501 bp, Oryza sativa
acgtggaaatattatatacgaacatatcaatatgtacatgaagagaaagagtgatacatatagcttgatctccatgtatttcattcttgtgatttaggtccaccaacactccactttcatatccacatgagactaggcaaagaaatgcttataaaaacattagtctcacataattggatttgttattaatcatcaaaaccaaatcaatggcacttgaactttcagttcttagccgatctagagaagacaacgaacaccaacacaggagtagggtattacacctccgggtagcctgaacctgtataacctcctacctcctcctcctcgcggggtggtcgggccccgcgaatccatcacgatcgcagatacctcgcaccgctcgccgactaaccccctggtcgaatctccactctcggggaggggtctccactccccgctgtctgagggactgcctcttcggtgggcggggaaaatgacccgctccgattgcccccatctcccgttgcattatcctctcttttcttgatttcctcaactgtcactactacctactcccatccccttttatttacgctagatttttgttgttttcgtgcgtgcgaacaagactcaacggctatcggcggggtggggcagcgaccatcgagcttccggaggagggagagaagggcctagagaagaagagaagtgtgtctgacagtgggcccaaccgtttttcctttttatccttgtccctgatatgtaagtcccacaagctgactcagctagagtgctagacaacgtggacaaagatgacacgtgggacaaaaccacttccgaaaccaccagggtagtagatttgcaacaattttgagagttatatatatatatatatatatatatatatggggttttgcggttgagtgttgcaaatcaaaggacatgagttgagggaggcaaacagacttattcacttttaaaagcaaccgggacggcccagtagcctatggacggccgcggcccaagtgacgcctcctaaaccctaatcctatggacggccaagatgtcccgagcccctcaagctcgcgccatccgacgagctggaagcattcacgtcgtcccgactcttcctctataaaatcaccacctcgcctcgcgtcaccacctctcgccgccgccaccgcctccccctccaccccccgcctcgccgtctcccgttcggaacaccaagctccagcgccccccctccggcgaaatggtacgttctcgccgccgctgccgccgcgtcttttgtgtgccagtgctatcgcagctgctccagcggtttcctttctgcgaagaaaccggatcttttggtgatacttttttctgtggtgtccttcgtgtggtttccttggatcttgtgaacgctgtcttggattctcgcagcggctgctagcttatctcgagacctcgcttggaggttgcaactttacatatgaatcatgtatatgcgctgatgcgtctggatcgtaaatctcgc

SEQ ID NO: 44150 - DNA, 1226 bp, Oryza sativa
tccttcggcttcgcagcatcctcgccgacctagtccacctctccgtttcggtcgccgaccgccggagcgccgtcgtccccgtcgacccgagccgcgccaccacctccctccgctccggccgcctcctccgtcgccgccgtcgccccggggtgagccgtggaccgtcgcctcctttcccccttccctcccttctctcggccgccgctccgccgcgccggtggtcgccggcggcgaccatcgggacgcgggcgcgccgcctcccgccggccgcgctggcttggccgccctcgggcgcgtcgagtggctgccgtgtggggcccggccgtaagccgcccgggccctcgggtgcggctgacgcgtgggacccacggcgccggccggtgtgagccgggtgcacccggtccaccgtggaccgtgaggctgccgcgtgggccccactcccgtggacccggtccgcgcgccctctcccctcggctgacgcaataattccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccggcgtttgggaaagcgagcaaggcaagtcacatcatccttgaacatattaaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctacttacggtaccactagtatgattttaggtagatgcttcgctgtttaattaggtaacattaggtggttttacaactctagactttgggatattctcatcacctggacactttggaattgttggattattgtggaattggattcacaccgccccctctattcaaaacccccaaaatggttttaggctgggctcggggtgcatggtttggatagtagcacctcggccatataaggaccggt

SEQ ID NO: 44151 - DNA, 1501 bp, Oryza sativa
tggagagtggattactatcttcatttatgactgacttagaaaaatatttgctcatggaaaggatttcagcagtttacataagggctgcaataatgtatacacttctatcttgctaaattgtgtgcactactattaaaaaggataattattcgggtaccagctttagttggtatagccttcctgattcctattatttaatttttttctagaagttatttatatcgctgctactgaagacatctcgactgaaattatttttccctgcgcctgcaacagtagaaagttcagtagcacatgttgatttagggataaccctaactgtttaaacaaaaaaggttaactcacacaagatgtagttttggccaacatcggcccgtattaggatgcttcattctgatcctattttattttgcatcagcaggcactgcacggctgcagcgttgtaattaaatcatcgacatcagtggtggggccttatgcttgggtacgcagcggaggagggagaaataaattatctgtacagaccatcggtaagtaatatttacacctatccttatttttccaagtgccagtaaaatgtcttagactacttgatcaagcatagaattgagctataagagcaatgagtttcaatgatattttgtgtgtgtgtagaagtgtgaatgatgtgtcgacaggaagaatgggttctcgtttaaaattaaacaaggcatatttacaagaaagaattataatacgttaattgctagctttgtgattatgcaccacccataaatcttgcttagaagtttaattaacggtattatggtaatttccacgaacccgtagattctttactgtcctaataggcctaggtgcatttcttatcaatccaaaggcaataccatgcatactgctattggaatatttggcagagctttagatattggattatcatatgacacctatctatatctgtaatactgtagtactccatactcattaatcattgtacaaattgaggagcatatctttctatcatttttacatgagactatgtccttactggtccttctcatatgagattagctcataagaatttcatactttttgtttttgtgggtgaataccaacgtgcatttggtggaagaacataaatcaactggtcctgctaatctatgatttgctcttaaaaagattatattttttatgtttccaggtgaataccacggtaccaccatgcatttggtggaagaacacaaagctactacatttgtttttgttattttattagatttgggatcaaattttttgtgggcatgtacattataatgtactactacgcatcacaatataaatgcttaggatcaagttgttactcaggggtcttggccacgtagatgattgtgtttgtgtatgggtggatgccattgacacaggttcttaaacatgtatttagagttgcgcaaagcgcaaccatgtggctagttagttatgaatttaagaagattatttgtgtttt

SEQ ID NO: 44152 - DNA, 1501 bp, Oryza sativa; identical to SEQ ID NO: 35255

SEQ ID NO: 44153 - DNA, 1501 bp, Oryza sativa
aggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccggggcctggcttggaagtcggaggcgcgcttcgttggcgaggggggtgtagaaccagtcgctcttccagtcgtcccacttcttgcggaggacgcaagggatgtagcggttcaacaccggcccccgcggctggaagtagcagccgccaaccaccgacggcggtgacaccgactgcacggtgaagaaccaccggaacagctgaagagaagggcgcaccccaatgaacatctcgcacaggtgcgcgaagatggccaatgtcatcaccgcattgggggtgaggtgcgccatctggagatcgtagaactccaggacatccatgaagaaagaagaaaatggtgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaacggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcgtttgtggcaatcgaaatggattgtatcgtgcgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattgtgcccaactacggagaccggtcccacctgtcaccaggctttaggggtggcgtcacacctgaccgcttcccttgagaagggaaattgctctggcataacgccgggggctactgtcggtgatatgggaccgggagtatcatgaccagaggcttgaggcagacgcaatcgcccacgtggcctggcaccttcgggaacgtcgggcccgagggtgaggtgtccgccctcctcctgatttcccccgaggttgcgcttgccccggccccgagggccgaggcaccccgaccccttaaggaagttt

SEQ ID NO: 44154 - DNA, 236 bp, Oryza sativa
aaaatcctgttagcgtattttgacatgtagaatccaagaaaaattccacatgccgattccgattaatatttgcatttattaatttagggtttctctctaggttaaattaaacaatttcttcggacgatttattttatgaatttagagcaagggaagggaacttcagggcgtgacaaacctaccccccttaaacggaatctcgaccccgagattcggaagagctggcgaagaggtgc

SEQ ID NO: 44155 - DNA, 1501 bp, Oryza sativa
gtcatcgagatcagcttcaatttgttcatcagactttcagagagatgaattagtgctttccacctgatattttcctcgattccaacttggcgataagatacaagctagataaaagggatgagatgttccaacaaaaatccgaggaccaacacagtgaatttgaataatttagaataaagatcgagcaactgagcttgcatgagcgcccgtcccggagcataggatactactatatttgtttcatgtttcagtctatatgtatatatatgttccacacgcatgcatattaattatctattaattgtaggtcttcatcaaagtgcacctgagtgtttgatatacatgcattattattattgaatctctagggaaaaaaactggcgtgtcgatctgctgatggaaatgttttagtcaacctaatctaacatatatagatgcggtaagtatcatgggagcatgcacaattatataaatttggctgaaatatatgcgtgtgttgtcttgggctctcagccttcttaattttatgacgctcgatcgtcctttgcctggtgattatatattactcggtcagtatataaatgcatgtaaatcccggaagggttggaagattctgctgttcaatcactcaatgatgagacactagctactacttaatgcaagaaagttagaagttaattaacgcatgcttagataaatgtacactaactcacatgttggtactaaaagtaacttctaattctagtttattctcctgcaggttctttctacttgctttggttgcttttacaagtaattagttgccctaggaaagaagataaaaaaagaaactagcccaaacaattcgagcacggcctcatatattttatgtccattcctcgaattagcagctagagccatgtgttaatttataaactaacatcacgcaatatatatagctccaattcaagtcaaatattagattacttctgcaaagtttacaatgggataatgttaacatatgtgtgatggttacctcacaggagtaaactacatataattacagccatatgttttgctttgagggtcagtattataagtgtaatgagtacacgagcaccttggatttctttattgtgtatgcacaaaagtctaaataaattttcttcctagctatggaaacacggaaagttcgttatatttagtcacttgcaatggatagtactactgttgattacgtaattaaaatatcgatcgagaacacaaaaagttcattttgtaggttactactaatataagaatcgtaagtacttgatcgcaggacaacatcaacatcatttgttgcatcaaatcttttatagtcactgtactggccatttttttattaccacgccatggataaactgtgggcgagagcaacttggtttctaataagcgcgtacaaagcatgaattcatgatgaggacatcacttcgtcggatacgctcataacttcacacactccaatgataattccaaatcc

SEQ ID NO: 44156 - DNA, 1501 bp, Oryza sativa; identical to SEQ ID NO: 35256

SEQ ID NO: 44157 - DNA, 1501 bp, Oryza sativa
ccgccgcagcttctcctccacatcgcgcgcgtcgccatcgccgccccctctccctgtgcgcgtcgccggcgcctcctcctcaccctgtgcgcatcgccggcgcagccccctcgccccgcgcgtgtccccgcgccttcccatcgtcccgcgtgtcgccggcgccgtcccctcaccccccgcgcatcgccgacgccgccgtcttgcgctcctccaccaccgccgtcttccgatgtggatcttgaccggaagaactccgggaacaagggcgaggctgtgaagcagggggctggtgccatcaaccacatcggacttccgtcgttgctgtcatctatcaatcacctcgccggtgagaaccctccccctactgaaaccacctctctttataaattgtgaatgctgatgagtgatgatcctgtgataatcttttcattaacaaatcatgaagtagcttatactagtgaatctcatgtattaatcctgcctcatacatgttttcttcataagttcacatggttatgtagaatatattttcccagattgcaggaaagttgaatattagtgaatattttttttgagtgtagggaagtttgaccaactcatttttactatctagattttgagaattttgatttcttttactgccaggtgatatatcattttccacaatgtaagattggaaaaaaagttttgtgtaaaacaacagatacatgtaaatatccctgaatggatgcttgatattgtgttctagcaaatcacttaggtttagcaataaaaaaaatatgtactgtgtttattttagtggtagcttgatgtattatgcgtgctagcaggatatattctggacatggttaatgcttttgttttatatatttgtagagtgctatggctcgccttcccttaagtaccaaaacgcggagaagaaatttagggcttagaaatatgatgattgctgtcatacttatgtattatcatgttgttgtactgtttttaatttcatataagagaaaatattggaaaatagagaggaggatcagaactagagaacttaggagtgaaagactattccagcttattcgtgagagtgatattgcttgtataagcgagctccgaatggacaggaggacatttcacattctatgtgacatgcttagagacgtcggaggtattgaggatacaagaaatatgccgttggaggaatcagtagcttcattcttatatatactatctcaccatttaaagaatagaacaataggaaagtttttttaccgaagtggagagactgtgagtaggcatttcaatttatgcctacttgctgttctgaggcttcatcaacttctacttaagaagccagaacctatacctgaggacaccaccgacgatagatggaaatatttcaaggtaacccattctaaaaaataaatcacatttcctttaaaaaaaatcacatctcagcactattaattgtaccatattttattgatgtggtgttctggattgtaga

SEQ ID NO: 44158 - DNA, 1501 bp, Oryza sativa
taattttttgcatgctgtcttggcaagcatgcacctagcaagcaacaaagacactagcttagctagctccgattaatgtgtcgtgcactgagcttaattaatttgtgattcttttcttttccctttatgctacttagacgattttcttttcttttctccttcatgtacgtttcttagacgattttgttgctttgatttttttttcccctctcccttgacgcttaattatagtggattctgtacgtggtataagtgagctgccgattactggcattagtttctgaatcactcaacttgtgaataccccaatgtcatgcttaattaattggaacaaagactaaactgtctcaaaagccgtctggttcgatccatcattccatctcattagagttgctgctgtcggataccccttcgtgtgtcgcgtcgtccccgcgccggtggctcgggacaaaaccttagcccaattcttatccgacagcagtgacgtcttttgccgccgtaaccctcttgagaaggttgtcgaggtgccttcctccccctctttaatgttatcctctaggagaaaacaatatcgtttcgggatgagcgatggtggcgtttttaatgttgtaatctttttggagacgttgttttgaaggttctcggtgtggccgtgtttccttatattgtggtggtggtgtggtgtgacgcaggatttgaaagttccgaaatctcggtaatttcgccccccccaccggcatgctcaaatatcgctcgaaattttcggttttttgcaaattattgtgaatttggtcacattttattcaaattcaatcaaatttcaaaaaatttcagccagaaattttcgaaatttcggtcacccccggcatgatatccaattttgaaattgaaaacctattaattctttatttctttctgaaagtcttaataaacagatgcacaattctattggaaattccccaaaaatactaaactgtctcaaatatgcactaataagaacacgaagaagattatataaaaatggtccaggaaaatccggctcggtttagaaaacagtggcttcatctcccttcatttaaccgtgaactattcatctcaccatcggttacttcggctgcataattttggataaagaaaagatgtacacaatccctttggatcggcagtgaagttaaatcaatatcccaataatctgcaaggattagatacggtcatttgacatcatagggagaacttgctaaatctgatcaaagatgtgtccagagcccaagcaagtagtgtactacatccaaatgcaccgttaaatagctgagctagactttactcacgatgtgctcacgtccggcaaaccatatggtggaaacagttgggtaacctgtcgtgtttggtgtaatatccagttttcattttttttttttggggactggaatacacttccataagtttcaagtgacaatgcaacaaactttcaggtagataaaaaggccatacacaggagaat

SEQ ID NO: 44159 - DNA, 785 bp, Oryza sativa
agaggagggcgagcgcgcgggaggcgaacggactgggccgacggcccaagaagagagaaaaaggaggaaaaagaaaaagaagaaaagattttccagggatttaatattgcactttgcttattttaattggttaaaattatttccaaggctctgaaaattccactaaaaatcctgttagcatattttgacatgtagaatccaagagaaattctacatgtcgattccgattattatttgcatttattacttagggattcatctctaggttaaattaaacaatttcttcgaatgatttattttatgaatttagagtaagggaggggtacttcagggcgtgacacttgctggccttggaactcttcaaattcttctcctgcgaaaacggactctccggaaacgtcggaatctaaacagaaaggagcaaaacaccaaaacagcacattaacaagcatgaacagtacatgtagatatttttaacatgtagatctcaattttagaaaaatttagagacttgaaccaactaaatccgagctaagatgaattagttatgaattttcaaagattaaatcggtttaaaacacttatatagattttaattgaattatgacgcaataatgaattatttttgaaaaggaaaagggaattattgcgtcattggctagggttcgcggtgaaccgggtgcacggcggcggttcacaagattgggcggccgagatcgatcctaactacaacggacggccaagatcgatcggatccaccgcggctcacggatggacgacgacga

SEQ ID NO: 44160 - DNA, 1501 bp, Oryza sativa
ttgacatgtatgtagagagtacaatttggaatagaaacatatgcattactctatttttgtttctgatttgtttcactttgataaccatgtatgactgttattttccaaaagaaaatactatttctaaattgaaaaagaatccagataagcaatctatagtatagggtgtccgattgattttttttttgtttttctttttttttcagcagttaatgcggtaccgtctaggatttgacttttattttttttcttattttccttcaattaatgtgggattttctagaccatgagagagaacgtggagtcttctttttctattactttaataaattaatagatttcaataacacagttacgaatagacgaactgtagtatcatttacctaaatagccatatttgcaatgtcaccaattcaccctcttctttttcatattggaaattaacaattatgcaacggttgacactagctagcgtacacaaatgcaagtgtcaacttgatctgacacaagaaataaatctaacatgcacagacatcggtccccctctctctccctctttctctcacacacacaaaaaaattatttttttaaaaaaaaaagagagaaaagaccgtgcaagggtaattgggccgtggtctaaagttagtggtcggttgagatcgtgttttgaccagaatgaaatcaaaaatccacagcgcgcgcgcgagcgatcgatcgatcaagtagtgggaggttacacttggcacctcgggctactactactcccctcccttactcatgcagatcgctacacactagtgagaacgagtggaatatgctcggcctccaccgcccgcacggcacaaccgccgcgcgaagagctccatgctgctctaaacttagcccccttccgaccgctataagaccagattttcctccacaaaaaccactctcgttgatcactccgcacccccctcaactctctctatcgatcgatcgatcgatctgtgcctccatccccgatgcccccatcaagatctcatcatcaggatcatctccctgccgccgccgccgagtgaaatcaactagtgtatgcctctcactgtggctgagatcaagtgaccgaggaagaagacgaaggagacggcggccggcggtgtaaagctgtatagctagctctctagctctgcgtgtgctcggtccccgcgccgcagtgctgtgcctgtgcctgtgcctgtgcgctatctagctgtggagatggaggcgcggctgcggctgctcgtcgtcgtcgtcgttgttgccgggcactgcgccgccgtcgcgtccgccgccggtaactcgtcggtggtggggtaccacggggacccgacgttcaacgtcaggaactacggcgctaaggggaacggccaaaccgacgacagcaaggtagctgaggaacaatcgatcgatcaagctagctccttggttgaattatcccctagcttcttggctaactgcgaggtgttcgtccgcgacatgcagg

SEQ ID NO: 44161 - DNA, 1501 bp, Oryza sativa
ttgtgttcgtacgcacgcgtgtatgctgtgtgcacatgcgtgtgctggaataaaaagtgtcagatgtaaaattaacatgcttgatgtagttctgttcaatgaaagggctttcgttttcatgtgtttttgaagtacgcatctacggatctacttatatcgatgaatgtaatcatgtagccgtgtcagtgtatgctgtgctccctagtcgttttgattttttccccatttttttgaagtttgatagaattcagagataaatataatgatatttttaacacaaaatgaatattctattaaaatatatttaatgatatatttaattaaattattttggtatcatatatgttgctattttttttataaatttgatcaaacaaaaaaacataaaggagttttaagagtcaaatatgaaaccgagggagtacaagatattgacatccttagttttgccaatccaataaaggtaagagaatatgttatccacgtgcctctcttaaatcaaattgatccaacatgcctctgcctcatgtaaaatatttttagaacttagtatccctattgtttcacctttttagaacgaaatactgatatatcatttccatagcctaaaaagaaaacttgttcggcaaatatatcatttccatagcctaaaaagaaaacttttttgccgggtcggcggaaggacgtcaaccaaatttctttaagataaaaagagggtaatataatatacatgatattacactgtcgagtcgaggggaaacctcgaaaaagaacgtaaaccaaatttctttaagataaaaagagggtaatacaatatacataaaaaaagagggtaatacaatatacatgatattacagagtcgaggggaaacctcgaaaaagaacaggaaaactatttaaggaggccaaaaacatgctgctactcctcgaaagaaaaaattccggccactcttcagatcagaggacctcctgatgtctgccaccaagtgttctaccaccctttctgttataaaaatctttacgtttcttcctttccaaagcttccagcagatcaacatgaacagagaatcgaaatccttacagcttccagcagatcaacatgaacatagaatcgaaatccttacgtttctttctttccaaagcttccagcagatcaacatacacagagaatcgaaggcggctctgtgcctttgaccgaaaacagagacgcacctgctgccaccattttggaagctgtaggccgagctgacggcaaataccttgtctttaaacacaattattaattcttctctagtgttcctatcccacaagaattattttcttactgtccttacaagttatttccttgcggattctcgatagattttggcactttgccatagacttatacacaccattactggtaccatgtatgaatgcgatcagaattcatgtctatgtgatccctacaccaaaacgcatcagtagtggaatggttttgcagggtgaaacacagcgaaga

SEQ ID NO: 44162 - DNA, 1501 bp, Oryza sativa; identical to SEQ ID NO: 35247

SEQ ID NO: 44163 - DNA, 981 bp, Oryza sativa
tctatgatatcctattcaatccctaggttagcatgcgttgctcgtcgtgctaataaatcctctcttcttaaagcccaagtaggacaaagaaatgcaagtaaataccctcgattcattccttttatgcgagtgggaaagctagctagaaatcaatgacaaggagtagagcctagagcaaaagggcctggtgtcaggttagttaaagcaagaaagtcaatgctggtgcttgcttattcaatccttttttctctcctcctttgtgctaatcactaggtcaaaaggaacccttaatatggagttttatacttgttcttacttgtgttagtgaagccggatagttcaacttgcctgcccaaagtcaatctatgaaaagtcttccttataggcgcacccagttgtaagagagtagaagcaatcggagtaaataaatcccatagtgaaatgagcgttagatgttgactagacaaaactagctaatacatgtagtagggtaacttttccttttttcttggttatgtgaaaagggagaaaactcgctacactttataggaaatgaactactcttaatgcaagctagtcgagctggatgagttgttaggaatggctcaacccaggcagcactaaacctttcttttccaggcaaatctctcacttcaatctttctgggctagctatgttctcggaccccaccagagtaggtttcaccatcgagtaatgaagatgttaacttctagtacaagcaagcaaaatctaatgcccgagaaagagggaatggcattgaggcttcatccttggaagaagacgggagtgctactagggacaaacagagttctggggccagaggaaggggaacaaaaggtagaatatgcgggttatcgtagaatctctgagtggcgatgccctctactacctaatactaaaagaaggggactttgaaagccaaagccaagaaagaccatatcaactactctccaaattgca

SEQ ID NO: 44164 - DNA, 781 bp, Oryza sativa
aaagaaggcgccccggcaggaattctgtaagcttgacttgcgcgcagcgtttgggaatcaaagataaaaaataactctatgggacttacggaactggaaaaaaggtagcacctaggcgtaagaaagaaagtaaatagagacagcacctactacgctatctattgaagcttactatataatatataaaagaaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctaccggcagggcgctgcttttaatctgactgatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcacaga

SEQ ID NO: 44165 - DNA, 957 bp, Oryza sativa
ccctatattattattcccttgtacctcccttgcattaattatgcatctccggtgtggcttgctgagtactgtggttgtactcattcttgctcaatcttttcccccttcagtaagagaaactttggagaagatgtcttaggtggagtcctggcttataccccagttgagcgcctgtgaagatggagccgtaggccgctagtccgctgctgtttatttttgtttgtcaggccttaagtgcctttgtaataatgtaaatattaccgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaactatttgcgaaagttcctcttttcttcttcccctaatgctatttgcaaaaggtttactcttttcttccttcttcaaatttcaattagtactagttggtcagatttgtgaagaaaaagatatcgtcagttgtttgccgaagctccggaagactgcaggatccgctagcgtagcaaaggaagcagtgaagccagctgtgaagcaggagtgaagatcttggaaaacccgtcgcagaacctaagccgccctatagggtagtgttgttagtcgtgtgttccttgcttgtgtgtgtagtgcgtggtttgcatcggtgggttgtgatgtgaccatgttaggttgtttgtttaatcaacttgcagaataagcataacaaacaacacatcaataaaaagagttagttcctttaaggtcctgtccctagctctggtatattctttccttgtatgcttcctctctcaacccctaccttgtgacagatggataacactggtaacaaaggctatgggaa

SEQ ID NO: 44166 - DNA, 1501 bp, Oryza sativa
ccacaacaagatcttacatgattatattctgaccaaaagaatatatgtttcagttggaatccaactacgttgcacattttaactttatatgttctaatgaatttttatcaaatgttgcatgtggtgtgttacgtggatgtgacttagtccaatgttttattgattcatttgaaaatgttgcacattgtattatatgaatgtttctgtaaaattacgtaatgtttcaaccatcgcacctcgatgttttatatagtatataaaagtattttacttaaaaatataatcatttttactcataatatgatcatgcgggatctttttataaggatttaattataataaatataatggtataatcggattgtaaattagatcaataatttaggagaaatatcatttaaaaattgataaaagatattgcatggatgtgcgtcaaacctacgcatgacagagaagacaggagagacagaggagagaacaaggagtgcagcatgcaagcatgcagagatggctacaccaaatagatattgcagcatggagaagggcgctcgactttttcaattttatcaggcacccgacccatagtcttgtcggtacatttatgcgtgtatttgggtatcatattgtaggatgagtttttgacatttataaatatggtgtattaaccaggcaacacctaccacacttcaaaagtatttgtccacaattattttttatcagtattgtttctataattttctaacatattactttgctttatagtatgtcgtacttaattcatccttatagactttaattatttgtaatctttttccccgcaaaaaatatatttataatcttttcatcatctaaaaaggggtaaaataattttgtttaaaaagcattttatattagtagtggcagaggcctttcaagccctaaaacaggaactcattccagctcctgaactagctatgccctaagccttatttttctcaggttgtttgtggttgagacaaatgcatcccatcaagatattgtggctgtgctgatgcaaaacgaccatcttatcgcttttctgagtcacgcactgggtccacgacatcagggtttgtgtctacttatgaaaataagagcttagctatcatgttggtgattgaacattaccgtctgtatctccagcatgatgagtctatgagccagaatgcatcgagaaggtccaggaggagtacgtttgttgatttttagatcggcaataacagaaggggtagcacagagataatgagttagagtattcggagcaagtgtgtgccctcaacttcactgtcgagcacatagaggcctcccaacgcgtgccacttccccaaacgaacgactcctctgtctcggcgtcgcacacggtgcaagatggctgcccactgcccgaggacaatgacacgcacttccacagttataccttcctggcacatcccactggcgcattggaattcccgacgtacgacggcaagggtgattcgctccc

SEQ ID NO: 44167 - DNA, 1501 bp, Oryza sativa
gaagaggagctccttgaagatgaaggctttggtgtctagctcgtgcctgccgtcaagtgcctgtggtcgtcgccctagtcttccgctgttttttttgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaataaaaatcctttgttatttgtgaaaacccgctattctctcttgtcttgctgcttcatttatcgtcaaaatctggcctttaaaatgttgtttctctttttgtttttgtttgtagatggccggcagcgttacccgtcgtggtttgcacatgactggcttcgtcttggagctgcgaggcatgtgcgtggtcttggggtatccacacggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgtttttctctcgtttgtcttgttgagttgtgtggggcatggttatgccggtgtgtggcataactatgtcggagcctgtctttatttgtttgcctaagcaacttgaaccttaatgaaccaatttaatagcagtgataaatttaagaataatagtagtcgtgggtggttagttttaatcgtcagctctccttctctgtttgctggttctgtgtggggttttc

SEQ ID NO: 44168 - DNA, 347 bp, Oryza sativa
tttcgtgattagtctcacacttctcaccatagtaaatgatgcttaaattggtaataatttgattagctcctggtttggaatggtacattcctggtttggagatagacctgtgcagccgggatggttgttcagaatggatgggcctatataacagggtatgttgtatagcgttggattaatattgcttaattaatacttaactgttttattaaattctcaaatgtttgctaaatgctgcttttgcaaatggatccctattacgccatcctttgttatcctgtgcacttgcatatttgctgcgtgacttgctgagtatgtgatatactcaccttgcaatcattcatcgg

SEQ ID NO: 44169 - DNA, 1501 bp, Oryza sativa
atagggaacgcgtcgacgatggtggccactgatagtgggcctcacaatttttcattttattcttgtcactgacatgtgggtcccacaagctgactcagctagtctacaagtcaaagatgccacgtgggacaaaattgcctccgaaaccgttcggggagttgattttcatcggttttgggaattagggggttataccctgttttgcggttgagggatgtgtgattcttctaccagggacatgagttgagaaggggggcaaaatagacttattcctttaaaattctgcttggaaggagagggaggagacagtgcaggagtagatgtccaccttcgccgggggagaatggccacctcccaatcgatgggcgtggggtggagatcctcgccgccgtggaggccatggcgagggttggggaaggagttgatggcgacgtcgcggccagtgaggaggttgttgccggccttcctggccccacctcctccgcgcctgtggcctctacaacactgtgttacccatcactggcgccgacgccctcatcctctcccgcctcactccgctgacctccacctcacctgctggccggcctacctagaaaagagtgagagagaggaggaagggagagaagaggggaaagagagggtgatgacatggccaccctgacatgtggggcccacgttgactcagttgccacgtcggaaataaccagggttaaaactgcctaaagacccaaagtaacctagttttgttagttgatagatgacatatatctcgtggttttgtaatccgatgacaagatgagggacctgatatgtacttttttccccctaaacactcccaatgtggaagtaaacggccccattgttattcggggaataagcgaaacgacatatttacaaatgaaaaataatttgtgaatataatttttatatacatgttcttagcaatctaaaaacaaatgttaaaaaataaacttcgatgaaaaaaaccctaaaatcaacaataaactttaagattataaatttaaattgtggctgataagtataagtataaaaaaaaagacgaggccgaaaaatcacttgggcctgttctgttagtccagcccactaggcaactccaacggcggccgcatcaaacatggcgtcggccggaatcgcagcgccaagcccccagtctcctgtccccaatcggcgacgcagaacagaacgcgagcagtcgagcagcccgaccaccttgaccacatcagctgccagcagagcaggagctctctcctcttttttgacttcaaacttgcgctcgctcggcgacaagctcaccaccaccccatccttttcttttaccttcttttttttttcttttccttttttgctctccatggcttccacctcctcatcagccatcacctctccctttgcaattctctaccaaagcgagcatcactactactagtgctccttccactctctcctcctccttacactgtccctccatggaggaggcccc

SEQ ID NO: 44170 - DNA, 1501 bp, Oryza sativa
atgaaagagtggtacaacatgatgatttgacaacaacatatttatgtgtaagtaagttcgcgtgtcaatacaattgggtgactgttggaataagtcttttcgccatgttgacaggcgaaacgattttgtgcaccaacaagttatgagtactactttgtgtaagggtatgataaccaatggcacaactttcctcatatgatcaccaaaacaaagtacaagagtgctagggcaaggttaggaatacaaaattagagagcatgaaaagacatagcattaacaaaccaaatctgatatggtacatgtgtgtgaggtgggcacaaaatgatctttttgctatgcatgactaggaaatccattggaacaaacaatattttcaacaaaacccaataggattcctagtaggctcttcgagacgtagggtggagaaaatggaggaatggtaagaatatatgatgactttgataggaatgtaagtgtaaaacagtggatgacatgaatgcaagtgcaaaaaaaaagattgcaaaagaaaaaaaaaatctatgagtgattgtttgattagatttcatgaaaaatgcaaaaatcaaatgagagaggtggactagaagtgaaaattttcaaaaggttagagctcttgctaacttttcttcaaaatttatatgcactaaaccatcccttaggaattttggagccccattgaattggaggattcaatttccaaagaaaattttcccatggaaagcttttgattcataggaaaaggattaaaaaaatttcataagaccttcatatggctcaatttcatagggaaataagccaagaaatccaacctctcgggaactataatttgctttgtttatttcctatgatggtattaaagggaccttcttgagctttcccgtgttttctattcatgtaggattagagaaacatgttactttaatttctacggttttcctatcacacgtttcaaaggagtcactttaattttttcctacaagttgtttggcaccaacaaaaatgttataatcttttagaatggttcccattcctccaatttcacaaccaacaaaagctgaaggaaaacaaaatccttcacaccgtttttttctaatatacttaattaatcatgtttcaaaatttgtatgttttcaattccatagtcatttattttgtgctctcgtattttttttctgtttatgtatttttagtcctttgttccaaataatgagactatggaattttgaaacaatttggaatgcagattctgagaaaacgaaccaacaagagagagacgtgtcgcagacgctccatatctcaaccgcttccatcctgggtcccacctgtcagctagccacacccttgataaatacccgtgaaacccaggatcccgtgggtaactccccaccttaaaccccagacaccctcaaaaaccctaatcccctccctcccgccgccgccgccgccgccgccgccatgggctccgcctccgcttcctcgctcc

SEQ ID NO: 44171 - DNA, 1501 bp, Oryza sativa
acctttactgctgcggtgcaggatgtgtctgatccattgttaggtttttttttagataatggataaaatccagcctctatatctaaagtggatatacacagccaaaggttgtttacacaagtgcatacactctaaaacccatgattgagaaacatgaaaaagaacaaccgaaaagaaaacactagaaagtagatgcggagctagcccgcccttccacacccccctgctgtcactgcaaccaccataaaagcttcttcattctagtctaatcaccttgtagttgccaagcaagggtctcatgctgcctgaacaacctactcatctgcggtgctaactactatcgctaccatgccgtcgtcgctgtagagaaccatcttcgtcgagctgccatagtgccatagcttatctcgccaaaagtcgtcgttgctacactgacaccacatcacacgacaaccaacaccccaaaatgcaaacgacaccctgttgccccatcgcccacctccgccgagcggccaaagcttatctcatcagaggacctccgctgccaagttttcgtcattacagaccaaaactttcgccaagccgttgtagcttatctcaccgaagagttgtcgctgcaatgccgatatcaccgcagaacaatgattcatcttgttaggtttactactgattcttcttgtttacaatttttcttgaacaatgacctctctaattattttaattctctctattttttcttattttatcattattttgaatggagttcaatggttaaaacggatcttaaaaatatatgtttgaaatatataagccatcaaaaaaatttaaatagacagtatacatgtattactcacattgtcggaggctattgtatgcgtctcgccgtaagattaattcgtgcgtgcgcgccggttagattttatcaatttggacatatatccaatgttgttttcacttgccttaactagtaattaataaatattgttagacaaaagtgataggaaaaaagtcaacatgttatttatttatattaaaaaaacagaggaagtaaaaaatgtgaaaaaccaacaggaaaaaaaatcgaggaaagtactctgcccggccagatgctcagccgggcccggtgttgaagcgttcctccggtgatctggactatttttcgcggtcaaggttagccaaatttaggacttgagaaaccgtccctgcaagcaaaacgaaacgaacaaaaaaaaaaaatcctggatcaccaagcttatttataccactcagtcacactcactggagatcgatcaagacgacgacgagtgatcatcctcatcatccatggcgagcagtaggctgttcctcgccgccgccctcctgtgcctcgcctcctccgcccaagcattcaagaaggcaagcacaaaaccacacagaattcattcatctactctataatttctgatgaatttcttgtgtcatttcgattcagtgaaacaaactgggtgtgatcctttctgat

SEQ ID NO: 44172 - DNA, 1501 bp, Oryza sativa
gccaagcgtaataccctactcctgtgtttttgtggatttgtgtatggacaagttacaaaggattcacttcctttcccctccgccttccaaaagggaaaaaagtcccctctctaaatgggcaaggtcctccttttatatctcaaggggataccacatgcccctttctctttccaaactggactgttctttttctctttaatgggcggagatcggtacggtttccatccgggagcccttctgatgggacatcccacacctacccccacctcccccgaagacagagatgacgcgggaccgtagctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacagtagcccccggcgttatgccagagcaatttcccttctcaagggaagcggtcaggtgtgacgccacccctaaagcctggtgacaggtgggaccggtctccgtagttgggcacaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaacgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccgttgttcctcttgccttcgccgcctgagctctaactctttctctgctacgccctactttcgccacacgcgctcgttctcaatcatctcttcctccaccgcca

SEQ ID NO: 44173 - DNA, 650 bp, Oryza sativa
tgtaacgttggacagtgattggttaatatggattaattactacaactgttttactgctttcaactactgctttgaaatgccggctttatgcaaaagaacctttagccccccttggatatatcttgcatcatacctcctcttctggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctaggcgtgacagcaaggcaagtcacacagatcccaaacaaccctttgagcatgttgatcccgtttaaagctattgtttctattcaactattgcatttattttcgaatgtcattgggtgaaattaacctattgtttgttatagcccttttgttcttgattactttattccttgataccttg

SEQ ID NO: 44174 - DNA, 1501 bp, Oryza sativa
gagatcgtggagggaggtattgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgtcactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcagaaccgctgaatgtacgagcgaagcgactcatcatcgcctcgctgtactgcatgcaagtccgcttcttcgcctgggcgcggatatgtgccttggaaattcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcacggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcaacggcgtggattcggctccccgtcgtcgccgctcacactcggagagaggtcgtgcgcttttccttgctcggccattaggctgaacaagaaaaacttggcgcacacggaagagtctgagagc

SEQ ID NO: 44175 - DNA, 988 bp, Oryza sativa
gactttttagggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgtcaatttcttttcgaattttaattaattctattattccttttagcgaatgatttttaattcgggatgaatttatcaggacgtgacattaacccaacgctatacaacataccctgttgcataggcccaaccattctgaacaaccatcccggctgcacagttctatctccaaaccaggaatataccattccaaaccatcccggttggcacggttaatgtttcacagccgaaactcgtgaaccggtccttaattgtcatgagcacgaccatcaaaaccatgtgctcacaacccaccattatcaggttttagttggcaaattaattaattaaccaatcacgattgaccatcgtgagctatcattaagacatcattaaataatagtgaattataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaatttcacccaatgacattcgaaaataaatgcaatagttgaatagaaacaatagctttaaacgggatcaacatgctcaaagggttgtttgggatctgtgtgacttgccttgctgtcacgcctagaaattcacgaaccagaatttctaagctgaatgtgcattaaacccctgtccaggaccagccagggtacacaaacgacaattgttgacatacagatccacgtcttacaaaaatataaaagattacaaatgcagcggaa

SEQ ID NO: 44176 - DNA, 1501 bp, Oryza sativa
aggaaggcaggggagcacaagaaccgggtgctctctgaggccacggctgctgatagtgccagatcggaagacgatgacttgatcgagcaagtgacaagcaaggatggagaagatgatggcttggcgacggtgtcagttgatcagcagcagataaccacggcatcccaacagcgatctgcttctgaggttgatagtttattattgtcaagtttttatgtgcatcttaccaaatttagttatgttgtcacctgtggattagtcatctggacctttgggacctccgcatgtgctttagcttctatttgggattgcattattagtgttggggccaaactctgaatttgtggtaggtagggaaagtcttttttgtgcctattatacctaacttatcaatatctggtaatgttcctttcttgtgaaaagacagtggctactcatatcttgacgtatctttcttttcttgtcgtagtaggtcaaagtacctaagatgcaatgatgcattattttcaacattaaagaatgtgttggtaaattgttctgctcatgtcgttagaggaaaccatattttttagttgaacatgaattaatttatgcaatgtagctccgtacaaagtaactcagttgttttgttttcaaatgtgtgggtaaaatgctgtaagggtgtccttcagaaaagatgatgatcatagtttatctgacaatgttaatgcacagtttactgtaacaagatttatgctgttaaacaactagactaatgattaatcatggagtatgtcaagattcaaagcatttatgtttatcaattttgagaatgtgtgtatttggttcagttacggtcttctgcttcaggctaaagttaagtttctttgttatggaatgttctttgtgcacgcttttgttaatatgcttgcctctttcagccattccttaactttcctgtaagttaacttgactcccaatattcttgcctttcatgtttgtccacccaaaccgtttcttaagttgagattcttgtaccaactttgcaaggcatccctaaagtgtagaatcttggcacctgatgtgaagtccatttcacattatattccctcaacctttacaaatacaaggcacatagcaacctagacaaagtttcgttttgggaaatgaaactaccagacatttaaaaggctactcacatgagcacgtgcacacacattttcataattccttttgttgagttgactagaaatttctagatttggtagatctgttcacatgtttgtgcatccatatgctggggtcacctaaactgtagcactcatgcagaatttgtgccattttattatcaagtaatggtatcataattctgttcttgaatttcctttttaacaaaattcatttgccatatgttgagataatgatttcttgctaaatggtttcttttttattgcatggtcttctatttacaggcaagttcattggagaatgtgcctgaacagacatccatggaaaactctct

SEQ ID NO: 44177 - DNA, 1501 bp, Oryza sativa
taacttattttctgatgtattccaatgataagaggagaaatgactagtatagtagtatgtttagaatgttatcacaaattgggggtgggggatagaatgaaaattttattcttctttgttctcaacagtcacaccaggtgcaagtaacataatatctaaatctgatgataaaggcttctggtcattttcatttacagcatgtggttgttagtggccatttctatgtggacagacaaattcgaacaatattcagttgctttgtttataatataattgtatttttttattgtagaaatcaatatatgaatatgaattcttactgtgatgtttcacagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttccccattcatctatttgctgctatcactttgttttcagctggtttgtgccctaaactagcattttctttggccttctgttacattctgttttccaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaatttttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattggatattgtcgtttttcttcgctgtgtttcaccctgcaaaaccattccactactgatgcgttttggtgtagggatcacatagacatgaattctgatcgcattcatacatggtaccagtaatggtgtgtataagtctatggcaaagtgccaaaatctatcgagaatccgcaaggaaataacttgtaaggacagtaagaaaataattcttgtgggataggaacactagagaagaattaataattg

SEQ ID NO: 44178 - DNA, 1501 bp, Oryza sativa
aaatacacaaaacacccataaatcttctagccgcaatcagctttgccaacaaattagcaagacggaagttttgcagccggaatccacttcattaacaaattggcacccaagaatgccagaaatcttatagcaaaggatcgtccaacaaataaatttgtgtgctgcaaattaacatattaggttggtaatagaaggaaccttcatgttggttcaaattgtctaggaaaacaaacattaattacaaaataaaaatataaatatatctattgatttatctattaacttattagaggaatagaaaaaagagcctccacattcgctctcacggtctagaaattctcatattaatcggagaaaaagaaaaatagagttcatatagaaatacaatttaaaaatagttgaaattcgaaattaaaaaaataaggaatattggaagaggagactagacaattaagaaataatagaaattcggaattaaaaataaggaatattagaaatagagtatagagtccatatagaatttaaaactaacgaaagttcggaataaacataataaaattaaaactagagtttagagttcgtataaaagtacaatttacaaataactaaaattcaaaatttaaaaaaaacatgggaagaacaatcaaaagtcaatataagaatacaatttagaagtaactaaaattcaaaattaaaaattaaagaagagtaaattgcatccacggtgcatcaacttggtaggtaggtgcaatttagtgcaataacatgaggaatgagtgttccagtgcaacaaattggcaggtagatgtaatttaatataagaactttataagtgatcgtataactacaacatcttgcaaggtaggtatgattttgatacaataaattaaaaggttatgtgacaacttaattacttggaacattttttttatataagtctatttttaagaacttattttgacaatatactagtgcggatttgtataagcatatttatatttttatcctaataaataataactgaaagtcaattaaactggatatagaaattactatatttcgattgatatttgagaaggtgaagaaaaccaaaaaaaaataatcttaaaggcaattggatgtaaattgtactactatgtgcagtataattcataattattaaattcaatataaggtaatatccgtatgattactatgtaatggcatgttgacatagtaaaaaaactcacctaagatatgcttagccaagttaatacaccaaaatactaaattgttaagtttttgtactagaacgcacccacttgtcaagttgttgcactcggacattcaattcttaaattcttatactatatcgcacccacctgtcaagttgttgtaccgtgggtgcaatttactcattaaagaatattgaaagatgagtttagagtccacataaaaatacaattagaaataacaaaaaattcagaattaaaaataaataatattagaagaagagcctaga

SEQ ID NO: 44179 - DNA, 178 bp, Oryza sativa
ctttttattttaatcgattgaggcattgggcgatagaattgtgttaggtttatttctagctttgccgtactatcaagaggggtaataactttggtaaagaagtgatcaaaatgacacattatgtcatttgcatgatggcttggtttgatagttttatttatctatctttctgtctagg

SEQ ID NO: 44180 - DNA, 1501 bp, Oryza sativa
gcctcgtggcgagcccggacacccggagcacggcgcgcgccacggcggccaccgccagcccgtgctcggcgaaggccagccgcccctcggggcacttgcacatgcgcttcaggaggaggagcgaccgctcggcgacgtggcggtcggcgtcgaggaggagctcggcgaggacgcgcacggcgcccagctccacggccttggcgcgccgcgcgccgcgggagtaccgcgccgtgacgtcgaggagcacgtcgagcgcgcgggagctcagcttcgcggaggcgccgtcggagaggagctcgaggagggccttgaccatgtcgtcgacgtcgacctccgcggtccagtcgcggacgctggccctggagatcttggagatcatggacattgcgtgcagcctcgcctcggcgctgccgcgctggaccagcacggacacgggccttatgcactccggcttgagcaggagctccaccgacgcgtcgtccgagagcggcagcgtggcgaggacggcggcggcctcctcgcacgtccggaacgccgagaagtcccccccggcggagctctcctccagcgcctgcgtcatgacccggccgagcacctggatgccgccgcacgccacgaaatcctcccgcgccgcctcgtcgccggccatgcaggacttgaggttcttgagcgcggtcgccttgaacggcgtctcctcaatgccagcgagcaccgacggcaacctctccctctccatcgcgtttgacgacgacgacgacgacgtcgtcgccggcgagccggccgtgctcggcgacgacgacgaggaggcgcggtccagccacgacgagatgacgcgcttgagggtgtggttgggagtgaagtcgaaggaagcaagccgctgcatggtggccgggcacgtcgtcttgccgtacttgaagaaccaccgctcgatgctccggcggtcgtaggtgacgccggtggccaccgtgacggggtcctccattagctccatcgagatggggcacaggaacaggggaggaggctccattgccattgcgatcaaacaaagcagcagctcgatttcttggcttgagtgagaaggttgagggagaccaagctgggatgttggttttatacctgtaatgtcatcatatgcaattaaaaagtcaagctaacccaaagtacagccgcaaaatggctcaaattcaaataactaatgaaatactcccttgtcgaaatataggtatattttgtttcgttaggataaagctttgactaacaattgttatactaatatactagctctatattacattgtaatagatgacgccgttaacttttgggtacacgtttgaccattcgtctagttttttaaaaaaattatgtaattattatttattttattgtgagttttcttatcactaaaaatatctcatatatttacatacaatttttgaataagacaaacggtcaagcatgtatctacaaacaacaacgccatctacaccaccacaccacattt

SEQ ID NO: 44181 - DNA, 1501 bp, Oryza sativa
aggccagctagtgagctccctgctgccatatcctatcatctcctctcttcctctcctcaacgtgcccctcttcccttctgttgatgtggctagcgagacaaaaaaaaacaataagtacagttgctatttgcttgcatgcgaaagctcagctatacataggaaaagaagagggaggattcagtgatagcactgattggtctgggtgatatggcctattctgattgggtgtggttggtttgattttctgttaagcaagctccaaatgattttttctcctaaaccgtttatctaatttatgatttgattacactattatatttgttacaattaaatctttaaaacaagatctcggatgattatatttttgataaaaaaatatatatgacaaatgggtcccactaacttatggcttttcccatccgtgctatatccctccaaccaaacaagaaattggatcgccatatctatacaaaccaaacaaaaatttggatagccatatccatcaaaatatgtatggacatatcccatccatgcatgaccgtgaaccaaacacacccttaagtatcctatcctctagtctctctcttgattatgtggaatgcactgttctcaagcagtaggtgccacaagcgatgggcttctcagctcatcatgttcaccactcagggccgaatgaaaagcccaccgacgcagcagaaaggcccaaaaaaaacccttcctagtagtaacaaacaagcagccacgcttcccttggtttctcagcgactcgactccgcccgtccggccaactccgcggagtcgccaacacgaacccccctcctctcttcctccctccctcggtctcatcgaaaacccccactattactaccactccccctcgccttctccgcctccacagcgaccagcagccgcgccgagctcccagatccctcgtgcattccaccttctcccgaggtgagccacccgcttcctcctccctcgtccccgatccgtgccgcccacctcctcgctcgctgtgcgtggcgcggtgtttcactgatctgtgctttgcgggagaaaggaggagagttggagatgttttgtttgtgttgtcttgttttgtttcttggacaggtcaagtgggggatgcgggttttttttttcttgccccagggtttatcagcgaaatgtttgttctgtccaaatcgtgctcctggcctgggtggggaatgatttgagcgctgcgtcgccggttttgcatgttagatttctctcttgatttgtttgtgcaggataggttctttaggcttgtttttttttttcttttttgatagattccatagttctgaaatactagtttctcgagtgagctttggagaatggaggtgatacaaatcttgtatctttgtttcgatttgttctgtttgcctgaatacgggttgaacagttgaggctgagttagtagaaggacagatcattcgtgtaatgtgtgctgtgatgatcttttgatgcagcaggacga

SEQ ID NO: 44182 - DNA, 1501 bp, Oryza sativa
aggaacaaaacgcagcccggcctgatgatgaattttttaataatccctaaacatagagtacctattaactttcatattgtcaagttgcaccatttttttttaaaaaaaaaactgaagcgcctgatctcgatgcctacctacatatgaggatatatgacgcgtgtttttttttttctctttgatcattcgacagaatccctccttgtccgataatgaatagaacacacgcactcgaatcggattcaacagagcccccgacttttgttataataagttagcgtatctctcgcgcactaacttcaggcctcatcgatcattcatggcagtcgaggcatgcagcatatgtcgtcgaagaggggcaagagagcacgccggtcgtccgccggccagccgctgccggacgaaatgatgacagaaatcgttctgcgcctgccggcctattccatcgtccgtttccgcgctgtctcccgctcatgggccgctatgctctcttctcctggattccaggacggctacgcggccatggcagatgcccgtcgcatgagcatgagcaagttcgtcttctttgcggcgtcgccggcgtcgcccagaggcgccacggctgtctactcctgcgacgtcggcccagtccggcgcatcacgacgacgacgaccgacttgctcttcaatatcgaccgcctgcgcccgggcttcctcgtcgtctcaagcaggccgtgccacggcctgacgctcctggctgacactcgatccttcgcctactgggtgtgcaattccagcaccggcgtgttcaggccattgccgcggcggcgctgccacgatctgtccagcgccggcctagccttcgacgatcggaccaaggagcacaaggtggtgcatctcttctgccatgtgagccgtggcggcgagagtgagtccatgaccatggttgcgaggtctacacgctctgcaccccaagccgcccgtggaggccagcctccggaggcataccggggcgtctcggtggcgtggtgatctgcgccctcctctacgagggcgcggcaaccaaggtgcccccggtatacgccaatgggttcttgcactggcagctctaccctgacaaatacttgatcaagacctcttccctgacacgacggtatttgagaaccgaaacagcagcgttccagtgctatgcttctctgttgccgacgaggccttcagcctggtcgctgggccggcggtcgacggcatagcggattactgcgctttggacagccactccccggctgttccactccacctggtggagctccatggctctttgtgcatggtccgcgatctccgccatcttccgcatggtgaaagctgcctggagatatgggcgctgagagattacagcgccagcgtatggtcactcgacttccgtgtcgccatgacgccgcaggtggcacgcgacatgcacgatccccggttcatcaccgtccttggatgtctcggcggcgcgcgcggagacgacgtcgggagt

SEQ ID NO: 44183 - DNA, 319 bp, Oryza sativa
  unsure (1)..(319): unsure at all n locations
caaccatctccatctagcaaagagctaaacctagatgggttttgacaaataaaccggctagcggagccaatttaagataactacccgtctcgtgggcaaaacggaaggttttcaggacaaacctacaaagagatgtcacactctcgcagcggcggcagacggtttacgacgcaaaccgacaaagatggacaaactaagagaaaactaaaagcaatatgaaaaaacgattcaattgattgattgtagattggatttttacgatgaanaaanccccccccgccatgtcccttatataggggttggtcttgccctctacagg

SEQ ID NO: 44184 - DNA, 1501 bp, Oryza sativa
acatctcctgcgctatgcctggtggtagaagaaccaactctgatctttatgccatacgcggaccgtgtcttctttgagaatttgctcatcttgaactggagcccggacaagctcgggaagatcgtcgtgctcgggcacagtttcagcaccatggtgaagatgcttgagctcagcatttcaaagcaagagaagtgtggtgtcaatgagcagagggagaaggtgaagagggtactggcaattccgagctatgttcaggaattagagctttgtgcagagatatctggcttattcgataaccctctcttgggagatgagtatccttatgaattgaaccagtacgactacaataattcaccagagcagtgtacatgcatgcactgcgttgcgcgtatggaaagcggtgctttgatttgtgctcttcccagcaccttttcaattcatttctttcacctcgatgctgaaatcgatatggaatatttgataccaggttcttttgcagctcatttccttttttttcaaagcttaagagtgtgtgtgtgtgtgtgggtgggtgggtctgcgcgcgcgcgccaatatggattgtggcattatggtcttctgacttgttgcctctttcttcgatgcaggtaattgcgctacaagggtcgggagcaatgtcaatgtccaaatgggctatgatgctcagttagaagggtaaggctacatactgccaaacgaatcatttggattagttttccatgcttatttgtttgcctagttctatgaattttaagctaaatgaaagtataatttggtttcaaaaataaaagaaaggatgatgcaaacaagatatgtttgctaaaagaaagggtttcttgtgtaaaaggggttctctgtttgagtgagatttgctttgtactattgctgcagtgcaggttattgttttgcttcggcgattaactcaaatttgtcctgaacagagaaataaaaacaacatatttttgtaaaacatgtttgttgttttactgcagtcattaactttaacaattggtttgttgcgatatgtcacatgtgaagcacatgccttaatttttgtggtatatttttgttgttcactattgatgacttcaaaactaactagctgggtggcccgcgcaattgcgcggctagcacccaaacaaaatcatatattttttatgatattacttaaaatttataaaatagatatctcattgtcttaagactttgaaagactaaaccttatcatcctcgtgtttctaattatatagttttttaaagtcacaccagttgctaccccttatgtcatcttcttctttatttgcttgctcgatctaccactatttctattcattcttcttggaacctttaaaaattggattttatagtttttagagtttattgtcacgttgtgtttcatttttataatttctagatgtcccgtcaaacgttgccattatactcctctacggcccgtccactgtctcttttctttattgtcatt

SEQ ID NO: 44185 - DNA, 921 bp, Oryza sativa
cagcacacccatgctgcacaggcccaaccatcctgaacaaccatacccggctgtacagatctatctccaaaccaggaatgtaccattccaaaccaggagctaatcaaattattaccagttatagcatcacttattatggtgagaagtgtgagactaatcatgaaagacattgttagacccgcccataaccgcgggcacggctattcgaatagttttactctggccagaggtgtaccactgtacccacaatacacaactccacaatatgtcaccatatcatcatgtgcccatgctgaacatgtcaccatttgtgtagttgtgacaagatccctcgcataactcaacccaaagcagtgcaccgttcctggatcgtagtcaccccctcaaaaccagaggcatggactcctcagcgacctccgtgggcttatctcctccacttctcagtctggtgctccacaatgagccttgctatacaaagtgtccagccgttgcccattctggcttgtggttggcacggttaatgtttcacaaccgaaactcgtgaaccggtccttaattgtcatgagcacgaccatcaaaaccatgtgctcacaacccaccattatcaagttttagttggcacattaattaattaaccaatcacgattagccattatcatgtccatcattaagtagtagtgaagcattagttatcccaatagtgtgctaatgtttctaagcatggctaagcaattatgtctaatatctagctgaaccaatatataaagctcaactagtcaaattataataacccaaggtatcaaggaatagagtaaacaatgcaaacaggccataacaaaggaataagttcacaccacctggtgacattcgaaaataaatgcacagttgaaataaatagagaatttaaatataggaccaaca

SEQ ID NO: 44186 - DNA, 1501 bp, Oryza sativa
gggcacggctgcggctgcgacgaagcggcttggcaagcgtggccgatgggttgaaatctaaaccaaggagacaaggatagacgtctcaccgatccaaaacgatcggagagggagggatgatgacaacgttccgatagcaacacacggagacgacaacgctagacaaaccacggattagattatattggattaagaccctagggaaaaacctacaccggcgaacggcatgggagcggcggttgccggcgaaccacggcacaataatgcaaacggagggcaccgggaggaagagcgtgagacgacggtccttaccaacacttacgcgacgacggacggcgacggaagatggccggcgacgagcttcgaagggcggcgaggtactgtccatggtggcgatggctttccggcgacgagagacgacaaccgaggggtggacggtcttcactgtttttggaaggggatcggtggcactgtgcacagcatgggagacagtcggttggagaagaaagatgaagtactgtagcacggggaaggcaaaacagactttcggccgggctgaaagaaaggaagggaaaaaaatgggttgaattcggcccaagactagaaagaatgattttattgcttttccaaataaattaaccaatgagatgatctttcaattgttaaaaatacttccaatgcacaaataagttcggaaattactagtgaatttctgggcgtgacaatctggtaatgcaagaactggtgctccactgagagcttgattcacagcttcaaaggcttgtttctgagcatcactcccagattacttgagttccttttcagcaatgtagtgagaggttttgtcatcacaccatatacttggatgaacttgccgtagtaaccagccaaacccaaaaaatctttgagttgcttcaagtttctaggtacctgccattattgcactactttcaccttttcaagatctattgctactccattggtgccaatgatatggtcgaagtatttcaattcctgttgggcaaaggaacacttgctttctttcacaaaaagctgatgttgttgcaatagagtgagcaccattcttaaatgttttacatggtgttaacaaccaaatttggtaatatcggcatcgggaaagaagtttagatcgaagcggagtccgaggcggagatcgagttcggaaacagagcaggaatcggctggagtccagatcggctatgattaggatcggctggatttgagtcgaactaggtaagctgatgcagccgattccgatagtgcaacttgatgtatgatatcgggttgaattgaggcgcttcaaggtgattgccgcacatggatagagtcctgagaaggcaattgtatctattaattaggatgttttatgtaatttccttagagatacgcattgggcaaaagtctgccgcaaagacttatggtatcttagagtttgttagagatggtagtcgtgtccgttatggacatatcttgtaattct

SEQ ID NO: 44187 - DNA, 1358 bp, Oryza sativa
tttcgtgattagtctcacacttctcaccatagtaaatgatgcttaaattggtaataatttgattagctcctggtttggaatggtacattcctggtttggagatagacctgtgcagccgggatggttgttcagaatggatgggcctatataacagggtatgttgtatagcgttggattaatattgcttaattaatacttaactgttttattaaattctcaaatgtttgctaaatgctgcttttgcaaatggatccctattacgccatcctttgttatcctgtgcacttgcatatttgctgcgtgacttgctgagtatgtgatatactcaccttgcaatcattcatcggaggaagagttctacaatgaggctgatgctgtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgcctcggctgattcctggacgagggttcacacacatgtaagcgtttggaattttggatagaaattccgggcgtgacaaaatcgacgaggagctgcggcaatgctgcgacgattgcaaccttcggtctcctttggcgtgcagactgcttgacaaacctgtaatccccttcggtcacctccacagaaactgcacaaattggagatttgatattgagccgtagattttggtgtaggcttcaccgggctcaaccagaattcaccatggagttcgtcgttgtatctgaggagcttgagctcaatccgaacaacaaactgtggagattatggataccccatatctacacggcggttatatttagactggtaataggataccgaatatagatataatatctttatttgtatctcgggtttgtttcttaacttgtacgtcaaggaaataccctgaggtttagtcggttacgattgtattttatctgtattctcgtattctgttaggggtatgagttataccttataatacggactccttcctctatataaggaggggtccgagtccttcctgggacatcaattttctaggagatcttacattcaataatacactcggtggtttcatccccggacaggagtagggtattacttcttgaataagaaggcctgaacctgtataaatcctttgtctccaaacccatccacttttccagcttgatagccacccccttttagtattgccgaaatcttgtttcgacagttggcgcgccaggtaggggttgcgtcaagcttttcgccgatcagtgcaa

SEQ ID NO: 44188 - DNA, 1501 bp, Oryza sativa
  unsure (1)..(1501): unsure at all n locations
tcgtcatcgctgcggcgtgttccacgccatcctcgcattcgtgcagccgctgccggctgccctcgtcgcctcctcgccggccccggtcgtcgtcgtcgtcgtcctctcgtcattcctggtcgtcgtggcgttcgtccctccgtcgagccgttctcatccgtcgtccgcatcagtcaagcaagccgcggcagccccgtcctcgtcttcgtcctcagctccgcgtcgtcaagccttgtgccagccgcgtctcgccttcgtccaaggatcgccgccgaagtcgttccctcgcggttcgcctccgtcgtccccgagctgtctccgccgcgcccgttcgtcgttgtcgtccccacgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgccgctcggtagccgcgtggtttccacgtgtgcaggccgtgtggtgtctagtggagtccgtttgtcggccactcgcctcggttgacacacggggtccacttccatcgacccgtggaccgtctctgtgtacccggtctaccgcggtccttagagtggggttatnatnagataaagcaaatagtggaggtctgcatgtctacggcgcagccttcctgtcttttccaggctagcgcttacacatattttatagtggcaaagcttaattataataatccgcaaatccccatataacagcattaaacttcggatgatcatatcttggtcatacgaactccgaatcgacccgttcaagtctcctaatgtttgttataacctaaagaaccctgtgctttctttttatgtattgttattgcttctttgtaggcttgtagctttgcttgtgtgcttcgcgtaactttcgtcgtcccggaggttcccgaagcgtggttcgtggtcgtcgccgaaggttcggaaggccgttccctctgagcaaggcaagtcacatcatccttgagcatattgaatcccagtttataaaattatttttatttaaattaatgcattatcgctttatttaaattcccgcgttatcactgttttatttagccatgcctatttacctttgttaaggcattattattgctattgttattattaccttgttcaccctaggataaacaaaaccccaactagtgggtactctattcatggttccactagtatgaatttaggtagatgcttcgctgattaattaggcaatattaggtggttttacaactttagacgttgggaattctcatatcatttggatactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 44189 - DNA, 457 bp, Oryza sativa
caaggcctacgatgattcagaccgaagtgccaaccggaccctgggtcccagctcgtcccaagccaacccaggccaaccattccacatttttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagatatgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagaga

SEQ ID NO: 44190 - DNA, 237 bp, Oryza sativa
tttacaactgtggtcttttatgaaacaaaaccttgaaaagtcttgaacttcagactggacattgtttcgggtcgtgttttcagctttttgaataggtatgtgacctaggttgaaacactgtttgactttttaattagtaaattgtttgaaataaataaagggtgaaatacatggttggtatttaaacttggatcatatatcacttagatatgtgatgttgtatatcacacatttaga

SEQ ID NO: 44191 - DNA, 723 bp, Oryza sativa
gacctgcaggcatgcaagcttgccccatgtgctgcacaatgggtggacctcatgttggagccatggacaaagtccagaacgttagaaagatatactcctatctagaaaaaaaaaacacttttgtactttcttttttcttggtcctagacgtatggatgatcttatgctgccgccatatctatataccttgcccatatgataggagcactcgagcaatatgcatgtctcacttaaataattagggcactaaactatgttgtttaacttaagaggggtcaataaacctatcataatattttaagggactctgtttggttagttgtctcactttatcacgccacacttgagttatgtttagatatgtgtttgcttcttatcacaattgagtcatgccactttttttagccttagaaaccacatgtcttttaaatttaaagccaaccatatcacaattgtgcctatctatttcttagccacacttttggcttaagttataatttgtcaaagtttagttctcaccaatcaccatccaagcttagtttggctccagttctttcagcttactggtagattactaataaatatattcaggctagtttaatctccattatgaaaagaacaccaaatctacttaggaccatgagttcctactattagaagaacaaatatgcatacctatctgttatagcactttgacttgtttgatcagagtaaaagggaaaa

SEQ ID NO: 44192 - DNA, 1501 bp, Oryza sativa
aaatgaaagcaatgttgtcatacaaatcacagtaaattggacaactctgttctctttagtaatttgcacatatatatgtatcatgtgtgtgctcacaagtcacaaacaagcatattggttttgaacctagtttcaagcctcatgagcttaatcaacaactcaaatagcatgccaaatggtgtattggttaattatcaagtaacatcaagcttacgctcgttgaactaattaaactaactgaagcaaatttgcacatatagataattaaacgctctcaaaggatatataaaaggattatactgcagtctaccgtttttcatacgtcttcagtaaatatgaaacatgctgaattagatgtttctggtgcaacaggtctctattccgttgttgacttcacttgtgatttggatggctcaagctaagtgacaggtcagagtgagttcatttgcatacttttagttgttaattatcatgagaagcttcggcagatgactggtcatcaccacatagatgagatcagtgtctgagggtgacaagcagcaaccatgtgcaaaagtccatattgagttatatgcaaacacaaaagtttaatcagaaggaccagcaattcacttgtaattaacagtcctttaggttaaaaaaaagggggttatatgtttttatcgtgtaaacaaacagttatactctgctccactagttctggtattatatagattcaaatgaaccaatcagttcaaatcaaaagcttaaaccgggtggacaatttacagtatacttgaacaaagacttttacgtactatacattatatagtaaatatatagctgatgatgagttcatcattcatatcttagttcttatatatgagtaagcaccgtacacctatgacattatacaagttcattttgtcaaactttccgctgtacgatcgacgattacgagcaacattcaggtattataaaaacaagttgctatcgttgttaattaactatgatctaaggaaagaagagcaacacaagcaagtagtatatattaactataccgtcctcagaaggcaatgcgaactcatgtttgtttacttcaaacaggttggcgcaaatatgtattttattttttaaaaatcatttattccagaacatcaaaatatattgattttcacaactatgatattttagatggctcatatgaaaaagggaaagtgcataccgatttttgaagacaaccaacactagtgactcataggtaccggtttatttaaaaccggtacctatgaaccgtttctcacctccctgcgatgaaaaatatagaatcaacacttttgagcactatagatgcctgttctagagaaaaaaaccgataccaatactatatgtattgattaattaaaaaaccgacacttagaatatattataggtactggtaccataaaaatctagtagagccgagccagtaggttgggagcaatatatttttagtgaggagagaagtgtgtcttatcctctc

SEQ ID NO: 44193 - DNA, 1501 bp, Oryza sativa
tctcctcctcaagtcgtgccggatctggtcacatgtccaaatggtggatctctagatctagtgatgactgatgtggccacaatggttacgatgatggcgctagactcttgaattttgtggagttttgttagggatcttgtatttttggaattctttttggaacttctttttttttggcaaaaaatcttttgaagttgataatcaaaacatactccattttcccaaagacattgtttttgaaagtcaaaaacatatgaagaaagaggttacaaaactattatgcccactaaatgcagagaaaaaataatgagggggagaagaagagaggaagggagtaataatgtttggatagctaaaatgagaagaaaataatgaagtggtattaagaggtccagtggaccccatagctagacaagtctgaaagattaaaaaaaaacactctttttggacgaagggagaacctgcctatgagccgcttgcgaaaatcaattttcgcatgccgtagtacgcccgtacatgaaaatcatgaattttcacatacgcatgcatccaggaaggtggctccaccacctgtgaaaaatgagttttagctgtacgtgagggaagttttagctgtatgtgaaaattgtttcggtagtagttaattccatttttcaaggaggtttaccatctgactttggtgatatgtgtcttagtttacttgttttgatatcactaatactactggttgggaaccccttatatttgccaatttcctacatggtaccaattttgatgaacttttacccattattataggtgctagttatatggatagaacgacacctatgatattcgaaaataataaaaaaacaattgtattataggttggatctaattcctaaccccatttgcaatttccccatccacattacagatcaacaagaacataagagcatatgtacacatcaacaagaaagaaggcacatcacagaccaagtagacaagaataagtacattacagataagaacaattcaccgatatatgttccaccatgtccaaccattacatgttcaatattttggactcacggtccaaatggattagccaccgccatcatcgattcctcgagccaccgccgctgctatcatctccttctaggccttgagcacgtgcgcgtttaggtcagatgtggctagatctagtgagccccgacttagaagagcctagatcgtgtggccccccaacctccatgcagccagatccgacggttgaatctgatgcttctgggaatggcatggaggagagggcgtcaccaaggagaggaggaggaggatgaggcaaacggagaggtaggaggaggggcgacgaacggggagggaggaggaggcaaggcgtgggcggcggacggagtgacggcaaagttgtgtgagagagagaggaggtgggagagagagagatagagatagagatagagatagagaggaggaggaggagaggataagacacacttctctcctc

SEQ ID NO: 44194 - DNA, 1501 bp, Oryza sativa
acaagacgcatcacctgttaagccactcaatgactgtagcagtgagaatgataaagatgagtatgacggttctttgcaggatgcatcacctagtgaaccaccgaatgacagtaactgcgagagtggtaaatatgagaacagtgactctctacaagatgcttcacccgctgagctatctgaagtctgttacaatggaaatggttctttacaggatgcttcgcctgctgagctatctgaagtcagtaacaatggaaatggttctttacaagatgcttcgtcttctgagctatctgaagtctgtaacaatggaaatggtcaggatgaggacggatgttcttcatcttctgagtttgtgatccctcctggatgggctcaaagggagtacatagcttggcgggtcgaagaggaggcaaatcagaccgcaattggtttggcgcgtctaggcactgcgctacctgaccatgggataatggtacacctctcaaccaagtgtgactgtgaacatggaagagaaatgaagaaaggcagaccagacatcacatggtgagaagctcttcatatagttgattcattctgtagccacaattgcttttcttttctgcagtattaacgatcaccatatgttacaggtttgatcattagagagggccgttgtttgaggagcaaagcttgggctaacagagagtggagagcctttctcatgtggaacctgtcgctgatgctgttagaatttcaatggttactctcattgagaagaggatggcactcgagatggggcaattttctggttttcttcatttactaaacacaaaagccatgtcctcccaaagaggattggatacatatttatagctgcttgtagcagccatgcagccatgcaagtctaagagggtgctgtcctagagcatcccaacaaactgtcctagagcagagcatcccaacaaactgtcctagagcagagcaacccaacaaactgtcctagagcatctcaacaaactgctgtcctaactgtcctagagcatccaaactgaaagtagagatgctgtcctagaaagttgaaaagcaggaaaaggcaccacaagaccaagaccaaccagccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgctatccaccctgagctccaccgctccagtatctctgccaaggagatcactaagcagtcgagcaagccagagcgcctgggtcgaagcggcggatgccgccatgtactcggcctcgcagcgggacagggccaccacctg

SEQ ID NO: 44195 - DNA, 1501 bp, Oryza sativa
cgtgcgggctttgctcgaagcccatccccttgagcgtggaatccaacttggcattccacgccctcggtgcctgccgcaagccgtagagggccttgtgcaggcgtagcaccttgccctccttgccgggaatcacaaatcccggcggctggtgcacgtagacctcctccttcaagtcgccgtttaggaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaaccccaccgggctgcgctcaacacgagctggcgtcggagtagacgtgcccggaggagtggctgttgatgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctcccttgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcggcgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgca

SEQ ID NO: 44196 - DNA, 1501 bp, Oryza sativa
tgtcttcaggaaaattagtagctacccatcctgtgcattgccgttgaagacttgaagtgctgcgattgttgtgagtactctttggttagcttagagaatgtagagtcctctctctggagcagtttggtgggggtgtcgtattctaaaatactacctgcatagagatatcagatttaaagagtgacgtagctgtgcaacatgatattctgaggttgttttagtattgtagtggtatacctaccttcaccaagaacaagaataaggtcactatcaataacagtgttcatcctatgggcaattgcaagcactgtgcaatctttgaattcttgacgaattatctcttgaataatccggtctgtagcagagtcaactgaagcagttgcctcatcaaggactagtatcttgctcttcctcaggagaattctgcctaaacaaaatagttgtcgctgtcccatgctccagttgtccccattttcaattactgcgaatgaaatataaattcatagtagcataagtatttcagaaaaactacatattaacatgttcttttcctaaaggactcattgcagtttttttgtcttccttcaaaagtttaatgctgagcagtacctatttcatccagctttttctcagtcgagcgcaccacattgccaagctgacacttgtctactacctgacatgggtagttcattacttcagaatgaaaactactgttgatctaccctaaaattacttctagtttgtatgcttgcttttgaggtcttattcatttactggtggataggggtcgcaatctgtaccatcttcacttcatattgttgtcgtctattcacgcttacccattttttttgctttatatgatttgtgctatttatggaaccattgtctatacaaatagaaaagctttgtcatatattctagttaggatgtaacatgtaagttttctgcacttacctcccatatcctactatctgggtactcgttcatgggatcaagatttcctctgattgtaccatcgaacatcaccggatcctgtgggagaatacatattctcgatctcagatcatgaagtccaattttgcagatgtcgatgctgtcaatcttgatggtcccttctcttggctcaacaatccgaaaaagtacttgtactaaggttgacttcccactacctgtgcgtccaacaatacctactgttttctcagctggaatcacacaagttatgttttttaatactgaagggagatgttctgcatatctgacctgtatgattaaatgtgcaatatcattactgggccaactaaagggtgtacacctctgatacttagtatgaaataaaattattatgatcttctttctaatcatttagaaccatacctctaagttgcttatgcttatcatgccaaactctggccatgccattggtggcttgctaccctcggttatggttggggcttcacttggaagctttgtgtactgtaatattctttcaactgatatcatg

SEQ ID NO: 44197 - DNA, 1501 bp, Oryza sativa
tcatgaagtccaattttgcagatgtcgatgctgtcaatcttgatggtcccttctcttggctcaacaatccgaaaaagtacttgtactaaggttgacttcccactacctgtgcgtccaacaatacctactgttttctcagctggaatcacacaagttatgttttttaatactgaagggagatgttctgcatatctgacctgtatgattaaatgtgcaatatcattactgggccaactaaagggtgtacacctctgatacttagtatgaaataaaattattatgatcttctttctaatcatttagaaccatacctctaagttgcttatgcttatcatgccaaactctggccatgccattggtggcttgctaccctcggttatggttggggcttcacttggaagctttgtgtactgtaatattctttcaactgatatcatgtttgcttctgcacgacttatattccgggtggcttctgataattgtgtattcaaattccatgcatacatcactaccagcccaccaatgcctgttttgcagcaagagaacatcaacccttataccagaaaaaagatatttatccttcaagtttgaatgacggtagaacagcatgagtttacgttcaattaaattcatgggtccgaacaagtcaaaacttacttggattaacaaaaccttgtggaagacgcacaagcaaaaccaacgagaacccaaagacaaagttgcataacaaattcattctgaaagagagccattctactgcagccatcaagtgaaaccatggtcttgaatgattgtcaagtagactcagatttgatctgtagaaccggtcttcttggcgaaatgctcgaattattgcagctccatagaaagtttccccaaaatgatgaagaattggagccttttgaattcctgataggcgagctaattctgttgctgttagactgtaatatctctgcaggatattatgggagatatgattcattctcaataggcatattgtgtgtactgatactattttgaatctgactaagttacagttaactcttacctgatacctgatgcaaatcaatattgatggaataaaaataatgagaactggccaggaaacatatgatatgattagtattgttcctagaaactgcatcactgaaaatgtgctctcacttaatgttgacgctgtctccaaatctagcacactttgatcaatcgaagcctacatgaacaatgcaaaaatcatgtattagcaactcaggtaaagcgacatacacattacactttcctgtgtaatgcagtatatgtttacttattttacatagaatttctttaggatttattttacatagtttacacttctgagacaggagaatggactgaccctgtttaagattcgccctgtaggtgtcgagtcaaagaaagacataggagcatgaaagatgcaatgcatcatgctcttgaacaatttttctgatgtgaggaggccggttacagctacaagaactgc

SEQ ID NO: 44198 - DNA, 420 bp, Oryza sativa
cccccccccccccgaaattttttatttttgttttatttgtttgatatttttttcacgcttagggacacacaaaaaacagaatcactatatactgtttaacttatatatgtcatttcatgtgattatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatcggaaagaataaaataaaaataacaccgttgcaactccatacagagaaacaggaatagaggcggcggcgccagca

SEQ ID NO: 44199 - DNA, 1501 bp, Oryza sativa
tggcgcgtggaccgagaaggagtttccaagttacagccgagtatacatgaacctacagggtcgcacgcttaatgggccgaaataaggggattggatggagacccaatatgagcttaatttggattgggatccgaataggagtcctacgtgccttggaggcccgagtgatggatcctatatatattcgtgaggggtgtgaccggtggagatatttcatcacgtgagaaaccctagccgtcacttccctccctgagcaaaaccctagccgcacgcgggtgctagcacatctgcgcgtggcgttccgtccctgtacgtgtggatactagtagaggcgccgctggtttgcggtgctgatcggcgtgggagtacggcgaggagaacacacaaggaggagaaggtcgagctagtgcgatcgactacttcctctacatcgacgcgcgctacttcgcgagaattccttcgacttcttaacgcctttttcctctgcgcagcgcgtcgagtggtaacgatctatgatctaatacttgcatggttcctggtttacgcgatagaaaattttgatttatgctatcgtagcctacgcgtatcccaacagtggtatcagagcctccttgtatagtttatgatctagatcactgcatataattgatatgcgggtgtagtagttgagatctattatgttgtatatgagttcttaggtgatcggaacatgagatgaaccaatagccgcatgggttgatgagatcaatcggtatgtgtgttggtgacttcactggaatgtctagtactcaccaaggccgagcgtgattgtgttcatcgggtagtaagatgtccactggaaccgcacgccaatgagaaaaacgagccaatgagattgactcggtttcggcataatttgattacgccgttaaggttttcacatggcgaatcatagcgggaccgccgtgtgcgttgccccttagattttgcttggggttttatatctatcttactttattgttgttgtatatttgatatgacatggtaggattgattccctcagaaaaattaagtgtaatttatgctcttccaataattacacctattacggttgtgatcataagtgatgggtttgccatagcaaagtatcactttttatcatgataaaataggatagatgtctgacatctatatgcggagattattggtttacttgacaaggttatcgaaacggttttggaccttggggcataggttgggttgaagatggagatgtcaccccaacagcataagagtcacatatgatgtgattagcaaggtgttgcttacctattttgatagttgtctagctgtgatgccaaagctcactagacactaataaaatgatgatcttgactcactatgttactagagggaatttcgtttcacaatacataatgggagtatcttttgttaaattgtttaatgaaaggttaaatgtagacatggtgctgattttgcatacatatatttctattgtaga

SEQ ID NO: 44200 - DNA, 1501 bp, Oryza sativa
ttaccacaagccagcgtgggcaacggctgggcttgtattgtagctttcctctagctgacgcaaccaggcaagggtgggcatgatggagtttggatgggccctgcgacggcctatgcagcttccggattcacctaggcacgagaggggactgcccgctgccttgcgaggagtgggggtgaaacctgaggtgtggtgtgtttggttatgcgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttacgggcggtcaaccagattcaccgtgattagtctcaccctagcttagtctaatggaattgagtagttcaggtggatggttgggcctgttgcaatatggtgtagcgttggacagtggatggttaatattgattaattattacaactgttttactgctttcaactactgtttataaatgctcgatttatacaaatgaaccgctctatctatcctttgattatatcctgcatcataccctctattccggtatgacttgctgagtacagtggttgtactcagtcttgctctattttccccaaaaccccagagattgagtgcgtgtcagatggtggcttctccgaggagtaggcttcgtccgtgccgtcgaggatgcctgtggagtggtgttctcgctgcagtccaagtcaaggcttagctccatttatcttttaattttccgttgcatttatgtaagacttttataatgtttgtaagacgtggatctgtatgtcaactttgtcgtttgtgtaccccggccggtcctggacgggggtttaaatgcacattctgcttggaattctattcgggaatttctgggcgtgacaagttggtatcagagccgaccttgaccgtaggacaagccaaatggaaaacctaagagccctctgaatccttttcattgcatatgttcttcgcaatttgatttgctccgggaaaattgggatttgttcctgtggttcaagggaaaaaagctttgtcgcttgtttaagtgagatttgtcaaatcaggtcagtctaggattttagtaaaattatttgaggtttatttgacagtgaagtcgggattggatgggaggaatgcattaggtcctaactcaggaatatgggttgcaaggtatttatgctattatcgttattattagtatgtatctaatttctcattattttatcgctatgtaagtcagtcttatttgttcgttctcatgcaaaaaaaatgatctatgcacaaaattccggtctcattcgcttattttatttgagttcattgccgtttattttataattggatttgagcatgcattgactctccatcctttgtcttctatagatggccgactgtcccctcacgcaccaaggtcagactatgggaggcttcgttgcagagttgtcccgca

SEQ ID NO: 44201 - DNA, 1501 bp, Oryza sativa
gcagccatcctccactgccacctgctagacccctgtaggccgaagctggcacgaaagtgaagccgaactctagcacgggggctgaagatgctgcggtagatggagctggagctagaactggagctggcgccggagctgcaggcggtgctagaggtggaggctgcggcgggttcctaggcgcaagctggatgcgcactggagctgtggtcgacttccttggcgtggtgcggatgcgggctcctcctggcggtggacgtccctaaagcctagggacctccttcttgagtcgagcgttctcatcctgcagatctgcgatcctcacaagcttctggtcgttgagactcttggtcgctttgtggagcatggcgtgcaacttgtcgtagctcctcatcacgtcactcatgtggccgaaggtgacgtcgttctctccccacgctgacttgaaggtgctgctgttggagctggaaccgcggcaagggtggaagcggtaggcggtggtgttcaggacgccgtcatgcagctccctcagatgggccatcatcctgagggcggcctcctcacaagcatgctcaaatgtgcccccacaagctgtcacctccatgttgggcaggtaggtgggtatgtcatgaatctccaagcggacctgatgcgggaattcgccactgagggggtgaatgctggtgtactgcggctcccttggaaaaccaatcacaaacgctatgcgggacaactctgcaacgaagcctcccatagtctgaccttggtgcgtgaggggacagtcggccatctatagaagacaaaggatggagagtcaatgcatgctcaaatccaattataaaataaacggcaatgaactcaaataaaataagcgaatgagaccggaattttgtgcatagatcattttttttgcatgagaacgaacaaataagactgacttacatagcgataaaataatgagaaattagatacatactaataataacgataatagcataaataccttgcaacccatattcctgagttaggacctaatgcattcctcccatccaatcccgacttcactgtcaaataaacctcaaataattttactaaaatcctagactgacctgatttgacaaatctcacttaaacaagcgacaaagcttttttcccttgaaccacaggaacaaatcccaattttcccggagcaaatcaaattgcgaagaacatatgcaatgaaaaggattcagagggctcttaggttttccatttggcttgtcctacggtcaaggtcggctctgataccaacttgtcacgcccagaaattcccgaatagaattccaagcagaatgtgcatttaaacccccgtccaggaccggccggggtacacaaacgacaaagttgacatacagatccacgtcttacaaacattataaaagtcttacataaatgcaacggaaaattaaaagataaatggagctaagccttgacttggactgcagcgagaacaccactccacagg

SEQ ID NO: 44202 - DNA, 687 bp, Oryza sativa
aggaaacggaactactcgctgccaagctggacctcctcatgaaacgactggacgaccacgacaaacggccacaaggcaccatcaaggccttggactcacacgtcacgtgtgaggtctgtggcggcacgggtcactctgggaacgactgcctagaaactcgtgaggatgcgatgtacatgggcaacaacaacaacgggaatcgtccacgaggaggttaagggtggaactagacacacccatactattaaggaggaaacaacaacggtaacttctctaaccaaccctccttaaaggatctcatttttgcgcaagctaaaaccactgatgctttaagcaaaaagctagctgccaatgacaagatcctagagaacatcaatgttaagctagatggcttcgcttctacttttcaaaaccagctgagcttcattaaaatgataaaaacccagctagcttaattggcttctttagtccctgcaactgaaactgggaggattccggagcagaccgactcctccattgaaaatgtcatggcgatcacgacgagaggaggtaagtccactcgtgatccgccatatcctaaccctgcaggaactaatcgggttgccagagaagcgccatcgagtaactcggctgacaaagaggttcagccagaaaaggccgtgccgcaggaatactgcgacacacgat

SEQ ID NO: 44203 - DNA, 298 bp, Oryza sativa
cccccccccccgaaattttttatttttgttttatttgtttgatatttttttcatgcttagggacacacaagaaccaactatagaaaaattgaactcaaatggacgtaatatgtgacatgtagaatttttcctctcctctcctctctccgaactagtgcagaggagagagatgtgcaacttttttatttttattttattttgttgatattttttacacacttaggaattcacaggaaccaaccacgtaaaaaataaactcaaacggacgaaatatgtggcatgtggaattttccaaagc

SEQ ID NO: 44204 - DNA, 1501 bp, Oryza sativa
ttcagagctctcgaggtatattgcttgatataggagcatttgaaagcggttatgaagaggattcttattgctgatttactttgagtcagaaggggaggagtcctggcgatgcggcagctcgagctgcgcatggtagcaactccctcgcaacccctgtcaatgcctcgcttcctcttgcggcgctgtgtagcatgtgggatggacggggctatgtttttattcttttctcggagaagcggaggggcttggtcaacgagtagcctaggctggcccaatattaccgaaacattcatctgggaaatctgcaggacgatccaacggctcaggaagtgacgtggctcaatatggtgcaagctttatagtaataactgtataggactatataggaagaagggatttcatgcatttcccttcctttaatatattgttgccctgtaaccttgtcaccttcaattgtaaatggttaggatggtttattctatcatcgaatgcttagccgtgcttaggtctacttttgattcaccacccgtgatttatgggtattaaaatctgattacctcactcaatgattaatatggaaacatgctttaacttggacgggtgatagggcgatgacgggacggtgattttccctgatgcaagtagcctcgtctgggttgttaaggaccgaacatgttgacgtatattcaagcaccatacgtacttccacacgccttatttggggccggcttgtctgttttcaagtttataggatgcaattggaaagcaaatatgcaattggaaagggaaatatgcaatgtgatacaagttacctcagtggggagagagatgtctccccccaagcttggctttcgctcagggtccttggtaaggattgaatccctgaaagcggaaatatgcttgaaggtcatcgtgttgttgctgcatcatgttgttgatgttggcaaattgagcattagtagtctgttgtcattcttgtgtctgagctatgtgttccgtgaggttgtattggatctcccccgtctgcacatcaagggtgtccattctcctagtgatttcacccaagtcccaacgagaggaactcgagcgccattcacttggacatggaggtactccacttgatctgggaggttggttgtccccccactatatgtcatgaggcgcatgccaccggtcctcactggcacttgcccagcttgagacaccgatgttgtggcgtggagcttgggtccatccgagtgcatccccagttggttcccaacctgcctcatataatctgcacgggtgttgaggatgatgaactttctcgttcgttccttgccatgttgtgtgtgtccctgtatactccacctgcatgagattcttctatggtctgcaggggaatggttagctcacggcagttgtacaaatgataccccgcatttggtaacgggatttcattttgtcacgaccggaattaacccagcgggcattccatacgtgtgtgtattactccttgtcc

SEQ ID NO: 44205 - DNA, 1501 bp, Oryza sativa
aaatttatatgatcataactatttttatttatattggataaatcatcgaagttacagctcaacggtacatttaaaccaaaaaaaaaaggtgcaatggcaaaaaaaaaatgaagttcacacaattgtctcactaattaaagctatctacagctttctacatgtagaactgattaattggccgtttctcttttcccctgtaatctgtaaatcatttagtcttctatatcctgcaaaaacaaaaatcaggcaaggtatattaatgattcatttgaggtagtgaccatgtcgaaagtcagtgttcacatttcaacagaaatattcaaaatccaagtaaagactaagtgttctaaaatgatgtgcatgtcatcaaggaattactagatagcatgctctataccaactttttggaactattcaactcctgaataatttgcatacttaactgctcttgatgaatattctctagatagcattggccattggatgttactagaagaacaagcgcggcttcacgctgcgcacgttaatatgtggatgatggtgctgaaagtgcaaaacagatacatgttaagcaaaagaagagaagaacaacaacggaaggggaagaaaagaaaatggaggcataaaaataacatagagagcatgatcaactgttcttttcagtgcccacttctccattgtcattttggaattaagacctagtcgcaatattaacacattttggaaacaagaacaaagtaagcttgttagtgtcccatggcttcaaacagggaaggattgatggcatcatattacacatcagcacaagtaataaatgtcacccatctaacataattcattacgcttgggaagatcattcggactgaaaattgagctgtttcttttatggcaagtatgttactccctaacaatacatgcttgcaagagcttttatcatttcccacaaacctaaatagatgtatgatggaattacctctcacagttgtaggcaagtgaagcctctgctaaacgtctcttttccccctctgtactcctgatgcttccagttgtcagagtatcatccatctgcaagcacaagaataattcatagtgacaaacaagaccatcttcaaccatacgaggaagaccatctttaaccatacgaggaacaagaaataacaaatttgcacttatttttcttttctttttttttgacggcaagtggatatggttttgttccaaccacatctggacaattgtttcattgttgtttaagcgccacttaaattactcacatgacaaatagatgagattatcaataaaataaggaatcggtctgagttaagctagattacagaactgcgttctcgcaagcgaaaagcaacagagttgcttgagggtggggggtcaagattaatcattcatgggtcagcaattaaaacaggatgagaatctttcttgctaagcctgagctgatgcaaaagtaagggcgtccatgccaaatgaactaataaggcacagt

SEQ ID NO: 44206 - DNA, 1501 bp, Oryza sativa
ctgggtcctagctcgtcccaagccaacccagaccaaccataccacattttagttgttaagcatgttttaagaattaaaccactaacttgggtacattgctaggcttgcccataaccgagggcgcggctattcgaatagattatactttgatcagaggtgtacatctttacccacaagacacatctttctcatgtgtaaccatgtgccacataccaccacggcataccgacgaaagacgtgacatagttctcaatccatcctagccataaacaagagtaccgacccaaccctggctacggccaggattcccgagacaggtaaccaaggttgagcccctagcagcaggacaccggccatgtgccatgacatctcgactaccgggccgcagctcgtgtagccttaatttgccctagagatgtccatcgagccccgacttcgtccatccctatccgtgtatttttgcccatgaccagactgagccacgaactaagccttacccactagacatgtggaagtacggtagtgctttgcaacagaggcccgaagaccggtccttatagtggccgagatgctactatcaaaaccatgcacctcgagcccagcctaaaaccattttaggggtattgaatagagggggaggtgtgtgtccaattccaacataagccaaccattccataatgtccaaatgatatgagaattcctaaagtctaaagttataaaatcacctaatgttgtctaattaatcagcgaggcatctacctaaattcatgctcgtggaaccatgaatagggtacccactagttgggggttttgtttatcctagggtaaacaaggtaataaataacaatagcaataacaataaggtcataacaaaggtaaataggcatggctaaataaaacagtgataacacgggaatttaaataaaacgatattgcaataatttaaaccaaaatagttttataaactgggattcaatatgctcaaggatgatgtgacttgccttgctcgctttcccaaacgttggcttcaacctccacgtagagcggatcttctgaagctgcagcgtctacacggccaatagaaagaaaaaggcttttactctaataaactccatataacaagcagaaacaaagcacaaaaataggttcttgacttcttaaggaaaaattagagacttgaacggtccaattctgagttcaaaaggccaagatatggccatttgaagtttatatgctcttaatgtgaatatttgcaaatttcttcatttaaattttaattaaaaaatagggtttattgtgtcagttgaggggagggagcgcgcgggccgggtccatgggagtggtgggcccctgcggcagcccctcggtccacggtggaccgggtgcacccgcggctcaccagccggctccgggggccccacacgtcagccgcacccgatggcacggggggctgacggccaggccccacgcggtggccacacggtgcgcccagaggcggcta

SEQ ID NO: 44207 - DNA, 1501 bp, Oryza sativa
gtcagttcaagccagagggaccggtaaattcatcgattattttggtctagacccgttcgccggtacgtgtatattgccttcttctcgcctctcttagtttcgtttcacttgatttttctgtcgaatatgaacattatattctacgcttctactgcatatctatagcatgtttgcagtgatcgtttgtaatgccttgccagctgacagccctatagcttttgcgcctgtgatcggttctcttatattgttggattccaattggtgtttctctgaatgtgcgattcaccaacgtacggacgatttctgtttggttaaattcggttaattagaccggtgtaaattggggctgggggctgttcaggccatggtgaaagacaagtacaaatcaatcctaggattattccccagtgtggtctctctgatattagtacacatcaagagtgtgagacacatcggggcaggaagcaggatctattcagattttacaacaatcgttatacttcgcttggctactaccaatgtgttcatggattttttttttttttgaaaataaaaaagtcatagtacaaacgtaaccattcataacacatgcacactcacttctagaaatccacatacgcacatcctacttctataaacatctcaagagattagaccaatatatctttgagaaattttcatatataccagattgttaacttagaacacaattgctcacaccctgcagttgcatttaatttagatactgcgaattccgatatgcttctgaaagtaggatttgacattgtgtttgtggtttccactttatcagctctcgtgcaagctgctgcagtgcagtgctctgtttacccctatatatatttggttcgacatgttgttatttagtaacacctatagaacgacaaggtagtcagcagtttatcttgatatactcctcatttggcattttggttatcttttaagtcaacttaaaacttccatgaaatttagagaaatatatattatacataagaacgacctctgtaatgcccaataaatatattatcaagacatatataatcgtagattttaattaacctactttgatattttagatgttggtgtattttttaaacttagtcaattatcctaagtatgatttagaacataactaaaatatcttacagtatgaaaaaggagggagtactttatatacccagacaaaaaatatttaacttataaatccttgataactaattttatattacaataataagcttttaatattatgatagtatttttgagttagatgttatctttcgcaaaatatttttgacgaaatatttatctttagcgcttaaagctcgtaaaaaaatatttttttctgctagaatgttactgagtacccatattcctctttcctttcaaggaatagtgagcattttatggaagggtatagggctgactggttttagatggagtatttcactaatatgatgttgtttgcagttgagccgaggag

SEQ ID NO: 44208 - DNA, 1501 bp, Oryza sativa
ctattatttaatgatggcttaatgatagttcacgatggacaatcgtgattggttaattaactaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtatgaggggtattgtcacaactcctatccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgcttaaattggtaataatttgattagctcctggtttggaatggtacattcctggtttggagatagacctgtgcagccgggatggttgttcagaatggatgggcctatacaacagggtatgttgtatagcgttggattaatattgcttaattaatacttaactgttttattaaattctcaaatgtttgctaaatgctgcttttgcaaatggatccctattacgccatcctttgttatcctgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacacgttcagcctcaccaatgcctctgccaccatccagacgctcatgaacgacatactccttccgttccttcgatggttcatgttggttttttatgacatcctaatctacagctcggcatggtccaaaccctgcaggatcatcattcccacctcgcacgctccaagtgcaaattcggcctcacctccattgcctgccttggccatgtcatctcaggctccgtgtgccgatggaccaccagaaaatcaaggccttctaggattggctgatccccaagatggcgtgggcggtgcgtggcttcctcgggcttgtaggctactaccgtcacttcatctacaactttggctccatcgcca

SEQ ID NO: 44209 - DNA, 1501 bp, Oryza sativa
gtgaacctccgcccgtgtgcccggtccaccgaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgtcggagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattcattgttatagcccttttgttcttgattactttattccttgataccttgggttattataatttgactagttgagctttatgtatattggttcaactagatattagatataattgcttagccctgcttagaaacattagcacacttatgggataacttatgactcactattatttaatgatggcttaatgatagttcacgatggacaatcgtgattggttaattaactaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtatgaggggtattgtcacaactcctatccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgcttaaattggtaataatttgattagctcctggtttggaatggtacattcctggtttggagatagacctgtgcagccgggatggttgttcagaatggatgggcctatacaacagggtatgttgtatagcgttggattaatattgcttaattaatacttaactgttttattaaattctcaaatgtttgctaaatgctgcttttgcaaatggatccctattacgccatcctttgttatcctgtgcacttgcatatttgctgcgtgacttgctgagtatgtcatatactcaccttgcaatcattcatca

SEQ ID NO: 44210 - DNA, 1501 bp, Oryza sativa
tctcctactgaaatggaatagcagcagtgcagcaactgtggcaggtagtgaaaagactcgaatgcaacggccataccaggtgtgtataaccgctgccttgctgtataaaatgtcatacatgagggatagctccatctcgattaacctgtacatgtgctttccaccatcaatttgcatggcttactcgacagcacttctttggggctctgacatcgaaagagcatcaacgaataggctcttgcaaaaatcgaacatgtaatgagcacccaacagagcctgctttagatctctgttcatcctctcttttctggcctgctcaaggtaaggattgtgagcacttgaatcatctaaaaaatcaagagagcttcggatgctgtccatgttagcacacatgaatgcccataccctcttcccatacttgacaacaccgacggcaaacattaggatgatggcctcgaccaaagtcctactgccggcaatgtatctgtagagaacataagcaacacccaacacctgcactgtgaaagttaacaggtggcgcaaccagagctggttgtcctccaaggaataagctgtgatgttatccgggccacccaggtgaagtaagaggaatgttgcccagaacgcattcagcaggtgctcacgtgagctgctgcttgtggtcatggatagctggccaagcgtgtagatggcagtggagtcagcagatagataggaaagccataggatgatccttaacactttgtaacctttgtgtcgacggatccatgacaagaggtggaggataacttgtagagtgaagctgaggatgattagtatttgaatttgccactctttccagagttgagctagtcctccggccattgctcctcggctcaactgcaaacaacatcatattagtgaaatactccatctaaaaccagtcagccctatacccttccataaaatgctcactattccttgaaaggaaagaggaatatgggtactcagtaacattctagcagaaaaaaatatttttttacgagctttaagcgctaaagataaatatttcgtcaaaaatattttgcgaaagataacatctaactcaaaaatactatcataatattaaaagcttattattgtaatataaaattagttatcaaggatttataagttaaatattttttgtctgggtatataaagtactccctcctttttcatactgtaagatattttagttatgttctaaatcatacttaggataattgactaagtttaaaaaatacaccaacatctaaaatatcaaagtaggttaattaaaatctacgattatatatgtcttgataatatatttattgggcattacagaggtcgttcttatgtataatatatatttctctaaatttcatggaagttttaagttgacttaaaagataaccaaaatgccaaatgaggagtatatcaagataaactgctgactaccttgtcgttctataggtgttactaaataacaacatgtcga

SEQ ID NO: 44211 - DNA, 911 bp, Oryza sativa
gctaaatgctgtttttgcaaatggatccctattacgccatcctttgttatcctgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtctgcgccgtttatttagtttccgctgcttagatctttattgattgagaggaactatctacctctgtaatgacattttattcgcttattaattagagtaataattgtactctattatcaatttgttattgtgtgcctcggctgattcctggacgagggttcacacacatttaagcgtttggaattttggatagaaattccgggcgtgacaagttggtatcagagcctccttgaccctaggttatgccaaatggttacccatagaagccctctaaaatattggaaaagtagaactgttctcctccctctctcttttaattaaaccaaactaatggcacatgcacttcataatctcttttaatggttctcattcaaaatttattccagtgttattagtactgtacatctattactgtactaatggctcatttatcagcaaaagttttacaatattgttttatttaatcttgctgcaataaaataaatttagcatgatgattttaaaattctccttcatttcttttgaaacctgttattcaaaagtacaaaatttgtaaacttgttttcaactatttcaactcatcttgcaagcttggtttactttatttacataccttttactttgaatttctaaactttattcaaattaatccaaaaacttgtgctgttaattggatagatgtcttaactctctcctttcacttgtatttaga

SEQ ID NO: 44212 - DNA, 200 bp, Oryza sativa
ttttagaccaaggagaatttaacaaaaattctccgggtcacatttgaatttttcttgtacgtatttttagtgtttgccaatttcttttcgaattttaattaattctattattccttttagagaatgatttttaattcgggatgaatttatcaggacgtgacacggcccaaaacctctcttctctctctcctcggcccagt

SEQ ID NO: 44213 - DNA, 1501 bp, Oryza sativa
ttgttgttgggcttgcgcttatgcataaccatcacatggttggagtttttcttaatgctttcctcgacagtctttagcatcccatgcaattctgtcaaggtcatgttcaggttgttcatattgaaatttattatgaacggctcaaagctgggagggagcgactagagaatcaaatcagtagccaactctcagctaaggggaaagccaagcttatccagactctcgatgtaaccaatcattttgatcacatgtgggctcactggattaccttctacaagcctgcacgcaaacaaggactttgaggtattaaaccactcagctcttgcttggtcctcaaacatgttacgtagtcccgtgattatcatatgagcatccaatgcctcatattgcctttgaagctcaggggacatagtagcaagcatgagacagcttatatcaaggtattcattgcatcgcctttcatgctccctacgttgagcaacaggagcattgttgggcaagtcagctggaaaaggttgtgtaagcataaactctttgtgctcttgcctgagaacaattctcaggttgcaataccaatccatgaagtttgttccagtcaacttctctttctcaagaatagactgcaagataaaattgtatggtgcaggagctgccatgatctacaatagaaatatatgtatgcaaaatcagcaccatgtttacatttaacctttcattaaaaaatttaacaaaagatactgccactatgtattgtgaaacaaaattccctctagtaacatagtgagtcaagatcatcattttattagtctctagtgagctttggcatcacagctagacaactatcaaaataggtaagcaacaccttgctaatcacatcatatgtgactcttgtgctgttgaggtgacatctccatgtccaacccaacctatgccccaaggtccaaaactgttttgataaccttgtcaagtaaaccaataatctccgcatatagatgtccgacatctatcctattttatcatgataaaaagttacactttgctatagcaaacccatcacttatgatcacaaccactacaagaatctatttaatctatgacgaaaaaaaatcgtcatggatcactgaaaattcgtcacaggaatttgtctgtgacgattatacttattgtcatctattgagcgtcacagattaaatgtgccgacgttttctctgaaatcgtcacggatcagcacaatctatgacgttttttaaccgtcataaaacgcttatgggctcgtgtagtccagcccaggcccaacctttgtgatgaaattaaacgtcacggatggttgccacgtggcgaccaacatggcaggtgacatggtcgttttgacacgtgtgcgatgacatgtcaatgatgatgtggcagctgacgtcagcaacttttttatacggctcattaatttttaaacaacccattattttttttacattggtccattgattatttaatgacggcccat

SEQ ID NO: 44214 - DNA, 1501 bp, Oryza sativa
agaactcagaattgacacgatgaattgggccaaaattcaccagtctatgaagtgaagcaacggaggaggccgccagccaaaacttgggctggttgggccggcccctggttcggccgaacaagggggttcggctgaacctccctcgtcgccgttggatgcagggcttcttctggacggttgggattgatccccaatgacggttggagggtattaccgaccattccaaccatcacaaccgtcattacctgcctataaaaggacttcctcttctcacttcactcacacacctcaagcaagagctctctcatattctctcaagttagtttagtattcttaagctagtggaataggaacagagtagaaatcaggagtccggaagccttcggaagagttcaggtatggctctaggagctcttctcctctcttttgtaagctttgtactttatttagaatactcttctatatacatttatggtattgaaatactttccgagtatatgaatacctactttatattatgttcatgttatattgaatatactgctagcttatctgggagatgctttggtgcgggtataatgtttgcttatgcaattactctatgtcatgacgatgatattagagtagtatctggtagtttagacgtggtgtctagattacggatatcattatttggggttatatgctgcggatgagaggtgggccgctgatggtgacagcttagtacgggtattccccacgcatgtatatagtcctaagttcattccctagggagggtattcctccgtatttagccccggttgtatggtcatgacgggctgtcgtaaggaactcggcagtcaagggtggcttctcaaagtactaggagggcatcggatagagggtattagctagtatgtcggttaactagaatgtatgtatactatgtatactagaagtataggaatagattttctttctcttttctttccacttagcttagataatatatcatgagaatgggtagataatgcttgtgtgtcactctaccctaggattatcttaacccctgcttagaatatgattatcacaagtaatatataaattattagtcaagttctctctacatgatcttcccacgggataaaataaatacaatacccttggaatactctcgggtgaaatgctacaatggtatatctgtgcgcttgcggatgaactctgtaaccataatataccaggagtatttctgcgccattgctgggaattatatttctagtactgtcgtttagaaataccaacaagtatttctggcgccgttgctggggaagattcataatagagattacatgaactaatactttatatttacctctgtataatcactgccctttgcaggctaaccttggttgttttcacttttgttgtgaaaacagggtagtgcatgactggtttcaacttggcggaaaacttcaaagaaaatccagaagctttcttccggagcatcaggccgcgattcatt

SEQ ID NO: 44215 - DNA, 888 bp, Oryza sativa
gaaccctggtgggctcagtcggcctctaaatttttcacacgtctacactaaattaattcaagcaagacatgatacaattttacagaatttaagcaaattttagatgagttcattgaggctcgaaatcgattagttcaataacgtctacttcttcatcgaaaacttcattccactcaaggaaaatttttaaatgttggccgtttaccttgaacaaattatctaagtcgtcacgaagtgtgatagctttgtgtgacgaggtgtcgatgatgtcgaacgaccctgtcacacccggagttttcccttcccttaggttccaaatcactaataaatgatctcaagaatttgctttggttaaccaggagaaaaccccagttaacagtacttttaataattggaattgtcagggagaatttttttctaattctctttgctctgaaaatcactaacaggatttaaagagtaaatatcagattaccagaggcaatgttgctaagttaaaagtgtcaagttaatttttcttcctttgcctttggtcgtgaattgtgcccaattcactcgcctctcagtccgcggtttcgttttgcatgacgaaccgtatacgtgtcagttcgcgggaccgtttccttttctttcctaaaacagcaccgcattgtttttcctttttgggtaagtcctaatcccctactttcctttttccttcccctctccccagccggccgcgccctccccctctccttccggcgcgcgcgccctccccctccccttgcccgagtcagtctcctcccctccgtcctagtcctactccatctatgactccccctttcctaatctagtcctcccctatttaagtgttccctcccccagtttttctttcttttctgccctagc

SEQ ID NO: 44216 - DNA, 1501 bp, Oryza sativa
tttatacaatttttttgttctggactttttaagttgaaatcgtttagtatttgaaaatgttgtttgaacttgttataatttgaaattcaaattttatataggtcaattaaactcagatggagaaataatcaaaataagataggtagatctcaataagttatacaagtttgtttttgacaacttttccacataagtttatttagtatgataaattcgattcaaagttttaatattttgaaattaatttttttccctcctccctccttcaaattttttcatctcgtcttctctctcccattctctcctatattttcacttccccatccttatcttatcctctcctctcctctctgcctcttagggcatccataatgttgctagaaaccaggcattagacattcaatacatccttactacctggtaagaagtattgtgagggtgatacataactactatttagtcatatagctaatacctagtaagaagcgctgtatgcctgacacatggagtaaaaaattaaatgaaagcaactggttgccacgtgcaggtgtacaattgagtgatggatgatgttttttcaagaggggtctaccttattcctccctattacacataagcattgtggcctcctgtgatatactattgctatgtactgtttgggcccaccctcctaccgatttgggtaggatacattgagcttgcccttactctttcctcctctcctctctctcttcaccgacggcagcggcgggctcggcaccggcggcggcggcctcgaccgccgaccgccgacgccccgcgccgcctcctcgctcatcaggatgggctcggcggtgtatgccggtgccggcgtgctcgacgacttcctccggcggcagtccactttgttcgcggtcgcggcgacgtccccaacctccatgacgtcgtcgccctcggctactccggagcccgctgcccccggccggatttggaagccagctccacaacgacgggcgccgttcttcgccctcggcctccaccggcttcccttccgacgtcgccgccttgagctcctcctcacgccctccccgccggcccttcccgatctgctccacccaagccaccacgacgaccagatccaggaagtctctccatcgctctggtcctgacagtggctggaggaccccggccggttgcagcacttcatccccgcaaaaatatcaaacttgacatcgtcagcctcctcatttggataagtaagccccttcttcaccctgatttgtgcgctaatgctgatcttaatcggtgaatggttgtgttgccaggaatttgtgaatcaggatgttccatctaatttggttttgctcgggttgtcaaatactcgatggatatgtacctgcgcatgtgcatcaggttggtgtgtttcggcatatggtgggttgattttcttcagccaaggttgtgctcatctcttgtatcctcaaacactaagatactgatgttcttttcctcttctcaccat

SEQ ID NO: 44217 - DNA, 1501 bp, Oryza sativa
tttttgcttaaagcatcagtggttttagcttgcgcaaaaatgagatcctttaaggagggttggttagagaagttaccgttgttgtttcctccttaatagtatgggtgtgtctagttccacccttaacctcctcgtggacgattcccgttgttgttgttgcccatgtacatcgcatcctcacgagtttctaggcagtcgttcccagagtgacccgtgccgccacagacctcacacgtgacgtgtgagtccaaggccttgatggtgccttgtggccgtttgtcgtggtcgtccagtcgtttcatgaggaggtccagcttggcagcgagtagttccgtttccttgacgaagcacatacctcgctgatgggtttggagtcgttcctcgctccaacccatattggagaccatcttctctattaaatcaccggctcctcgaaccaccttagagaagaacgatccttcagctgccgcgtccaggtggtcacgggacattggagtgagtccattatagaaattctgcagaatcagccagccgtccatcccatgatgaggacagacggccacatactcctgaagtcgttcccatgcttcaggaatggactcaacccttgtcagctggaaactagaaatccttccaccaagggcattggttttgcccatcggaaagaacttcgagaggaatgccgtagagcatttgtcccagatgttgacaacagcacggttggcataaaaccattgcttcgttttcccgagaaggaagaacaggaacagccgcagcctgacggcgtctggactgacaccctttataccctttatagtgtacgtgatacagatctctaggaactgctgtagatgagcattggcatcctcgttaggctcgccacagaatgggcaagcttgcgccatcatgatgaggctagacttcaagtcgaaatcaacgtctcccatgttgatctgcggcccaatggccacattgccagtagagggagcagcgaattcgcggagggtcttgtcagccatagtcttgaaagtctgtggcgctggtacggctggattttttgtcagtagagttttctgcggagcaatgaatcgcggcctgatgctccggaagaaagcttctggattttctttgaagttttccgccaagttgaaaccagtcatgcactaccctgttttcacaacaaaagtgaaaacaaccaaggttagcctgcaaagggcagtgattatacagaggtaaatataaagtattagttcatgtaatctctattatgaatcttccccagcaacggcgccagaaatacttgttggtatttctaaacgacagtactagaaatataattcccagcaatggcgcagaaatactcctggtatattatggttacagagttcatccgcaagcgcacagatataccattgtagcatttcacccgagagtattccaagggtattgtatttattttatcccgtgggaagatcatgtagagagaacttgactaataatt

SEQ ID NO: 44218 - DNA, 1501 bp, Oryza sativa
tcatgctctctatgttatttttatgcctccattttcttttcttccccttccgttgttgttcttctcttcttttgcttaacatgtatctgttttgcactttcagcaccatcatccacatattaacgtgcgcagcgtgaagccgcgcttgttcttctagtaacatccaatggccaatgctatctagagaatattcatcaagagcagttaagtatgcaaattattcaggagttgaatagttccaaaaagttggtatagagcatgctatctagtaattccttgatgacatgcacatcattttagaacacttagtctttacttggattttgaatatttctgttgaaatgtgaacactgactttcgacatggtcactacctcaaatgaatcattaatataccttgcctgatttttgtttttgcaggatatagaagactaaatgatttacagattacaggggaaaagagaaacggccaattaatcagttctacatgtagaaagctgtagatagctttaattagtgagacaattgtgtgaacttcattttttttttgccattgcaccttttttttttggtttaaatgtaccgttgagctgtaacttcgatgatttatccaatataaataaaaatagttatgatcatataaattttacagttaaataatgggccgtcattaaataatcaatggaccaatgtaaaaaaaataatgggttgtttaaaaattaatgagccgtataaaaaagttgctgacgtcagctgccacatcatcattgacatgtcatcgcacacgtgtcaaaacgaccatgtcacctgccatgttggtcgccacgtggcaaccatccgtgacgtttaatttcatcacaaaggttgggcctgggctggactacacgagcccataagcgttttatgacggttaaaaaacgtcatagattgtgctgatccgtgacgatttcagagaaaacgtcggcacatttaatctgtgacgctcaatagatgacaataagtataatcgtcacagacaaattcctgtgacgaattttcagtgatccatgacgattttttttcgtcatagattaaatagattcttgtagtggttgtgatcataagtgatgggtttgctatagcaaagtgtaactttttatcatgataaaataggatagatgtcggacatctatatgcggagattattggtttacttgacaaggttatcaaaacagttttggaccttggggcataggttgggttggacatggagatgtcacctcaacagcacaagagtcacatatgatgtgattagcaaggtgttgcttacctattttgatagttgtctagctgtgatgccaaagctcactagagactaataaaatgatgatcttgactcactatgttactagagggaattttgtttcacaatacatagtggcagtatcttttgttaaattttttaatgaaaggttaaatgtaaacatggtgctgattttgcatacatatatttctattgtaga

SEQ ID NO: 44219 - DNA, 1501 bp, Oryza sativa
ttcgacgagttcttgcttttgggttgagctgcatcggtttcgatcttcaactagaggtaaaacttgctatggcggcttgcgttctcgggattagtgcttccatctttatgatagtctaatcttgtttatgtaattcgtcgagttatcatatattctgtataatctttgacaatattgttatctaaccttcaatcggataacatctatcattggaaggcagccgattaggttaaatatctatgttggcttagattgtacaggatatccaccatctatgaaatacccaacggcttgattgtctagatattgtccttttcataattatagctgcatcagttgagtttgaccttataagtcatgattagaatctcaacctctagcatgcttttggttgccgattagggtagtatcggggtttcagccgatcttacctgatttagccttatatttcatgtttaattgacatgctagatctgccctttatattatgatcttagtacaacaaagtatgttaggcttccgtttgatatatttttgattgctttaatatcttaatatattgtagtatcggagtattagccgatacatgctagatctatctgatcggcaatgctatgagcatctataatctcattgttaatatatatttcaatctaagtgatttatactgtctcggcatggcgaccgatctatcccaatcacttgatttaagtatatatcgatataaagattataggttgttaatatctacagctgatcgagtagatttagtcttttcttacttatttatatctgccgatcgattcaaacatgacatcggctcagagataaatgatatgtcatcggcaactagtcgatcggcaatcatttatggatttaaccgcggtttctttatctttatttcttgttgattgcaggattaaattaactggcacgctcacgaacctaaaggcaagatttttggacctgcactgaagttaagcagatcttcaaggcctcgtgttttcgcatcaatagaacaacaactttataaactagtcgtcttgattaaaccctaacagctttgtgaccttatagagaaagtcaacaaaaatagcatgatgtttttgacagttgggcacctttttgtatgcatcgtagtaattccaaggaatttactaactgcgaaaaaaggattttaacggtatcaggctttaatttgtgtgggcaattttgcctaagcaaaaatacgcctaagtcccaagagaccacattcagccacaccgaaggtatatttgggctgaaaacactgtatgggcccatgcccattagcattttccgatacccaacgataaaatcacgtcgaaggaaaccactttgtcttcttcgccgcaacagctgctcgttccccatttcatgctacagtaacaaacttgtgccgccaaaagctagggttcgcagctgcaccgcaatccgcctcttccaaaccgtctcccttcaaccgaaaccctccacgcaacct

SEQ ID NO: 44220 - DNA, 497 bp, Oryza sativa
gtttgcacaaatgttgcaacacaataagttttgtgtgttttcgtttgcagaggtacttgcttgggtgaaagaaaagagactgagcgtaaggaatgcatggatgattgaagaaattgattggggaccaaaccaagaccttctccaagtcttctttcatctcaccatgtcacttttagcccatagaagacaagagatcaagttgtacacgttttggattcggattcgggcctcctgatagcatcaacttcaaacggatctagccgctgatctagaaggaatttagaggcccatgagcacttgttggaaagattatgaagtctactttcatatggttttggtcccatgtcaaaattcctaccgagctgccgacaatcagcaaaacaagacacatatctcatctagtccgaatctgattttgagttttgggccttgtaattgtgtcgtgggcttagcccaaggggtgtgcgccctagggcaaccctaggacgtccctaagc

SEQ ID NO: 44221 - DNA, 1501 bp, Oryza sativa
gatttgcctcaccataataatttgacttgacaaactagtttagttcaggtggtttggttgggtctatgcaatgggtatgttgtataacttttgacagtcgttataggccaatttctaccgtcaatataactaaaataaaggagaactagctatgcttgcaatgcatattcgctttagaataatctatttccacttgtacttggatattatttgcttgcactctgcttgccattgctctgcaagcaaataatatccatttcacttctacataaaatgtaggagaatcaatggaaaataattgaataatcaatcaaacatcgtcgagagttagacttataggtaaatgggcttacaaatccagtgaaacaatctcaaaaatcccaagacaccacgtcactgaagtaaggagcaaaattttggccgattgggccagcccatggttcggttgaacccccgtcttagccgttcaggctggggtttggcgtggacgctccggatgacgtcctatggcagttgcgcgacatttctgacaattcgcatgctctacaaccgtcatacctgcctatttaagaagctctcattctcgcttcacaacacacactcaagaagaagatcaaagagctcactcaagtttagtagagctctactgctagtggagtaggaaatataatagttttcttagtcctcgagtcttcaagagatttcgggtatggctctagtaactttcctctctttttttctaagacttatttaattaatagaatatttttctttatacatcttcggtattttattccctttatattatctgagtaccgactttattttatacttctgtcgatatagttgtgtaactaacttatcagagaggtgcattggtgagggtttaatgtccgagaactcggttgctctatgtcggattcatggatgtagagtagtatttagtaatctaagcatggtgcttggattattaagtattattatctgggcatatatgctgcagacaatagagatgggccgctgatggcgatagctcggtacgggtattcctccatgttagtatatattcctaaggcacattcctagggagggtactcctccgtatttagccccggttggatggccatgacaggttgtcatatggaactccgcaatcaagggtgatctctcgaaacaccaggagagcactgttagggggtattggttccatgattgtataccagcgagtgtaaactaaggatgtttgcatactagaagtataggattgattcttttcttttcatatccccagttagcctaggttatattttagtgagaatatcttagttctttcttccgtgtgtcacctttatcctaccctttgaactacttaacccctacatagaccttgatatatacaagtaatatataaatgattagcatagttctcccttatcatatcttcccttgggattaaataaatatgataccttagaatatttcctggtgaaatgctacaatt

SEQ ID NO: 44222 - DNA, 1501 bp, Oryza sativa
gctggaaaataaacaacagcattcaccgtttctatctacttgctgacaagctttgtagaaatggtatatctctattcagcaaaaataatgtttacaaacttacatacgatctattatatgtgtgctgacatttttatttttagagatgataaaaatagatgggcagatggcacagttctagaaggcctagagggtgagcatttcagcaaaaacaaatagatccatctagggaaaaaaaatagtgtcagatcaaaaaacatgatacatctgtaaatagcatttcaaaaatacatttctctgaatcaacgaatgatagatttctaattgacagtcagagcatgatgtttctaagccccataattttcaaaacatttcagagctttgacacctgttgggatacgcgtaggctacaatagtataaattaaaattttctatcgcgtaaaccaggaaccatgcaagtattagatcatagatcgttaccactcgacgcactgcgcagtggaagaagacgctgagaagtcgaaggaactctcgcgaagtagcgcgcgtcgatgtagaggaagtagtcgatcgcaccagctcgaccttctcctcctctgcgttctcctcgccgtactcccacgccgatcagcaccacaaaccagcagcgcctctaccggtatccacacgtatagggacggaacgccacgtgcagatgtgctagcacccgcgcgtggctagggttttgctcggggagggaactgatggctagggtttctcacgtgatgcaatgcctccgccggtcacacccctcacgaatatataagatccatcactcgggcctccaaggcccgtaggactcctattcggatccctatccgaattaagctcatattggatctccatccaatccccttattccggcccattaagcgtgcgaccttgtaggttcatgtatactcggctgtaacccgaaaactccttttcggtccacgcgtcaacagcggcccctagcagaacatattgacccaccgggcatacataaagatcatatcggctgaacctctagtgtatacttgtatgaacccctttgcctcacgatatcgattaaactcaaggctagatatgtgccatcctctaatagctcaatcattcaatcgaacctgttaatagattatataacttgtgattgactcctcaatcacctttggcatggccatgcacttccataatctacaacattgaccgcaacagcagcaactcttgctccattgcccacgcgaatgtccactttgcctcttgctaagtgtcacgcccagaaatttccgaatagaattccaagcagaatgtgcatttaaacccccgtccaggaccggccggggtacacaaacgacaaagttgacaaacagatccacgtcttacaaacattataaaagtcttacataaatgcagcggaaaattaaaagataaatggagctaagccttgacttggactgcagcgggaacaccactccataggca

SEQ ID NO: 44223 - DNA, 1501 bp, Oryza sativa
tgcaattaggagtccgatcatctcaagctagcatgcgagtttttttaaagagatttcttatacgactccttctatgtttccaaaaacgaacaaacttaaaaactaactcaaatacgaaaatgtatttccaaaagtaaacgaagttaaaaaccgactcatacacggatgacgtactaaagtaccggcaaaaaaatttatttttttatattatagagattttatagtggtattaattgatttcttataataatccatgtaagtggatttagagcattcttgcaccgggaatattcgatttgactatgaggagctcaattaaccttggtggctttacactcctcccacacacccattactactttttcttttttttgcttcacccaatgcaacgcatgggcattttgcttgtgtgtgtgtgtataatgcagattcgcactcgggttcatatgtacctacaatctacactgttgatgtgttccaagattcctgctgcaaaatgtagctaaccttaacgaaatgaatgcttactatagggagaaaagataattaggattaggttggttcactatatgtataacatgtatgttgcattttttaccaaataaatttttcaataataatcatatataacatttatatatctagtgcattgtatttttctaacccttattttgtttataacatgatatttagtcaaaatgagaaaacaatatatctactatatcaccaaattgtcatcttgcaaaaatgatatttccaaaatgatatatatcctaccatcaaaaactacataaacaagataatttatataaacaaggtaaactacataaacaagttttgcataagaaatacaaaaattatataaacaaggtattttacacttgtaaaaaatatagtataacatgtatgttacattttgttagcacctaatatactagccttgtgggtacatgtgaactgcgtgcaaaaaatccaactcttatatatatatatatgataaaagtaacttagtatataattaaagtgatttacaagcataaatatttttttcatcataatataatcatgtaagatcttgatgtacagatataattgcaacgaaacgatgtaatcgggtcgtagatcagataagtaatttaagagaaaaaattatttgaaatttagatgggtaatgaggatgcaagtggcaggtgctactacttttagtaagaagggtaacaagttgattacacactgcactatttttggtaaaaagcatggtcgctggttagcacaaccgagtgcatgcgctccctgtagtcgcatccataagaaaaataatcaaaaaaaaaaaggaaaagtactagaacgtgaggattttatcagccaggcctccgacattgttgctacccaccaaaaatggccaccatcgccccgcttctagtgtggcccttccctctcccgcgttcatctcactaccgctagttccatccccttctccacttctccgaggcgattcccc

SEQ ID NO: 44224 - DNA, 1501 bp, Oryza sativa
atattgcattgttttataatattactatgggatggttacctattgttacagccatgcttttcggataccatgctcctttgttagcttggggttataacatgattagagtttggactaggaattgcttagccatgcttagttcaactagttcacaacggggaaaatcatattaatgtttagactgttggttccaatggtgttgttggattagtgacaccgttttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctggacttgtagtgtatctttcctctagtcgacgcatccaggcaagggtgggcgtgatggagcggggcgggccctgcgacgacctctgtcgcttccggattcacctaggcacgagaggggactgcccgttgcccgctggggacgggggtgaaacctgaggtgtggtgtgctttgctagagggggttatgcaaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccttagtgcaatcttttaatttggatagtttaggtggatggttgggcctgtcgcaacatgggttagcgttggacagtggatagttgatgttaattaattattacaactgtttaaatctttcactttctgtttataaatgctcgctttatgcaaatgaaccacttcagctcttctttgatgattccctgcatcatacccctattccggtatgacttgctgagtacagtgggtagtactcagtcttgctctacttttcccaaccccagatttcgagttcgggtcagatgaaggtttctccgaggagtaggctttgtccgtgccgtcgaggatgcctgtggagtggtgttcccgctgcagttcaagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgtacattttgcttggaattctattcgggaatttctgggcgtgacaatcagatagaggatagccgatggagccgatctcgctaaggtggctctacaatcatctttgggattgatcgacgtgctgcacaagtattgccatgattgagatgagctcacggataggcaattgtatctattaattaggatattgtgggtagtttccttagagatatttaccggcaagagtctgcctaaaagacttgtccgtatcttacggttgtaacagatttaga

SEQ ID NO: 44225 - DNA, 1501 bp, Oryza sativa
taccacaagccagcgtgggcaacggctggacttgtagtgtatctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcaaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacatgggttagcgttggacagtggatagttgatgttaattaattattacaactgtttaaatctttcactttctgtttataaatgctcgctttatgcaaatgaaccacttcagctcttctttgatgattccctgcatcatacccctattccggtatgacttgctgagtacagtgggtagtactcagtcttgctctacttttcccaaccccagatttcgagttcgggtcagatgaaggtttctccgaggagtaggctttgtccgtgccgtcgaggatgcctgtggagtggtgttcccgctgcagttcaagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgcacattttgcttggaattctattcgggaatttctgggcgtgacaagttggtatcagatccgacattgaccgtaggacaagccaaatggaaaaacctaagagccctctgaatccttttcattgcatatgttccttgcaattggattttattccgggaaaattgggatcagtttttgtggttcaagggaaaaatcttggtcgctcgtttaaagtgagatttgtcaaaacaagtcagtccagggttttagtaaaactgttgagatttattcgtcagtcagttgggatttgatgggtgaaatgcattaggtcctagctcaggaacatgggttgcaaggtatttatgctttatttgttattattagtatgtatctaatttctcattattttatcgttatgtgagtctgtcttatttattcgctctcatgcaaaatgatctatgcataaaaatttcgctttcattcgattctcttatttgagtcttttattgctttatttaaacttggatttgagcatgcattgatcctactcctctgtcttctctagatggccggccacccacccaaccaccgcggagaaggcatgatcgactttgtggcagagttggcacgca

SEQ ID NO: 44226 - DNA, 1501 bp, Oryza sativa
ggctgtcaggttcgcaatgtcaagattcatggatatattgaaaaagataaaatcgttaaggccggtagatatattattggattaatttgtaactacaggtaaattaattgataaaacttagtatattttctgtaatttcatcagatttgctaaaaactgttaatttttttaaaacaatcgatttgtggaccaccataaagatttgtggtgcaaaatatggaaacaaaccttgttggttattgtgcggtgtgcctccactggtagccaacttagtaacactgtgtgtattcttttatacattagttgtatgctgatgacattacgatttcttttttaaaaaataacatcagaagttatatagttagtctcattttcattaagctaagttagacggataaatcaaaccaaagtttcatattaagaaaagaataaaaatatgatgaaacagggttctgtgtaagaattccttagagttcatgcatacgcatcctgcattagccactactaaaaatccgagaatgagtcatgattgatagcaccatcatcatcggacataacaaatacactttcttctcccatcctttccgctctactttgctatgccaactactcttctctcctccttgtgattgctttgctcatccctcttcgctgccccactataaggtatagggtgtcgttttgaatcaagtcttaaatacttctatatcgaagcagggatttaggtcgtactacttcatttttattgccctaaaaacataaatataaattcatattagtcagttatactagggtttggtgtttccaatcagcattgtcgtttttctattaacatcagtatgcttctgctccgataggtttgctttagacactagcataatttaatagggcaagaattgccgttttccgattgatatcgacatgtctctgttttcatagttctatttatgatattataacagagagctactattgtatttcttttatgtctgtctgatttcattctatttcatggtaggttaggtcccgtttagttacctaaaagtatttctcaaaaacatcacatcgaatttttaccatatgtatggagcattaaatatagattaaaagaaaaactaattgcacagttatggaggaagatgaatcttttgagtctaattagtccatgattagccataagtgctacagtaatccacatgtgctaataacggattaattaggctcaaaaaatcgtctcgcgatttctaggcgagttataagattagttttttcattcgtgtccaaaaacttctttcaacattcggtcaaacatccgatacgatataaaaaaatttttcattttgcgaacttaacatctcaatcgatttcgaccaatctagccgctatgtgcactccttttcctctgctggttgcccacgagagcctatcgcctattcgcctcctccgctcctcaaatcccaatccccactcccacctcactccccccctctcttcgcctccc

SEQ ID NO: 44227 - DNA, 886 bp, Oryza sativa
aaccagtcaagacatgtgatgcccataatatactggaacaatagtaacagatgaatacctgaataatgttatcgtgctcttaaaataaccaataacagtccaggtgtcaggattttcctagtaaggataagcctattgtaatcatagaatacaaacacatgcacattaaactaacatccttaaaaaactaattgggatttgtgggccatggaaccaacatccttcagcatctaaaactgttaaatagccatggtccgatgatcatatcatatcgcatatagcaagacaaaaagagcatatgagacaagaagccaaacaagtatgacaaaaagggccagggaaggtaccctgccatgtatcctttttatcacaatagatagatagggaaatcaaaccggataactataaatgtcaaataaacaagaaagctattacataagaatgcacaataatataatgtgaaaagaaaatccataacctgattttaatactcatcacatgatcctgaccttgcatcataaaaaatgtacacagttttctatcaatcatgccaacagtgcctaggactcacattttctttttttctacaaaatgctattccatgatttcatataattatgcactgacaagtcaatattcataccctaaaattaaaatgcaaaacgctcctcacacacccgcaccacgacgcaaaaccgagaaattttggcaagcagtacgttcagcgcctcaagatcgatccatcacggtctcactgtcaaatcatgcgccccaaaattttgtataaacaattcaaaattgccgtaggaaacgaagcacacaaagagggattagatcctgacgcacctagcactccggcagcggtaggggtcggaggagagtggaa

SEQ ID NO: 44228 - DNA, 822 bp, Oryza sativa
aattcctgcagccctagctttttttccctttgctttaccgatgtccgatgccgtgacatgtgagtgagacaacagctttcgcttgttcagaatgcacgtgaagcggctttgttgcatatgcctagtaagggtgtgtttacttcacgctaaaattataagtttagttgaaattaaaatgatatgcgtagtaagggtgtgtttacttcacgctaaaattgtaagtttaatgtgatgaaaatgttggaagtttaaagaaaaattttggaactaaactcagtctaaatcttgaacgcgctttttctttcatgtaaagttggataaaatccgtaggcaccgttagaaaataggcaaaatttgctacagaacatcgaaagattgcggtttttgctgtgagacactcgaaaatcgtgtatttgtttatgaacacttaaaagggtgttaattagctgctggacactactcctattaaactttgtttaaagacaaatttgcccgtgggcccacttgtcaatctctctttctctgttgttcttcttcgtctctttctctctgttcatctcttcctcagttcctctctttctctgtcgcggcacaccgggcagagctccacggcgaaggtgtgccagcgaggacgacgaggcggcgacgacgcgggcgggccacggcgaggtgacgaggtcgacgaggcgagcggcgtgggagcgcgatgcgaagaagtcaagcccgccgccgccgccgcccagccgtcctagcgatgcgccgccaccaccgccccgccgtggcccagccgtcccggtgatgcgccgccgccgcccccggcga

SEQ ID NO: 44229 - DNA, 1501 bp, Oryza sativa
gagataaagctgatttgcgaaaatttataaaaccccaaaagtctgagatggagtttgagaaggaccagattcaagactattccttctttcaatcgcccaagatggtaagttagccaccgatgaagttcataggtatgagactggtcttgaataaattatgtgcttgtactatatctcggagaattttattctcaactttagctctaacctttattcgggacgagtaaagagctaagtgtggggggtttgttggtggctgttaatgacaaattttatgccgccaatacctgcataaatcaaagaaataaaacgtccaacatagtaatagggtttaattctaacatattccacaagtgttggtgtatatttgaatgcagataataaaccaccaaagttggatggaatatagacttaagtgaaggagaattcctatccatataatgagtgggccagaaactacgagaaaacatcttcaaatgggccttccactcgtagaaatggaggagcaacaggccaaagttgaagcctgttgggccagccatgggtttggccgaaccacccctgcagccgtccgatcaagggttttgcgtggacggtctggataagctcctgaatggcggttgttgggcaaaatggacttttcgcgttctatgaccgtcatgcctgcccctatataaagacctcgccttttcacttcacacacactccaagcttgagctgaattataagaggctctattatattatattgtatactagaataggaaaagagtagagtagaagaagtcggaggaattccggagttgtcggtaatcctctccctctttattcctactctattaattactctgattataatagagttatcttttgagcaatttagttttgctcggtgagaattatctcttagttagttcctatttagagtgctggatcgtcgttcacaataatcaaataaaatatagtgattgctttagtgtgtagctaacattaaagtaagtaattaatctgcttaggtgtggtgtctaggtaaaggtggtgacagccctcaagacactgaagtcctccctgtccgggtgcgcagtagagcgatatctgggagtagggagctggctagtgcctgaagtacctcattaggattaaagttaagcgccggctaaagtttacatcgactaccatctgtatcggctaataccgaatcggttagggagaagtcgatggagccgatttcggcaagatgattctagaatcattgtcgggattgactggggtgttgcacaagtattgccaagcatggattgagtccgaggaaggcaattgttatctattaggatattttagtagtttctttatagatattttcagtaagagtccgcctaagagttgtaatagaagtggagtcgtgtccggcaaggacacattatgtattttgggtataaatatgacccgataccttgtaaacaattaactttagttcaataacactttcagcgtatcaccac

SEQ ID NO: 44230 - DNA, 740 bp, Oryza sativa
ggactctagtctcctcttctaatattccttattttttaattccaaatttcagttatttcctaattgtatttctatatggactctagtctcctattctaatattccttattttttaattccgaatttcaactatttttttcttaattgtatttctatttggactctatactctacctctaatatttcttatttttaattccaaatttatgttatttcctaattgtatttctatatggactctatactctacttctaatattccttatttttaattccgaattttagttatttcctaattgtatttctatatggactctagtatcctcttctaatattccttattttttaattccgaattttagttattttctaattgtatttctatatggactctagtcccctcttctaatattccttattttttaattccgaatttcaactatttctaaattgtatttctatatggactctagtctcctattctaatattccttattttttaatccgaatttcagctatttctaaattgtatttctatatggaatctgatttttctttttctctgattaatatgagaatttctagatcatgagagtgaacgtggtggctcctttttctatccctttaataatataatagattccggtcggcttctctttgccggtcaaaaaaatgtcaccgatccctttccaaatacgagtacttatcactatttattatatttgtttttttaattttga

SEQ ID NO: 44231 - DNA, 1501 bp, Oryza sativa
caaaaagggggaggacggactcccccaagtcaccgacttcttccatcatagccttgcgcgcgtcatcggtggccccctgatccaaagccttcttaaggtccagatcgggatatgccagcctcatgcacgcaaggacatggcactccccggtgtagatgccattggacgtctcctcgccgatcctggccgcgtgcttggaggggatctcctccatcgccgtagccaattccgcaagcgacgacgtcagcgagaactcatcggggtgcgccgggatggtagtcgtgacaccacactccccggcgagttggtgcaggctggtgaacgatgttcacagcgaaccacagatgttgatcatgtgaccctcgagctccgacatccggtgcttgagtccgcgccgttgcatctcgttgccggccaccagctccctcatctttaggaggtcctcgcgggcctccgctaggtcgcgcgccagctggtcggcacactggtttgccgacaacgctgccgccctggcctcttcgatctcgcgacctacgccatgagcaccggcctggagaatgcgctccatctccgcttggacctccccccaggtgagggcatcggtggacgggccccgggtaggcacggggctaacggcagggccactcggtgctgcctcctggtccttagcagtgactaagactcccgacgaggtcgctgcaggggacgcgctggatgcggcatcagccccaccttgcgccaccttttcccacgccaccctgcaaagattttcctcttccccatgaggcgaggtgatcagaactttgaaaatgaaaagacatcaagaacgtttacttacttctcgccgatcgtcaccaacctttgccttcgctgaggcggaggagacgtgttcgagtcctgagtaggatgaaatggtgtgaggagaagttcttccgactacgcgctaaaaaacgagagagaagcttaccgcggaggtcggcgctttccgacgggtcccgagtacggaggagaatttcctttccctctttgggatgttgctaccactcgtggtggcagcaacaacgttagatggctccttggcaacgctctctttcaacgacgctgccgcctggtggtccatgagcggcccgatgacgtccgtcagagggagggcctgcataacgtgaagtcacggcgcaatctagacaaggaagatataaaggtattatcgactacacttacattaatcacggcggcgcgctcagtcacatccttatcacagagtgcgatggggatatcgcccgccttcgtgggcacgctgatcattatctgaccaacgcggcgtcccacggtgtcactgtccagacctgtaaatcgagaatacgaactcgatacgtcaggagaaacagatgcgctcagaacaaaaatagaaatgcgagaaaaaataccccgaggagagaccctggtcgtgtcctctggcccagagtaatcaaaggccggatgggcgtggcttttttttctc

SEQ ID NO: 44232 - DNA, 1501 bp, Oryza sativa
tatatgggagcgtatcctatgcacacaggccctcgcgtatatacaccgtgtacaccaactaaaaattatcacaaacaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaatttgacgttaagattttaaccctaggtgtaatacaattgaaagtatgtgtatgattttttctagattttttggtgacattttttagttggtgtgtacgtgtgtacacgtgagggcctgtgtacataggatatgttgcctatatatatagtagctctattatatacccctcccttagaataactattctacaccccctccctaccagtccagcctagcccacacctccttccctccccacgggcctccctgcctcctccccgcgcgcgcctccctccctcctggtgaccccgcgcacgcctccctcccccttttttctctctctcggtgctactcttttttttctcccttctcttccggctactcctcccaatctccctcctcattttttttcttttttttctctccctcctcttcccggctcctcctcctaatctctccatccggtttcttttttctaaaaaaaagaaaaataaattaagagaatttaaaacttgaaaccatgatctcatggttcacggaaaactcccctaaccaattcaccttatgacactaagtgattacaggttatcgtttgtttgctttatatgtttgttcgaatcagttatatttactatagaaatcgaagcttcttactttaatttggaactagcattatcgcagaagtgcttaacatggtacgttactgcgaaatgtataagtcgttactatgaaatttataggtcgttactgcacgttttgcagtaacatcatgatgaaattacagtaatagagaacatatgatagtaaaggtactactacagtaccactgcttgtgcatagctaaatttttaaatctcaatcttgtgcaaaacacaagtgctaaaaaatacttctctttgtccatacaaagatacatagtagcaagcttagtacaagtaaacttttagaattctaatctttaaacaataatatctctcacatcacatattattttttagaactgttttcaccataattctttaaaacaatgttacaacgagacaataatcctgttactacacgatgatcgagacaataatgcttttataacgttgttactacggaaagtagttgtgttactgcacattgatcatcgcgttactacgccgttctaaagagacgagaacttaaaaaaagtaaatctcaatctttagagagcaatatctcccacgttatatagaatttttctaatcggtctgcaccatgatgttcataaaaaaatgtatccatca

SEQ ID NO: 44233 - DNA, 1501 bp, Oryza sativa
agaacgtttacttacttctcgccgatcgtcaccaacctttgccttcgctgaggcggaggagacgtgttcgagtcctgagtaggatgaaatggtgtgaggagaagttcttccgactacgcgctaaaaaacgagagagaagcttaccgcggaggtcggcgctttccgacgggtcccgagtacggaggagaatttcctttccctctttgggatgttgctaccactcgtggtggcagcaacaacgttagatggctccttggcaacgctctctttcaacgacgctgccgcctggtggtccatgagcggcccgatgacgtccgtcagagggagggcctgcataacgtgaagtcacggcgcaatctagacaaggaagatataaaggtattatcgactacacttacattaatcacggcggcgcgctcagtcacatccttatcacagagtgcgatggggatatcgcccgccttcgtgggcacgctgatcattatctgaccaacgcggcgtcccacggtgtcactgtccagacctgtaaatcgagaatacgaactcgatacgtcaggagaaacagatgcgctcagaacaaaaatagaaatgcgagaaaaaataccccgaggagagaccctggtcgtgtcctctggcccagagtaatcaaaggccggatgggcgtggcttttttttctcttcactcgaaccaatccacccagccgacttcttgtgttttttgtgagttgtgtatccactccaataatactattgtcaagtacctttagggatgaggatctcggcaagatatgcagttcttggagaatgaaaaaaaaccgatctacttctttttggtattttagactaaattcttttgttcctcgatgcttaatcaaaacccccttttttaagacggaatcttcctccgggttcccatattcgttctctgagtcttcctctaaagtcccatgttcgtcctttgagtcttcctctaaagtgccatatttatcctctcggtgcctatatttgttctctggactcccatattcgtcctcggattcctcctctcgagtcctatattcgtcctctaggattccatattcatcttctagggtttcatattcgttctctgggatcccatattcatcttctagggtttactcctcctctcgagtcctatattcgtcttctagggttttacattcttcctctctggtcctatattcgttttctgggctcccgtattcgttctctgagtctttctctcgagtctatattcgtcctctagggtcctatatctaaatttaacaattcctgaaccatttttatcttttttgtatcgtgggtcgtcaaaataagcaactatagtatttctacgtaaaacacccataaagggtatttcaatcgaaatcccaaaacaggatattggttctttctcttgttcttgatgatactataatggaatggcgaacctatttcttcgcttttttgctaacaaatccaaattattttgaagaataga

SEQ ID NO: 44234 - DNA, 1501 bp, Oryza sativa
cctgatgatccacgagcggtccgatgacgtccgtcagagggagagcctacataacgtgaaatcacgacgcgatctcgaggagaaagatgtaaaggagtcattgagtacactcacattgatcgcagcagtgcgttcggccgggcccctctcgcaaagggggatcgggatgtcgctcgcctctgagggggcactaatcatcacctggccgacgcggcgtcccacggtgtcactgtccagacctataaatcgagaacaagaactcgataagtcaggagaaacagacgcactcggagtaaagtttgaaatacaagaaaaaataccccgaggagaaacccgggtcatgtcttctggcccagagtaatcaaaggccggatgggcgcgagcctgcagcggttggatccgcctacctacaaagtcggcagcgacttcgtaccccgacaacccccgttttcagaggtcatcgatgatgtcgatgaaagactggagggagggagttagggcgggtttggcggtccactctgggattttgtctggctgttcttcaggaacaacaaggacggggtctgaattttctatctgaagataaaaccatctcgcctgccacttgctacgagaagaggggcattggaagggtatgtaacgtgacttcaggcgatcccgaagtcggaatccaacgcatccggataccctgttgggttccatccaacgcaacttgtagtaaaagcggaagagatcaaggaagggctctaccccaatgtaggcctcacaaagatgagcaaagatgctaagaaatgcgatggaattcgggttcaagtgaagcaaagaaagaccatagaagttcaagacaataagaagaaactcggaaggcagaggaagaaaaccgcaagaaatgtaatcttcgaccacaaccatgcggcccaagacgggttcgggtttaatacctcctgtctccctctacatggtcccgcgaccagggagggcaccgtcgtcctgcaacttcttcatggacgcggtggttgaggtggacttgtcaagatccatcgccgccggaggatcgccggagaacaagagggaagaagcaagctagggttttctttgcggagagcggagaagacgaagggcgctagaaggctgaagagttttttggtgaacggacttcaaatgggtttccaaaatccctttaaataagtgcactaccgacggtgcgtattccgaggaaaggagagagattgccgccggaaaattctgggtccattgcgcgcggtagttttcatacttcaatttaaattcactcataactgttgaacttcatgcgacgttgtcgatgactctttgcctctacggttctcatgccgggatcgaccagatgagaatgacaacgattccgacatcagaagttccgatcgattacatgagttcatttaagcagaagtcaggggctactgtcaaggttacggataaggtataccctctatccttggacgtacgatgagtactgata

SEQ ID NO: 44235 - DNA, 1501 bp, Oryza sativa
ctctccttcatgattttgaattcgagggagtcgggatcctctcagttagggccggtcttcccatcatactcaaatgtcgtgcgtgatctttctttgattggagacagtcggcacattatgaaatgccgagtgatttgctccccttgaaggccctgttcctttatcttcaacattatattcagcagttcaagggcttgagacgctttctcacgcatgggaagggagttccagacatcccgatacttaggcggacagcacgagtactcaggcagggcagggtctgggttttggatataaaaccagttagcatgtcagcccttgttagaggttttgaagggatgagaaaaatatttcttgtgcagggttccatggagttggaagtcagatcccccaacaatgcaaggcttatttttgtcgggctggggttttaaaaaaaagattcggcgaaacaaggcaaagtgaggccgaatgccaagaaaagcttcgtagaggtggacaaaaatcgcaatatgaacaatggaattggggttgagatggtagatattaatcccataaaattcaagaattccccaaaagaatttagaggtttgaagtacaaagcctccataaaagaagtgggtgaataccacgatctcatgggtgtcaggagttggaaatggctcaccaaatacaggacgccacccgatgatctccttgcttggcagtaccccatgcgccaccatttccttgagagtttcttccttgacatcggaaggtgcccattggctctggaagttttctctattgagggcggaggttgcgtggagggtttcggttgaagggagacggtttggaagaggcggattgcggtgcagctgcgaaccctagcttttggcggcacaagtttgttactgtagcatgaaatggggaacgagcagctgttgcggcgaagaagacaaagtggtttccttcgacgtgattttatcgttgggtatcggaaaatgctaatgggcatgggcccatacagtgttttcagcccaaatataccttcggtgtggctgaatgtggtctcttgggacttaggcgtatttttgcttaggcaaaattgcccacacaaattaaagcctgataccgttaaaatccttttttcgcagttagtaaattccttggaattactacgatgcatacaaaaaggtgcccaactgtcaaaaacatcatgctatttttgttgactttctctataaggtcacaaagctgttagggtttaatcaagacgactagtttataaagttgttgttctattgatgcgaaaacacgaggccttgaagatctgcttaacttcagtgcaggtccaaaaatcttgcctttaggttcgtgagcgtgccagttaatttaatcctgcaatcaacaagaaataaagataaagaaaccgcggttaaatccataaatgattgccgatcgactagttgccgatgacatatcatttatctctgagccgatgtcatgtttgaatcgatcggca

SEQ ID NO: 44236 - DNA, 1501 bp, Oryza sativa
gtgcctctgaaagccaaaaaatggaagaccattgaaaagcaacatcctggtacaatggctaatgtttggaagaagttgaaggttgttaaatattcttatgtcaacatattttacatatttattttttttagttgccaacatggaacttttgctgacaggatgcatttcctgagctacgcaacgaagatgaagattgtgctatgaagcaggttgaagagtagtatagtaatcgacgttatcgtctccactgcttgcaccataacaagaaaccaaggccaacccatgtttcaccagaagattgggcttggctgataaagcatgtgtggaccgatgaggattttcaggtgcttattttttttaatataattgtgccatgttccatgcataataattgatatgcctgaaattttattatatagaaaagaagcaaccagaatgcagctaacagggcaaagcaggagatgggctctaaagtgggaactaaatcaattgctcaaattgcacatgaactggtgagaacaatatagccatttgtctttcactttctccgtatttttgttaactgtacagctcattttctcatttacatgcagagaaacaaagagacaggtgaatggcctacaacaatgcaagtttggaaagcaacctatcaaaaggctgatggaacatggtctgttcctaatggtgaacgagttctggtatatatctttacttatgacaacttgtttttttagatttcagcctaaactatatgatatgtgtcaatgtaccttctgagtagtactattttaccattggaaacgcttccatctgccctatctgtatgattcttttgcttactgttgttttcacattacaaatgcttctattactctaaaatttcaccttaacaagtccacctcacaagaagtgcatactaaatgggctaggtgaactactgaactgtgttgttgctaaataatcagtaagtgatatcattcattttatattaggccctgtttgatctaatacttgcaaaaaaaactagaatagtaagtgattaaaaatcatatttgttgtaccttgaaaccttgtatgaggtgttagtttgtttatgcttatacattttctttttataatctgtgtcaacagtctaaactaaatgaagttgctcaatcacaacaagaaaatatatgttctgcagcagtaccactagtagagcattttgccttggtccttgggaaaaaagcgaaccattcacgtggtataggcttacgtgcaattaatagagtggctgaagaaaggctaaggtaacttgcacaagttgaggctgctgaaaagcatgcagctactgcccaggagcgtgttgatgctgcggaacagcgagcagtagctatggaagaccaagtccgcaaattggatgaaacaaatgcccagttgcaagtagagcaacaatctcaacgtgatgagttgaactcccagagaaggacagtagagggacaagctacagatgttgaaagaa

SEQ ID NO: 44237 - DNA, 1501 bp, Oryza sativa
aaaaattctatataacgtgggagatattgctctctaaagattgagatttactttttttaagttctcgtctctttagaacggcgtagtaacgcgatgatcaatgtgcagtaacacaactactttccgtagtaacaacgttataaaagcattattgtctcgatcatcgtgtagtaacaggattattgtctcgttgtaacattgttttaaagaattatggtgaaaacagttctaaaaaataatatgtgatgtgagagatattattgtttaaagattagaattctaaaagtttacttgtactaagcttgctactatgtatctttgtatggacaaagagaagtattttttagcacttgtgttttgcacaagattgagatttaaaaatttagctatgcacaagcagtggtactgtagtagtacctttactatcatatgttctctattactgtaatttcatcatgatgttactgcaaaacgtgcagtaacgacctataaatttcatagtaacgacttatacatttcgcagtaacgtaccatgttaagcacttctgcgataatgctagttccaaattaaagtaagaagcttcgatttctatagtaaatataactgattcgaacaaacatataaagcaaacaaacgataacctgtaatcacttagtgtcataaggtgaattggttaggggagttttccgtgaaccatgagatcatggtttcaagttttaaattctcttaatttatttttcttttttttagaaaaaagaaaccggatggagagattaggaggaggagccgggaagaggagggagagaaaaaaaagaaaaaaaatgaggagggagattgggaggagtagccggaagagaagggagaaaaaaaagagtagcaccgagagagagaaaaaagggggagggaggcgtgcgcggggtcaccaggagggagggaggcgcgcgcggggaggaggcagggaggcccgtggggagggaaggaggtgtgggctaggctggactggtagggagggggtgtagaatagttattctaagggaggggtatataatagagctactatatatataggcaacatatcctatgtacacaggccctcacgtgtacacacgtacacaccaactaaaaaatgtcaccaaaaaatctagaaaaaatcatacacatactttcaattgtattacacctagggttaaaatcttaacgtcaaattcattatattttagccgtaacaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaattgtttgtgataatttttagttggtgtacacggtgtatatacgcgagggcctgtgtgcataggatacgctcccatatatatatatatatatgtcgacgggggataccctagaccagatataga

SEQ ID NO: 44238 - DNA, 1501 bp, Oryza sativa
cactagtagagcattttgccttggtccttgggaaaaaagcgaaccattcacgtggtataggcttacgtgcaattaatagagtggctgaagaaaggctaaggtaacttgcacaagttgaggctgctgaaaagcatgcagctactgcccaggagcgtgttgatgctgcggaacagcgagcagtagctatggaagaccaagtccgcaaattggatgaaacaaatgcccagttgcaagtagagcaacaatctcaacgtgatgagttgaactcccagagaaggacagtagagggacaagctacagatgttgaaagaatggtacaacaaaaacttgatgagcaaatggccatatatttctcacgcttcgcttcttccaatggtgtttcatcctcacgatctccatcagatgtaagaaacaataaaatatgactaatgttttgtttttcatgcaatggctttttaagtactgaaagctaaaaatatatttgctcatatttacaggaccattagaatgcatgaagttgatctccagaagtctatttaatcaagctgaagacatcctaagtctatttcaccgaataatttagtattagtcccatttaagtttctactggttgctttagttctcatcatgatgtttatgtcagcatttcgtgagaaattttgagcttcttgttgagtgcaacatttgtttggttgtaagacttctgaataaatatttcaatatcattgttccttaatttggtttaattgagatgttattttttttaatggtgttcgatgcaaaataaaatttatatttcattaatacaattgtcacggtgaaaaatagtagtggtcctgggagtataagttcttgtgatgaaaaattgtcacacatcttacgtggcctcacaaaaaaaagattatttgtgataaaaaattaacacgaactattcatttgtggcgttaaacacatcactattaatcgtcctaatcaacggaaatggtatagaggtgagaagaaatttcaccacataaaacatcaaaagtgacagtaacgctgccacagatctaacggaagtagtggccatataaataatcacatttgtaaattacaatagtgacaattttatagtcataattatatactaaacgtggcaatttttggggccacaataaaaatcttaagtgatgaaactatcaccactattctaaacatatttgtggcggcgtatgtcgtctctgatgtaactattatcagtgataaattttaccatcactaatatttatgaatatttgtggcgaacacaaaatcatcactatgttatttgtgatgattaccagtggcgactagtgacaaacttcagaattggccacagtcgcttgcttgtgatgaataaaacattttgtgtcaaaattaatcatcacaaaaaccaatttctcttgtagtgaaaccttgtgtctcctagcccatccacttttccagcttgatagccctttttgtattgtcgaaatcttgtttt

SEQ ID NO: 44239 - DNA, 1501 bp, Oryza sativa
atttcaccgaataatttagtattagtcccatttaagtttctactggttgctttagttctcatcatgatgtttatgtcagcatttcgtgagaaattttgagcttcttgttgagtgcaacatttgtttggttgtaagacttctgaataaatatttcaatatcattgttccttaatttggtttaattgagatgttattttttttaatggtgttcgatgcaaaataaaatttatatttcattaatacaattgtcacggtgaaaaatagtagtggtcctgggagtataagttcttgtgatgaaaaattgtcacacatcttacgtggcctcacaaaaaaaagattatttgtgataaaaaattaacacgaactattcatttgtggcgttaaacacatcactattaatcgtcctaatcaacggaaatggtatagaggtgagaagaaatttcaccacataaaacatcaaaagtgacagtaacgctgccacagatctaacggaagtagtggccatataaataatcacatttgtaaattacaatagtgacaattttatagtcataattatatactaaacgtggcaatttttggggccacaataaaaatcttaagtgatgaaactatcaccactattctaaacatatttgtggcggcgtatgtcgtctctgatgtaactattatcagtgataaattttaccatcactaatatttatgaatatttgtggcgaacacaaaatcatcactatgttatttgtgatgattaccagtggcgactagtgacaaacttcagaattggccacagtcgcttgcttgtgatgaataaaacattttgtgtcaaaattaatcatcacaaaaaccaatttctcttgtagtgaaaccttgtgtctcctagcccatccacttttccagcttgatagccctttttgtattgtcgaaatcttgttttgtcatgcccggaaattcactagtaatttccgaactaatttgtacataaaatcctcgtccaggaatcagccaaggtacacaaactgacaatttaatatacaaatccatcataataataacgttacatacttacaaaagaaaagaaaacagcagcggaattaacggtctagcgatggcttcagctccactcccacaggcagctcaactggtgtataagccaaatgtcttctccttttggatcatttttcttcaactaaggttgattgattattgcaagaatgagcatatgacatactcaacaagccacacagcaaatatgcaagtgcacaaggataccaaaggatggcataatataggctcatttgcaaaagcagcatttagcaaatatttaagaatagtaaaacagtagagtaatcatcaattttaatcaacactgaacagcacacccatgctgctcaggcccaaccattctgaacaaccaaacccggctgcacagatctaactccaaaccaggagctaaacaaattattaccaattatagcatcaataattattgtgagaggtt

SEQ ID NO: 44240 - DNA, 1501 bp, Oryza sativa
ccgaccacacagggccggtcagaccgctcggggtcgccggtcagaccggcggcatgtagccggtcagaccgcccctggtcaccggtcagaccggccacgcaatgccggtcagaccgcccctggtccccagctttgccaatttcgcacaaagatttaaaagcaagcaccggctcctctaatatcagaaataatcccttcttcacattatagccagatgcttgttgtgccaagtcatttgctctagaattatcacgcctagcaatatgtttaatagcaaaattatcaaaattggcaataatatccaaatatgaatcgaggtacctatttagtgatccgtccaagcatttgtagactccggcgacttgttgcaccaccaattccaaatcaccaaaagcttccacatacttagctccaaccatctctatgacttgtaagccgaataacaaagcattgtattcggcttgattatttgtacaataatattccaaacgaaccgatgcttcataacacatgccattaggtgaaaacaaaattacccctatgccttgaccttctttgcaagaagaaccatcaaaataaatcttccaaggcataacttcaactaggcaaatctctttctcataagcaatatctacatgatggtccactataaaatcacatacaatctggcctttcatagatttcaatggttcataagccaaatcatattctatcaaagcatatgcccacttgccaattctcctacttagaattggcctttgcaacatgtgtttaataacatcggcttggcaagcaactatgcatgtactagataacaaataatgcctcaatttgttacaagcatagtataagcataaacaaagtctttctataaagacatacctcgtttcggcatccaaaagacggcggctcaaatatgtaatgatatatccttgccatcttcctcttgcgtcaaaacggcaccaatgactttgtcttcggagacaatatataaccgaaaaggttttccggctttaggcgctcgcacaacgggtggagtagacaaatatctcttcaactcttcaaacgcctcttgttgttttgcccccaagtaaaatcggcttcttttttcaagcgaagtataggaataaaagcatcgattttacccgctaggctagaaataaatcttctcaaataattcaccttacctagcaacttttggacctccttcttacatgtcggtgctttgaaatcacgaatcttttctatcttcttagaatcaatctcaacccctctctcatgcaccatgtatcctaagaacttccccgccgacacaccaaaagcatacttaagtgggttcatcttcaaaccataccggcgcatcctctcaaaagctaacctcaaatctgctatgtgtccttccataccatccgatttgacaacaatatcataaatgtagatctctaagataatacctagcgaatcatgaaagatcaaattcattgccctttgataggttgca

SEQ ID NO: 44241 - DNA, 205 bp, Oryza sativa
ggggggggggtgaggacagtcagggactcgtggggatcagtcaaaacgatcgatcaatccccatcagggatggatcgaccggtcatcactccctcatcatttgccaccccttcactatcaatctttttgagctcaggcttggatgcacccaggcttccttgtaggattggtcaccatcctacaaagcttttctttctttctcaga

SEQ ID NO: 44242 - DNA, 765 bp, Oryza sativa
tggggggtggtaaaatggatcggaaaagtcctaggggaccatgtcattttcttggtccatcattgatggcatggtcttttaggaaacaatctagtgtgctcatcaactgctgaatctgaatatgtggctgctgctaattgttgttcacagattctttggcttttatctactttgaaagattatggtcttacttttgagaaagtacctctcttttgtgataatactagtgctatcaatattgctaagaatcctgttcaacactcacgcacaaagcacattgatatttgttttcactttttgagggatcatgttgagaagagagatgttgaattgcagtttttggacacaaagttgcaacttgctgatattttcactaaacctttggattctaatcgatttgcttttcttcatggtgaattgggcataattcatccttttggcatgttttgagggggaattagtacctcatggttttatcaagctataatatgacaatgagaaaaattgataaaagagagctttgtttatgcatatggtattttcttgtgcatgctagcaatactttgaaggtttatttgtctctagcatagcttgtatgtattctagttttttcatgagatttagattttgctcttaagggagatgatgcatgacacttaaattctatacttgaattaaaaaaaatgcaatgttgatgctagcatatggtttgatttgtaaatactctatatatatgctttattgaattgttattcctcaaatagc

SEQ ID NO: 44243 - DNA, 1501 bp, Oryza sativa
ggaaagcacataaaccaattcactactttgctttctacacagtacattatggtaagatatcttgcttcaggagaaatttgtcacactgattatcaccagcggttgtattgtgaagcagactcggtatgatctcaatatatgatgaaaaacacatacaggtaatcagaataccttatagtagctccactcatctttgtctccaaccttgtaagcaagtggattatcgctacagaatgccagctttttattggacaggtatagcacacccatgacaggaccagcagaggttgacagataacatgcatatggtttcttcagtttctcgtcagggaggacatcaaatgtttgatggaagattttatcatatccaccttctgctatgactttggtgatctgggaaaccctgcccattgctgcatctgtaatgcttggtccagttttcactgtttcaaggcaaattaagattcgtgttatgactatattatctcacgctgctcgaattcaatttaagaaacttataccatatcatttcaagggatcaacagtacaatgagcatgtgaacaaagaaggctcaatgcatgaatacaacaccaaatcagtgcaactagaaaataagggagaggtagcacaatgagacatctatctggaatgatcagcattataaaacactgcaagaatttaaaacatctttttactctctacattgttaagacatatggtttacctaacaaattaatatgcatgagctattcactgcaaataaattgtgttatgactgatagaatatacccagcatttctccgttgtcatcaacaacgccaactccacataaatccaattacatagcctaatagcaacagcaccacccataatccatatgcgctggaccaattcaaagtttcaaacagaccaaagaagccaatagatagtgaaccttcttcattcagcattactataacccacagatctcaccagacagcacaaatacccaatcaagcactactgtaattcacaattctcaccaggccgccttttttttttcgaactcatcaacacgaattatcgtcaaattccattagcgctaactaccgatataatacccagttcccccacttaatttaattacatgctactcataactccaaaacgaagataatatgcagaaaaaccaagcattggtaaactgatacagaacaaaaaccaataacttcagaattgaagcttacagtgttgccagaagttgccggtgagggtctccgtcttgcgagccgcctctccaaacctcttccccatcttgccgagaacatccttcaccgtatccattgtatctgcaaaaggggaaatccgaaacagttaaaaaaaaaaaaccccgcaagttatcctgccaacaacggagggcagattcggctgcaggaacgcactcttggaggcgggcgcgacgccgccggcgggtgaggagacgtaggggttgcccgagtagggcggcgcggaggaggcggc

SEQ ID NO: 44244 - DNA, 1501 bp, Oryza sativa
gggagaggaggtccggggctagcaatttatagcctcaggaagaaaagatcggatcgggtttgagaggaatcaatgatggaaaagctatggttcaccggataaacgatgctcgaaatcgtgtagaatccacgcaattttattcgggaatcaaggtggtttcttggggataaggtacagcagatcaagacgattccattctcgcaaccaacttgtgaaaaagagtaatggggaggctggatttgacggaggacgcggcgtcggctagagtacacgggcactgcacgggctctgtccaagctggaaaacgacactgtagcaggagggaatgagtttaaacttttctttctttcttggaccggatgaaagagggaggccaattggactttggccgagagatggagagggctgcaggctcggattgggccggcgggagagagaggaaggagaagaggattttctttactttttaatttataagtaaatgctgaaatgattttttattccgggaaaaatccagaaaatacttggaaactcatagtatttataagaattttatctagcccaatttgatgctcaaatatttcatagattttattcaaacacttactttaattattacataatttgtaaaatttcctttctcacaacaatttataatttagcaatttttagggtgtgacatgcacctcctatgtctattactctttgcctggtgatctccccctctccctgcgatcatctcactcaaccatacttcagtgattgaacctaggattataaactctaactccaactcgaacccaggattctaaactctaactccaactctttgtaggggtcattggagcaggagaagaagatgtcactggagctagagaagaacgaatcgcgaagcaaatcctaaagttctaagggtgtgtttagttcacgctaaaattagaagtttaattgaaattgaaacaatgtgacggaaaagttgaaagttatgtgtgtagaaaagttttgatgtaatagaaaagttggaagtctgaagaaaaagttagaaaataaaccaggcctaaatcctctcgtgtttctcttgtggaaccaagtactacctccgtctcaatttaagtgcattgctaagtttccgcgtccaatgtttgatcgtctgtcttatttgaaaattttataaaaaaattaaaaataattagtcacacataaaatactatttatattttatcatctaacaacaataaaaatactaatcataaaaatttttcaaataaaacggacggtcaaacgttgaacatgaacagtacaaaactacactctctcttttttaggatgggtagcaacatatactccacgtcgcattcaaccgtatttaattcacaaacggatgggcagtagttgttgttgtcatgaatactcggagaaaacaagccatcacaatcacgaattgaagaaagtccttcatttcacatcaacttcttgctaataccttagctcttaagcaacg

SEQ ID NO: 44245 - DNA, 1501 bp, Oryza sativa
tcgagccggggtcttcggttgctatctttggcctcggcgccgtaggattagcggtaattaattttcgattatctggtgtacaatattgaagtgtacgtatgttatagtgaagtatttttgttgtcaggtagctgaaggggccaggatttgcggtgcgtcaacgatcatcggcgtggatttgaaccctgagaaacatgaacttggcaagcccttctgctcatgaaactgttctgaatgttgattacaattcagacctttggtcgatgtcctagtttatactagtagttagtaacaccttttgttgattttcaggaaagaagttcggtgtgacgcacttcatcaatccacaagaacttggggacaaacctgtcagccaagcgatcatcgagatgactgacggtggcgcggactactgcttcgagtgcatcgggctggcgtcggtgatgagcgatgcatttcggagctcccgagaggtatgcacattacagttgtactcgaacatcctagtgtacgttggatgagctgatccacctgtgtctgaagatactaactgtttactgctgcagggatggggcaagacgatcattcttggcgtcgaaatgcacggtgcccctttgtccattccttcgttggagatcctcaacggcaaatgcgtaatgggatcactcttcggaggggtgaaacccaagcaggacattcccatcctggccgacaagtatctgaacaaggtaaacctttcacttacagacaccctcaaaactgattaactgttcatagtgtcacaatattttaacatcaagattgttgatacgaacgcaatgcaggagctggagttggacaagttcataactcacgaggttcccctgaaggacatcaacacggcatttgaccttctgttgcaggggaagagtctcagatgcaccatttggatggacaagtgatgtggctaagtgaaattgcaattgagcaaaccagttgtctacttaagtttgctgcccacttcagtaggttacaatacaattatacaaataactggtttgactgctgccccaagaagatttgtgtgtataatgactagtgaattttaacatcgtgtgtcaaatcatgtgcgttcagactttattgatatacaaaatcactctctgaaattcatctgtgtattctcagtcatctgaattctgcctgtaacagctttctcaaaaaatggatctccaggtgaataaatgattgctttctttagcaaccagaattctgatacatatcatgattatgcaataattcagggaaatgtcacgtttaaaagaacagggcaagatcacaagttacatatagtaacactcaacactccaaatataggtaacaatctaattcagaatttcagatgaaccctggccttaaacttgtcattacccacaattttaggttctcatctgccaccacatatttagcaaaacatgaggatgcacgcctggatcatccatttttatcctcttcttcctcc

SEQ ID NO: 44246 - DNA, 1501 bp, Oryza sativa
gtaaaatttattttaaaatagtgtattatttgaaaataatagtacaaagtaaagagtacaccggcttaagttatatgatggtagattctttgtttgtaaaattatgattatttaaaaaatatatccattatatatatatatggaaaaaagaagaaaaaaggaaaaagggggaggaagcgtacgtatttggcacgggaggagagaataggtgggacccatggtttttagtttgttttaagatcagtttcatctaacggtgtataatattggacccaccaatttaagtgaaaatcaaaggatatatgttttgtttttttcttagaaaatcaaaggaagcgtacgtttagcagtttaaaaagcgcatcacgagcatcctaaatttcttccaactcttgttggagaaacgaacacagatgtctatatgatcggtgcgccaagcccaacaatccaccattcctacataatggtgtcggctacctcgttgtttgtcttactagtgacctcgaaaactcgcgcattgagctccttccagataatccagcataacagggaaaaagccgcatcaaacgccttcttgccaagcttgtcaagccctgcgcgtgcatccaagaatccaacaaccaacatacaagatcgatggcatcaggtgcttgagaaggtaggcacacgtaagtccagccaccagccacccgctttcaaaaaccaccagttttcataatttcattagaaaaaaaaggtagaaaaaactaaagttgtaaattatattccttcaaaaactgaacctcataatcatccatatcaacataaaaccattttttcatattcttttagatccccttacaaagcacgagtatgacacttgtctacgtaaatcctcgattttacatattatgtaaccatctaaaatttcaaaaccaattggttaacatttcaaccatattatttcgttgaatatttttttgaaattataatgttgaaggtttttttttaagaaatatacaagattacggatttgtacgaatagatcgtatttcttagaaatatacgagattacggatttgcatgaatagaccgtcgttacggttcaatagtgcgaaatcgcagcgaaattgtaaaaccccaaagtgcgatagcgatgatggcatgatgacgcaagcgctctcgcaagtgagaatacgagaccgctcggtcttcgctggtagccgttgcaagaaggcctcggtttcgcttgttccttgagcgacaccggccagaatgacactaatggcacaattaatagtcttattgagtgattaattaattactaatgatgctagttaaataattaataattaattaacggttaatgatgccgcccgagaccgtgtgacctcgcacttccattctacgataatgttatatttctgctattcctttatacacgtgtatatttatgtaaaatcggtgaaaaaatggtatatttttattttttccccttatttcgttttgccaaaatatacga

SEQ ID NO: 44247 - DNA, 1077 bp, Oryza sativa
cccctagccacctcagcatcgccccgccacgtcggcggtgggacggcgccaaagaggctggcgccgtcctattgaacgacggcgccagccactctggcgcctcaaaaaggaccatttttgggataagtttttctagagatctacttgcgaaataagtttttcaaaaggacaaaaatgtgaaaaatccagtaagccagcatgcaggtcaccagcggcgtcgtgatccatcggcaacttgatcggcatcgatggcgcgcggcgattagatctatgtccacagccacgttgcagcgactcgatcggtgtccacggcgcaggcgctcagccgatcggcaaagccgaaggtgacgaccaatccattggctcgctgaaatcatatggtaaaggcaaaaagcggcgctggagacatcacagcactgcttacagcatcgacaacagcatcgtccaccgtacatcaatagcatcgttctgggggtaggtactcccgttttgattttcttttctggaaaaataattcccaaaattcttaaatccatgcaaatcgatcggaagctacaaccaacatctcgcataaatctggtggtgaccaatttacccagccattcggtatttacaggttgggtgcgtctgccccgtcagcggcggcgagccgtcgaaccctcttctcaagcggctgacaccaccagcaagaggaggctgcaccttgagcatgtagctatccaggggcctgaagcgttcggggtttatacgcgagcggagcgccggcagatccaaccatgcacatgtttatacccaaatttgacacctatgattaaaataggaaagattgccaaaatttagaagtctaccggtttcctccgagtgggccggtctgactgccgtgtgttgggcggtcagaccgccggttgagggccagtcagaccggcggagtgtggccagtctgaccggcaggtccgagtccgactgtgtttcgtcaggtttcgaggtttccttgctcaggaaggcatgttttgggtttcctttagtttctaccccgagttggacgtggaggagggcctgtagaggacaagaccaacc

SEQ ID NO: 44248 - DNA, 1501 bp, Oryza sativa
tccctttccccccatttttccctctctctctcgcgttcaaacgggcggatttgcccccgcaaatctcgccggcgccattgatggcggccggacctcccgcgcctattccttccccgcgggccgctctctcccccccttccaaccctatttaaaccctccccgcacctcctccgtccatttccgcctctcgccgcccttcctcctcgccggaatcgagctcgcgccgtcgctctctctccgccgtcgccgccgagctccggtccaccaccgtcgtcgccccagaccacctcccacctcggcgccgcctccttcggcttcgccgcatcctcgctgacctcgtccacccctccgtttcgctcgtcgaccaccggagcgccgccgtccccatcgacccgagccgcgccgccgccttcctccgctccggctgccttttcgtcgtcgccgtcgacctagggtgagccgtggaccaccgcctcgtttccccctttccctcccctctctcggccgccgctccgatgtgcccatggccaccgccggcgaccataggggcgcgggcgcgccgcctcccgccggccgcgccgacgtggccgccttcgggcgcaccgagcggctgccgcgtggggcccggccgtcagccgcccgcgccctcgggtgcggctcatgcgtgggacccacggcgccggccggtgtgagcccgagtgcacccggtccaccgtggaccgtgaggctgccgcgtgggccccactcccgtggacccggtccgcgcgccccctcccctcggctgacgtaataaacccttttaaaattaaaatttaaatgaagaaattcgcaaatattcatttaaagagcatataaacttcaaatggccataacttggccattcgaactcggaattagaccgttcaagtctctaatttttccttaagaagtcaagaacctttttttgtgctttgttcctgcttgttatatggagtttattagagtaaaagccttttcttttccgttggtcgtgtagacgctgcagcttcggaagatccgctcttcgtggaagttgaagtcacatcatccttgaacatattgaatcccagtttataaaattatgttgatttaaattattgcattatcgctttatttaaattcccgcgttatcactattttatctagccatgcctatttacctttgttatgaccttattattgttattgttattatttccttgttcaccctagaataaacaaaaccccaattagtggacactctactcatggtaccactactatgattttaggtagatgcttcgctggttaattaggcaatattaggtggttttacaactctagactttgggatattcgtatcacctagacactatggaatggtttgattattgtggaaattggattcacacctccccctctattcaaaatcctcaaaatggttttaggctgggctcggggtgcatggttttgatagtagcacctcggccatataaggaccggt

SEQ ID NO: 44249 - DNA, 1501 bp, Oryza sativa
aggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacagaggatgcgctgttgcttaccttccgtcctggcccgtcgcagcagtagacgagcagttagtaggcttgcgcgtgtgttctttctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcaga

SEQ ID NO: 44250 - DNA, 1501 bp, Oryza sativa
ttagggttttgagcatgccagctggtttgatcatgcaaccaacaagaaataaaagaagaacaattaagtccgcaaatgatagccgatcggctgtgttgccgatgatgtttcatttgatatcaggccgatgtgatgtgaaccagatcggcaataaaatactaaacaagatagaattaaatctacttgattggctgcagatatcaatgatatataatctttttctaaaaatatgtctaaactaagcgattgggatagatcggacagtgagccgagacagtataaatcacttatgtttaaaagtactttaagacaaagattatatatatttatagcttagccaatgaggtaaatctaagatatatcggctaatactctgataccatctatactaagatattaaaacagacaaaatataccaaacaacaagcttaatatatttctaagcaataagatcttaatataaagggcaagtttagcatgtcaaacaaataaaacaactaaaccaggtaagatcggctgaaaccccgatactatctctatcaataatcatagaacaagttagatattataattctagatattacttaatagatcgaacctaaccgatgcagcattaagtacaaaaagaagcataagatctagacaaaccgatgaaaatctctttgagatggtagatatactatataaactagatcaacgttgatatctaaccctatcggccgccttcttattaatagatattaaccgatctagggttagatagcaatattgattgagattttatagcgtatatgataactcgacgattcacataaacaagattagagtatcatgaagatgtaagcactaatcccgagaacgcaagccgccatgacaagttttacctctcatcggagatcgaaaccgatgcagcccaactcgaaagcaagaactcgtcgaaatagtgaaagtagaaaagggtggcaatgcgccgaaagtgttattgaattgtttttgtcattatacatggtcttgggttatatttacacccaaaatacataatgtatccttgccggacacgactctaaatctgttacaaccgtaagatacggacaagtcttttaggcagactcttgccggtaaatatctctaaggaaactacccacaatatcctaattaatagatacaattgcctatccgtgagctcatctcaatcatggcaatacttgtgcagcacgtcgatcaatcccaaagatgattgtagagccaccttagcgagatcggctccatcggctatcctctatctgattgtcacgcccagaaattcccgaatagaattccaagcaaaatgtacattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacagg

SEQ ID NO: 44251 - DNA, 1501 bp, Oryza sativa
ccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtctactaatgattacatcgagcatattgtaaatggcatgattctcattctcattctactaatgattgcaatgtgtttcgacgataggttcaatcggccatagatgaaggacgattgaagttcactgatggctccaagatgaatcttgatcatgatccttttccggtgaatacgattaatttcaatgataagaaggtgttgattcggccggagcaagccgaatctactaaaggaaaaggagtaatcattggtgaagcaaggcctaaaatgatagtgccaaagaaaccggaggttggcgtttggaaggaaaataggagtggagcttcaacttctaaagcccctagaaagaccaaagtgacttttgatatgcttttggaaaagtatgagaagcaaggtggtgagagggttcgcaacaaaggaaaaagaccaagatcacttcctagggagcgatttggtcattcaccaagacagtcgcattcacctccatatcatcatccacaagatatgtcatggggttcttatccaatggccaccgccgggttatccttatccttattacatgccctccaatgcaattcaaccaagggtggggaggaccgaggaggccaattcatgagcgtttattttcaccgaacaacggccggttatatggtaagaatcgggctaatgaagaaaagagggaaagaaagcgcatcaaggtggaggtaaggacttcggaagtaattaccatcaaagtggggtctcatgatgtgtcaataccttctggagatgaagttggagagtcttcaaggaaaaaatccgaggccggtaccagctcatcgcagtcggatggtctgaccaggccttctggccggtctgaccgcagccatacagccggtctgatcgggccatcaggccggtctgaccgccgacccgacagcggtccgaccgacacctcaggctggtctgaccgtgcgccaaatgtcggtctgaccggcgcatctggccggtctgaccggtggtctacgtccggtctgacccggctccagcgccggtttgataggaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaaccggttgttgtagaggagaaggaggaacaatcggttgataaaggtgaatcatctccaaaagaagaca

SEQ ID NO: 44252 - DNA, 1501 bp, Oryza sativa
ttcctagttattctagaaatattcaaacatttgggcaactcgtattctatcttggtgcaatgtactggcagtaggtcataggtcttgatcagtggtctaatctcatctcaataagtacattggtggcctaatcacaagaatgttattgtactcagacgggaaatcggcggcgcgaagaatagttataagtaacttacttgaatgtcagactctttaagttttaagttagcagtaggtgctaattagtactaactgctaaataatcgatgcttgtgccatagaacatcaaacctatttaattattaactgaaaggacaggtttgaactgattatatcgataggttggagtattaaactagtcgtaactcgtaatatagtccattgggagcattgacgttgaatttatttagccaacgtgttaaggcaggttagtagatggtatgtggtccgcacattttgttcagtttgattcgacgaatacaaaatgttgaatgaacatctcaacaaaatcatcagttcctatatataattgattttcttaagatggtgaatctttatttcgagatttaatactgttctgatgtagagctagccatttctattatttccaataaaatatcacggatcaatagccggtaacgttgaagaatatttgtggtgccttttctactcttctatctccattcattcccttttcacaatatattttttattgaacgcgtaaaaggattgcacgtcaatatattagaagaatagagtttttgttacacgacgcaatcggttagaccgacttatgccaagaaagggagaaaacaaaaagaccaaataaaaaggagaagagaagactactgcgacggctaaacacaactttaaatagcgggaaggggttagagccactaccctcccaagagaaccccaaaattagcaatgtcagctaaagatcatagatgacccttagagaggatggactcaaggacctctgagaccgaggacaacgcagagtcaaaaactttggagttccgctccttccacggttgccaagagaccaggaggaccataaaatcaaaaccggcacgaatatacctttttaaagagaaatttactattttaccacgtgcatatacattatcatacacatacgtacacatccatgaccatgagtaggtcatttttaacacacgctcaagagacatcagacacaggccggataagtcatattgctgaaaggttgcgacccgtttatatcaacaattttctacaccaacacgatccgaatgtcattttccgatttcttagtttattatggcctttttgacattcaggaaagcatcgtccctttcctactcctagctcattcgtagaagcatagaacccatccagaaaatgcagctatcttacgtcgttcttatcagaacacgggaacaagccaaacatactgcatccatatacgctcatgacattcaacatcatacatatgtttccatctttagtgtattgtttg

SEQ ID NO: 44253 - DNA, 1501 bp, Oryza sativa
caatgctgatggctggctcaccgaggctgctgacttcggccgcgtgttcgtcaccggtgactcggacggcagcaccatagcgcaccacctcaccatgcacgccggcttggcgatgcccaatctcactggcgcctgtggcatgatgtgcaaccgcgccatcgactgcaccgagcggttgttcacaatggacaagccaatggagctcactgcgagtgagcgtcggaagaagactatgagaagggagaagaagataagggcaaaactgccattttatgtgatttatctctcatcagttgggtggatattatatattacaccaaatttgctccaagacactcaaatgcgtaattagctgtgggacaccacaaagaaattttcttgaggacactctaaaaatatcgtaatttgatgcaagacactagactcattaaaatatattaaacccacccaattgaatgggtgtacctatataatgctttgaatagggtcatctcgatagttgtatgatatgtggtatattaccactcagccaacgccgaccataaataccaatgttggggctcttggaaggtcatatttctcatataggactcaaagacattgattcactctttctgtctaacaatttgtttcatggaggtgacctgtattgaatctcgaaaaaaattttggaaatacactctttttttaataatttgtgtttatatatctacattggagagtttagcagaaatatatctaatccgcggttcggaaacacgggaccgcaaagcaagtgcggcgtggacatgcaggaacggcggctgcttcggtgccgcgcagcggaaacgcggaataggcccgatcctgcagagcagaagagcgggaccgtatcgttcccgcggccctatcctgtggcaacgtggcggagagtgggaccgatttgctcccacggaaccgtggtgcgctaccgacgcggttctgcatcccggatatgcggcaccgatctggtcccgtcgtgaggcaccgctccctttcccgcataaccatcatgcgggaccgtgaatcaatctctacgcaattggccggcaggtcgtcggtcccgcggcatagtagtgcgggaacgcaccagcacgagcggcattgcgttctggattagaggtcacaaccgtaaaaaaaagcaacttactttgttgatgtgattaggcttttttttttactcttctgcttccggattaatctccaacaactaataagaaaatattatactggctaatgaacctccgttggtaacttaatttgttgatgtgattaaccctgtttgattcagcttaaaattattataatctggattattatgagtaagccgaaacaaaccagtagattattataatctataagccagattagtataatctaataatctcctatggaggagctttttctagattattgagtggctaaagacccactacccttagatgtctccagtaatctagagaaacaaacaactcgcaactta

SEQ ID NO: 44254 - DNA, 1501 bp, Oryza sativa
ccattttttaaaatctggaaaataataaaagaaatacccaaacaaatatatgtttaacagaaaaatgcacaaacttggcacatgtagtacaattttgaggtaattccagttgctatagattcacaaagatatgaaatttaatataaaaacctaaaacttggcacacgtagtacaatttttgcctctaaaattcatctaatataaatcacacataaagcttgctcaaacttagaaaattcatataaacttcattttaactcattttggagtgaacaaagttccagtgtgctcataaaaccatactcttaattttcatgaactaaaacttaataccttctgtaataaaaacatcaccaaataattaattagtaaaataactggtatagtgcaaactagaaactacaaaatccataagtaatttgttttaactccaattgagacaaactaaaatttcttagtttgataaaagaatgtatattagttctgtaaacaaatctatagaagaatccatatccgaaaacattactaaaatttgaataatgaattaatattaagaaacttctaaaaattcatatcaaatttaatacaactccaaatgaggtgatttcagatttgttagattagcaaaatcttggacattagtttttataaaataaaatatagcacttacagtacccaaaacatatctaaaatgcgaaataactaataactactatagtatatcacttagcttgtaaaatttataataaaaacattctaactctacaaattgtgaaaccaattttgttgaaatcctgagaatatccttttcactgcagtaacccagcatttcataaaacttagacctaaaatgcatctatgtactattagagcttaattaatctagtgctagtattaaactttgaaaattaataactcccaaatgcaaagtgataaaatataaattccttcaccacaaatcttacccacacagcacctaatcacactagtaaactcatgcattttagagcattttgaattattgcatgttttggtatttatcgttacttttatttcttttagacggcgaaatcgttaccggtgaaggagatggattatagctaaactcagttaggtcatatatattctaaggcaagttttgcccttccttgaatcctatgttttcgggctaaatgctttgattataaagctgcacgtgtatttttgattataaacatgcatgaaaccccttttgaaaatcaccccttgctgttttgaaccttaggatttatgagagtactttaattgtgctcatataagtatactatacttttacaaaatgcaaatgcttagcctagcttagtaataaataaaaacatggttatggatcacttattatacttttgaaaacccttttgaactttatggacagaggtgattctctgattatttgtgaaataaaatgagataaaatatgattttagacttgggcgggaagtggtatgcatatgtgatgtgacca

SEQ ID NO: 44255 - DNA, 1501 bp, Oryza sativa
tacctttgcttagcttagacaattaaaacacatagaatgtcctctctagcctaactagcctaccattaattgttgtccttgaatagttttagccttaggtagatttcacacgttccctaagttcgatatccttttggggtcacccgaaggtgaagtgctacagcggtattccgtgcgcttgcggatttatctgtggtcgtaagaaataccaacaccgccattatcttcccgtgtgtcaactaggggtggaaatgggccagctcggctcggcttgcagtggctcgtaacaaactaggcttggcttggcttggcttagttagggaaacaagctaaaacttgagctcggctcggcttgtttcctggctcgagccagctcgagatggcttgcaagccttcccgttgaaacacctcttcatatatatttgtaattatttaaaaaagcaagaacaaattatcaacatgtaaaatttaaataagtttatatattcaattcttcaaaatcttaatgataaatttcaagttaacaaataataacgctataaaaagtaaaataatcaatataaacacatgatggcctaggctcgtgagccaaaacaagcggcttgaaagctagctcggctcggctcggctcatttccagcaacgagctaaaaaggaggcttgggcttggctcgtttggcttacgagccaagccaagcccgaactgagcccatgagcccgagcttcttttctacccctagtgtcaatgccatgattacattgtgatgtctcctctctatttaagacagcctatgacagagtttgactctaactcagttttacacatattccaactctaattttaactcttagtaggattatatattctgacacatattctaacagctggagctgtcgtgagctcgtgactcgccattggtaagtgaggacacaggcaggaatttgttaggctatgttcagcaggaggtgttggcaaccccttctttctggcacacaaaagatgtatgcattaacgtatgattaattaagtattagctaaaataaatttaaaaatagattaatatggtctttaaagcaattttcatatacaaaatatttgaaaaaaaacacactgtttggcagtttgaaaagcgagcgcgcaaaaaatgagagagatgagttaggaaagtgaccaaaagaactcattcttatggcatccataatgtgatgcaaatgtagtccacaagtaatataatatttcattcagccacctaggccccgttctaaaaaaaccaacttttcctcactttttaatagcatgcttttcaaactactaaacggtgtgtttcgtatgaaagctttttacatataagttgctataaaaatcaaataaatccattttcaagtttttaataattaaaatttaattaatcatgtgctaataacttgtctcgtttggtgtacgcacttaatcttcatgcttgttggagaatcgaacgggatcatagtactattgtgcaact

SEQ ID NO: 44256 - DNA, 1501 bp, Oryza sativa
tcagcagagctcacagctcaccgtcaccgacggccgacgcgacgggagaagatcatcatcagctgcacatgcaagaaaacggcgagagctaacgagcgcgtcccacacggccacagcgacgcccccatcccgacgtcgcggccggagtctgaaagtctgaacccatgcgtggcacgaggacgatcgaccgggctcagctcacgtcctgaaaacgtacgaagcacgcgcgaaaacgaacgcccgcgtgcgagagccacacgcggtgcgacacgcgtgcgcgcggacgtggacgccccacgccccggcgtaatggaggcacacgtaggagtacgtagcacatcgttgactgctcctcccacccgcgacgcgcaccacccgttcactctcgccgtcgtcgtcgtcgtcgtcaatcgtctaccagcatctcctgtccactgcgcgtgggcccgcccgtcatcgctgtcgcgggccatcgccactagtgcctcccacaagaggccgacgcggcgtggcactaatccttttcaccttttctttctactgactttttttttttacttcttttcgatgtgggggaaataatataattacacttggggtgcacaaagtctgaaggcagtcacgaccaaatcccactctagcagatgtggagttaaagaaatcaggcttcttttgaccaccttggatcagtgaatgcgttggcagctctaatctaatctttcgttgtatcgaaacattcttttttttttgtttctgtcgccattgttgtaggttggaattattagaatctgtgtttcagaggctggtgtggtggtgaaaagaaataaataatgggcaccttgaaactagtctgatacgaaacagtagcgcccaggccgagagactcagagacagagtacctgatcctgatccatgacagtatgaccctgtaacagagttcactgttggtgtttactttcatcattttcgcatgaaatgcttttatactgtgtttagtttgtgtactaattttttttatgtatacggacacacatttgaagtatttaacatagactaatatcatgacaaattacagatttcgcctgtaaactgcgagacgaatctattaattctaattaatccataattagcaaatgtttactgtagcatcacattgttaaatcatagcgtaattaggctcaaaagattcgtcttataatttacatgcaaactgtgcaactgttttattttttgttcacatttaatgctatatgcatgtgtccaaatatttgatgtgatagaaaagtcaaaagtttgacgaaaattttttgaatctaaacaagtcctacgtacgtaatactagttgttaggcttttttaacgtatctactttccaagcgtcgaagtaagttgtttttttcggcagcacatattgatattgcactcatcattgttccatcaaaataataacaaaaacgattagtttgattttttcctaggcaaacttatttaagtttaagcaa

SEQ ID NO: 44257 - DNA, 1501 bp, Oryza sativa
ggctatacttattttgggatggaggtaataccatttgcgcgtgaggacgaaggctacaaaagatgcaaagcagagctccgttggtgcccgtaaagcagggtccttgtcgtgattcacgcgtgcagacacggtcgtctcgcccgagcccgatttaatttacacggacaatggacatatccctaaatccgtaagatgacatggtcgatccttcgcaagttcatatagaagtcacatacgtcctgtttagattttaacttttttttttaaacttttaacttttctatcccatcgaattttcctacacacgtaaattttttacttttccttacatcgttctaattgctttaaacttttaattttaacgtggaactaaaaacagcctacgtacatcaacgcgtcaacgccagcggcgttgcgtatgaagctgatttatctataatagctgctgctagtagtttcagcacgccgcacatgcgtcgtgatgttgatctcactggtggtggaacagagatcgtttttgtagttctgtgctgcatgcacaagcaaataatggccatgaccagagaagattttaggcgaaatggaatcagatcaaaagatgacctgtcaccgttcacctctttcatgatatatctttggcatggctctgttccagcaaacatcacagcacgtcgagagaaaggggataatatatcgtttttggaccgggtgacacatgctgctgttgcacgaatctggcctttcaaactgggtgctgctagccatttggcgagctacggcgtccgctagccacactttgcgacctcgcgtatggttttttttttcctgactttttgtcatgtgtttagatactgtatcagcttcgctgctgtttcctcaacacatttgctgccacgtttggccacccaaggaaatggtaaacaaatgcagcaaaacctcacgttctatagtttagtgctaattaaagaggttgcgtagatgtacttacagagaggtgaataaggcctctcacagtccggtgacgtggagcgttacttcgcatcgccggctcggctttgcgcttgcatggagcaaggtcgcgcgctccaattgagctcctcgccccttagcagagccgcgcgattcttactcgcagtgagtccacgcgcggcaaggttctgtgcgccgtggagcgcgtgacctagacgcgtcgtgccctcgccggcgaacgggacgaggaattccggattcgtcatccaaaattgccctcctgcggctccgtcgttcgcgccctcccgaccaccaccttggcagggtcgacgtcgagctccgccgccaacaccgccgcaaaccaacacatgtcttttctgcacactttgtcctcactcgtacgcacccggaaagaatttcccgatcggtcacccatctcgaaattgctccaggccaagcacgcttaacctcagagttctttcgagatcggcttccagaaaaaagttccaacttgttgatatgagtattctat

SEQ ID NO: 44258 - DNA, 1501 bp, Oryza sativa
catgcatacttttctctctaaagttttttttgttgaaatttgttattacctctgtctgaaaataagcgcagtcctctaatttaaatttgaactagatgctgcacttttttaaaacaaagggagtagatggtttgcgcggagtatacatagaatgcgttccggatcagagtttccagagatacaattaatgcagataagccagcatatgtacatgacatgtcagttggtgtacgtacaggatttgttcgatcggcattcatatctacatcttttccaactggcattctctcctaccggtagttttagttaattccctcctctgcgttgtactatgtccattggacaacaggccatatatgcgatcgaacactgaaacagtaaatagatcgaagatcgaattgacttaattaatagcgcagccgaatatatagaaaatggtaggtccttaccagggcgaattgtatgaatcgtatatttgttatagaactttaaaatcataaggtttgaatggaggtattatttgtcattaaatttactcgatattacctactgttgaaccggagtatactttgagttcgtttgggtggttgggttagaattttcgacggtatgtgaaatcaggcaagtcatgagcgcgtgataaatcgggtgttgattaccataagcttacaaaaatgatttattcttttatattctaggaacttcgtctatacataaaacttttgcatggaacaaggaggtaatattgcttatagttgcccatacgtactcagcctaaacaaaacaattcttgtttgcaatgcctatttacttcatttagtttaagcaagtgagtcaatccatacccattgttaatcagacagcagcagtacatgcccttaacgcaacgtctgattgttttggactcctgcatgactggatggggttccaagtctgagtctttcatgtatgtcctagttcacttcactggcagttcctgctcgtcagaccatctctttgtccaaagggcccccattatcgcttacatccagtggacaagagtttgttaaagtgggcgtgctatacggattcaagcaataactccacagctatggccagtacacaagtagtttttggcgaagggtacattggtcggttcaacttgacatgggtcttttatctaaatcttatgttaagtagtaaatatttatgaccagatagaatatacattttcatgaatatgctgtaactcatgaatgtccattacttttttggggccgtgcctttataagtgataaaaatcgtataattagccctagaaacgactgccagagtaaattctggttaatggttgaaagcatttaatattctccaagtgttacttacaggagaaaattaaaccaatgttaattttcagatggatataaaaccgacgtatccgtgcgccaccatcaagcaagctcacatatgaaccaccgaagaacatagatagcatcgcccaacctcgctgcattcgcattac

SEQ ID NO: 44259 - DNA, 1501 bp, Oryza sativa
attaccccttgtacccccttgcattaatcatgcatctgccggtgtggcttgctgagtactgtggttgtactcattcttgctcaatctcccccccccttcagtaagagaagctttggagaagaattcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttactgggatggggattaatacactagcgttcgggaaaatgtatttttctcggtcgcgacaaatacaagtcaaggtgcgcctaattggttgccaccgattcagccgggcctgagagtttcgctgtggaatcagggaccgcagttcgacttcatcaacgctgctcaggcgccaaccgttcggcagcaagctccaactccaggcttcggaacaaaccaagcaccaatccaagctgccatgatgtggtcacagccaatttttgacccatccatggcggctcagcaagtacctccagttggagccgggcagccgaatgccatggcccaaccacacgcacaagctgcgatttcgcccttcgccacaccgtacccgcagtagggtgcggtaaacagggcgggaggcgaaaaagggctaccgctgtgtgggggaatcaagactcgtccaatcccaccccagtttaagttcccacccgtcccgcgctattcaggcgaaactgacccgaaggagttcctctccatctacgagtcagcgatcgaagcagctcatggtgacaaaaataccaaagcgaaggtaatacatctcgctctagacggcatcgcccgttcttggtatttcaatttaccagccaatagcatttactcatgggagcaattgcacgatgtttttgtccttaactttcgaggcaccaacgaggagccgaagacgcaacaacatctacttggcattcgccaaaggcagggggagtcgataagggagtacatgcgtcgcttcttgcaagcccggtgccaagttcaagacataaccgaggcgtcggttataaatgccacttcggccggtctgctcgaggacgaactcacaagaaaaatcaccaacaaggagcctcagacgctcgagcacctacttcgcatcattgacgggttcgcaaggggcgaggagaattccaagcgacagcaagctatacaagctgagtatgacaaagcctccatcgccgctgctcaagctcaagcacaagttcaagttgtcgaaccacctcccctcttcgttcgccagtctcagccggcgatccaaggacagccgccaaggcaaagccaagcccccataacttggagaaagttcagaacagaccatgcgagcaaagctgtgatggcggtcgaagaagtgcaagccctccgcaaggagttcgatgcccagcaagc

SEQ ID NO: 44260 - DNA, 1501 bp, Oryza sativa
tccaactaatcgttgtgttgaataaccatttcaatgcttttctggtccaatcccattcaccactacttcagactaaatcttagttaatgtggctgttgtatttgtattttaagtttttgttatcaaaatatgatgccacattcattgtatttctcatgtttgtggcagtgttcaaaagaaaagcagtttggcaactgaaaactataaaaccaattgcacagaaaagagatttgttaactccagaactaatttgtgcataatcaaatctgcaaatctaaagttggattatttcttgcgtaaatgaagatcagtgggttgctgtaattaatagtaggtacaatccctaccaaccatgcacgaagctaccatcactgttctcgtaacaatgtggcgtccttacgaatccttattaagatcacggtccctagtaccagtgaacctaaacccaaccaaagtaatattgttgtcgaatgaatgaatcttgatccatgcctacaaccaatccatagggtaaataagatggactgtaaattaatcatgtcactaaaacacaaataaagtatttagctacccctccaccataaaatatagcgatataatactggattagagacatcacaataaatataaatttaaatataccacagttcagatctgtaatattaaaatatgttttatttagttggttatatcttaggacggatatatagtagacaggttagttaaacattaactgagtggtggattgtaaacaaaaatgaaagaaacaaacgtacgtcgtcgtgggtgttacctgcatgaggagcaatggtttgccaacgacagccctggtgtcgccggcgtcgcagagcagctcgccgacgcacgggtacggcggcagcagcggctggccgaagtcctccagccgcacgtcggcgtcggcctccacgaacaccaccccttcggccgtgcagtccaccaccagccggttccccgcgccgccgccgtcggcgacctccctcagccggccggcgacggggtagtagtacaccagcgcctccgcgagcgccgccctgatggccttggccgggtcggccggtgcgccaacggcgccagctgcgccgccgtcgcatcggcggaagaagccgaccaccgtctcgtagtaccgcagcgtccgctggtcgtcgaggtcggagagctgcttcgtctcccgcggcgtcggcctcgccggccggagcagcaccggctcgctccggcgagatgtgaaggtcaccaccatggcgttggcacactttggtaatgcgaatgcagcgaggttgggcgatgctatctatgttcttcggtggttcatatgtgagcttgcttgatggtggcgcacggatacgtcggttttatatccatctgaaaattaacattggtttaattttctcctgtaagtaacacttggagaatattaaatgctttcaaccattaaccagaatttactctggcagtcgtttctagggctaattatacgattttt

SEQ ID NO: 44261 - DNA, 1501 bp, Oryza sativa
gctttcgccgcttcttggcgatcggcagacatcttgcgcaacttttgttttcttggcttaatgtccggcttgactgctaggtgatgcatgataagatccaccgggacaccccccacctcgttagggctccaggcgaagatatcgatgttctttttgagcacctctaggatactctcaacttcttcttcgcccatgtcgcccccaagtgatacgagctttgtggggtcggcatcatcaatctacacttttgttatcttgccgtgaggggtgggctttggtgtgtgcttcggccgttcatgcggttcggtctcaacactgtgcactgctctgttgattatggctagatcgcctttcgaagcggccgaaggctgaagccccttgactactatcacccctgtcgggccgggcatcttgagcttgagataattgtggtgggaaatggcttcgaacttgttcagggttgcacggccgaagatggcgttgtagttgtacgggatgtcgacgacgtcgaacagtatttgctcttcgcgtctattctcccccgagccaaaggctatcagcaaaagtgtttggccgagaacttgaactgcttctctgctgaaaccgcggagcgatgctggtgctggggtaagggcttgggtaggcaaccccatcttggcatatgcttcagcgaagataacatcggccgaactccctccgtcgaccaggattcgtcggacttcgaaaccagctatctcagctgagattaccaggggatcttgatgcgggaaaataactccttctgcgtcttccggcccaaaagaaattagctggttcagatactgcggcgccccttcacccgccgaagtgatgctgtggaccatacggatctgcatcatcttctgccgtttggacaactggcttggcgggtcagcccttgtaatcacttggattacccttcgctgtacatcttggcgttgttcggttgggggtgtttgctcctgaactgcttcgcggggtgcttcgacaattgttccctgctgcggccttaggtcttgcgcattgccacattgcctaatgtttcgacattgctccgtggtgtgcgaagagcatccgtgaaaggcgtagtagaggtcttttcggaccttcttgtgggctggctgctgatggttgctcgcttgctgggcatcgaactccttgcggagggcttgcacttcttcgaccgccatcacagctttgctcgcatggtctgttctgaactttctccaagttatgggggcttggctttgccttggcggctgtccttggatcgccggctgagactggcgaacgaagaggggaggtggttcgacaacttgaacttgtgcttgagcttgagcagcggcgatggaggctttgtcatactcagcttgtatagcttgctgtcgcttggaattctcctcgccccttgcgaacccgtcaatgatgcgaagtaggtgctcgagcgtctgaggctccttgttggtgatttttcttgtgagtt

SEQ ID NO: 44262 - DNA, 1501 bp, Oryza sativa
gacacctccctcgccacctcttgtcgaaacaagatttcggcaatactaaaaggaggtggctatcaagctggaaaagtggatgggtttagagggaaagaattttatacaggttcaggcctttttaatcaagaagtaatacgctactcttgtccggcgattgatccgccgagtgtattattgatcgtatgatctgggagaaaaatcgtgttcctagagggacccggacccctccttatataggggaaggggtccgtattacaaaatacagtccatatccctaacggaatatataattacagataaaatataatcataaccgactaggatctcaggtatttccttgacatacaagtttaaaacttaacccgagtcctcttaaagatattctatctatacatggtaccctgtacctagtcggactatacgtgccgtgtagatatagggtatccataatctccacagtagcccccctgagacctttacagtcgacgaaatagccttctcttggaacataaagtaataatccgagtgctttaatttcttctgtatagatctccgagtaccaaaatcaaagactgtgaaggtctaaaatagaaaaaaccgggtgcatcgactagatgcacctaattaggtgtagccccccgactatgtggttagttaaaaaactaaacatatagtcaagaaccgagtggttttacaaccgaatatcatatagcaaagcatatgcggcattcaacaaaacatccagtcgactgcttttagctttaatataccaaaaatgaaacatggaaaggtccgagtgataaacactctaaaggtccatgaattcacatatttgacaagaatccgaataaaaactctcaaaaagatccatgaaatgtggtataaatgtgataacataattagtgataagtctaaatagcctaggctatgacccacaccagaagaataagcatataacatgccaagtaaataactattcaaaaaccaattatttcaacaaacccgaacagcttttgcagcctaaagagacttacaaaatcaatataacacttttctgttgggtacctttttgtccgcatcgtagtaattccaaagaatcatctaactgcattaaaaaggattttaacagcatcgggctatactgttgtgagaaaaaattgccaaagcaacaatgcctaagtccctaaggatcacaactaaccacactgataatagaattgggctgaagtactgtataggctcaggcccattagcactcccgataccctggcgaaataaacgctgaagtcaaagcgtcgctttcttccccgccgagactctcgccactttccccatttcacgctacagtacaaaagcactcccgcggaactagggttctccaattcgctcaaattcaccttccaaaactccacagaaatcattcacgcacccaccgcatcaatccctcatacattctcagccatttccaaagcaaatcgcatcacctaactcgcatcca

SEQ ID NO: 44263 - DNA, 1501 bp, Oryza sativa
tttgaaattattatttattttatttgtgacttactttattatctacactttaagcacaatttttcgttttttatatttgcaaaaaaaaaaattaaataagacgtgtggtcaaacgttgtaaacaaaaacttaaaatcccttatattgtgggatagagggagtactattaagttcgatcttatccatgggcccgtggctgcgttcgtctgccgatcatgttcatggccgacgaagtagcaaaggatgcagctgatcgatcaaactgttgttaatcaatactggcatagtaaaggatacagctcttggctacgattaatagcgacgtagctcttggcaccatgatgcatgtggttgtgagttgcgacgcgatggtcacggcaaaacttaacgagtcgtggttcacgcctcgatgtgtagcgacatgtgttccctctcgtagtgtcgcaggatacatacattatatgtggatgtaaatcatataatcatgttaataatgcatggatctgtttatgttacgcacatgaagcccaggcaggacgtgatgccctcgtcgtggtgcggcgatcgagaggggaattttggatcggtgcctgttgtctccatggatggcagacaaaccggtagctgtatgcaatggttttggaattttcgtacaggtttgagtgattaactgattattatcactgtatggcctgtgaatatgtgattctctcgccgacacaaaaccgaactgaagtgatctgctcctcgcacgaaaacgccagcccagagtagacgtgcaaacacaagaggccggccctgttttttgtactgggccagatggaaataggactcgtccaagttgagcgagatgggccttggtgggttcaatctctcagttaccaggccacacggccgaaggaggagtgggctgccggcctgagcgaggccgatcacaaggccgaacaggatggccaattagcgcagctgcgtctcacacttttggtccacaaatttcacgtcaaagtttcatatgagaagttttcgaatgaaaattttcaggtaatttttttcagatgattttttttttgcagatgaaagttttacaaataaaagctttcagataattgtttcaagaaaaatatgcgttgatgaaaacgtagctacgctaaatagcagtcccctaaccccaagacttttaagacagagaattcagctgcattctctgcaccgtcgtgtgtcaacttgaccctttccacggtgtcaactaggaagctgggagtaggtgcgcccgttcgattcgcctgatggattaatgttgggttagttagttaatcggaacacgcatgcagattgttagacatgcaggttccaagcgacctgcaaagcgcggctgcgatcagaagaataatggtcacggtctcacggattagttgggtttcagtttgacctttatttgattgatcgaccaaggtggcacgtacgtctccgtactcacatctgattatttatttatttattt

SEQ ID NO: 44264 - DNA, 1501 bp, Oryza sativa
tcgaattccttttgaatttgaattttacatgcttaaccctaggtctttaggagtctcctaacctattagataatctcaatcaatctcaggacatcaagcaaggcaagttactatctaccttttgatcatttaagcctatattttacaaattatttatttatagccttctattcaatactctattttatatgcataattcaaccatagaaacccagataatttagtattgcttatcttgcttacaatctggttaaaatattttatacttagattgggacagtacgttagaattggatgatttccgggtggctagtactgtctcgatcgatatagtttttaccaggtacttatgtcgaacgaacgggtacgaccgcagtctctagaatggggacagacctagttattatgttaattagcaatgtggtacctctgtatagtggttcttatttttaagtcctcgcgtaggaggcaactatagctgcgaagggcaacttttaaccgttaccatgtacaggtaaatggtttgtgatactcgagtataaattatatggtatatttctaaaccctgatcgatatgacgtggtgtcatacgatcagttccccttaaatacctcgggaacgccagaaatcctcttgctgctgttaacattacgttcagagcatatgaggatataagttcatggaacaggtgccacaattgttaataacctaatactgggccatggctaaagctgatgattatcagcaagtcgtggactgcgggtaaagcgtacatctgctgcagtagaatatcattgaaactattcgaatagccgtgctcacggatttgagtaccgggactcatatggtaccctggttagaaacctaaagtatatatttttacaaactcttgctttaatatttccagattgtctattattgctttctgcaaagaactccactccatgccaacgcataacatatttccatggtaacttgctgagtattgtgaatactcaccctgctcttattaaccctttttcagatttgggtcaagaggacccctatgattattattatgatgactttgataacttagaaaatccctagaggttataccttcctagtcagaatgtactagaacagccgctgtgtattattagcacctatgtttaattaggtgagtacctacccttgtaaaaaccctagtattgtaaactttaacgtatgcaatgaagaaccagttgtattacatgtatcaatatttactgatccagggattgatacattaatctcagtcggatccaagttattagttttgggacccgacaggactggtatcagagaatatgtttggactataggacaaaccctaaggattactaaccaatttaagtttgagtttacttcgaacttaatgctttaaggggggtagatttgacttgcgagcacacaatatatattccatttatgtatttcaggttaatggcataaaggcatgagcgagaacatattgagatgg

SEQ ID NO: 44265 - DNA, 1501 bp, Oryza sativa
ataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcaaggcgtgcgtcagatcgcctgtcgccacctaacccacgatctgaccggtctgtgactggtcacagaccggataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggagatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaatgagggggcgaaatagtgggcgcgagaagcgaggagccgggcacagcgttggcaaaagtataaaggcactgaggaagggatctgtttccttcctttcgccattattccccttgtcttcgccgcttgcgccctaactccttctttcctgtgccctaccttcgccacacgcgctcgctcttaattttctcttcctccggcgcca

SEQ ID NO: 44266 - DNA, 1501 bp, Oryza sativa
aggtgggggggacctcctagggttttgggatgtggaggggacagctaggccttgggctggccaaaagctagcccagctagcatatacctattgtttttcttctaatttcaaacaccaaaaccttacggacttccaatatatcctctacagtattctattttttctagggcattacattctcccctcctttaaggaattcgtccccgaattctaccttcaaaacaaaacagtccaaagagatagacaccttaagcatcacacacacttacctctaggtgatgaaagggaaaaaaaatcccatcaaggaaaaaaaacacttgctacttatgccaatgattcacatataaagaaatacattagagaaattctttagaaagagacacatttagaaaccgaagttatgccttaggcacaatcaacttcgaggtcctgctctgtcccatttggttgatgctcgatcccaaactctagttctcctaaacttcaataaggttgtatgaagctctagctcccactcccttcgacaactaattctattttaggaaggtcaaacttttctcgtacccacacccataaccatcaaagccccacaaaacactccactttctattacaattgaacttcttgggtcccttgtcaaaactatttttcttactaccaaaagaacattgctaggccatccaacctccttcccacttcccaaaagaggcaaagaccagagaaaactatatggctcttctaaaataagacatagccaaacatggggcattatccctttgtacactcatgcatgcatgtactgctggaataaacacctattgtgacaccgaaactacacgaaaatatttcgtttggctgatgcaacaaaacctaaggcaaaacatgctcaaacacacaacatattgcaacatcacaagctaacattttactcaaaggtgaacattcatatgagaaacaccattagccacctaggtagaataaccgtgacgttttttctaccataggattcactcaaaggactaaaccaataggctcgacaaccaatacacaaacaatcacacacacaaacaagacaccatgggccacaacttgaggtctgcataatcaacaaacacaatggagagctagatcgagaaaaatactatttttaaaacttgatggcatgctagagaggacaactagccaagcaatcacaagaaaccctactatgaacccaccgactacgtcgatttaacacaacttcaagagcgtatcaaacacttaaccaggataacaaataaccaatgtagataaaaacatgcctttgggccacacaaacattccacatgttcacaaaagtaacagagcgtctcaacatccaaggaaagctttcagcaaccaaaaacaatgtggaaaaagcaacaatccaacttagacactaggtcccaaagcaacatgccaaaaatgtccccaacaacaaagatgcatccagccatggggacctcacaagattctacatagg

SEQ ID NO: 44267 - DNA, 1501 bp, Oryza sativa
aagaaaaaaaaaaggctaccaaagaggaagctggatgcatggaaacggcattactttcggtagacaacaacagtagtatacattattcgacacggctaagaaatttctccgtgttttttcaggagccacgtgagaggatcggtcgggagcgtactgatgacatatatacatgcgacgagctgatgtgacgcctgatcgatcaagacggcagcacgaatccgttgtctcatctcgtctagctagccccttgtgcttgaggtttcttagaaggcaaaatttaaacagtgcatacgcactatttgatctcaacagtgcatgcatactttgctaggtgagaaagtgttacttattatccataaggatggcaagctaaatatctacttagctaggtcatgcatgtcattttttccatgcggttaaaacaattttcgcatgcgagtggtgatccgcacgcatgcacccaggtctttgcgaaaattagatttttgcatgcgggtagagcaaccgcgtgcacgcgaaaatccaattttcccatgtaggtggttaagtcattcgcacgcaaaaaatggaaacttatcaaaagaaaaatcggaaattcaaaaccatagcccagaaccctagcccaccgctaggaaggaggagaggagagaggagtggagtgggagagaggagagggatttgggaggggaggagtagccgagtgggggagaggagtggtggagaggaggggaagagagagaaaggaggggaggaataaaaagaatgtgaagagaaaggggtattttcgcatgtgagccacttaagaggccgcgtgcgaaaataggcctgccaataaaaattgatttttgtatgtggatttcttaagaagccgtatgtaaaaatgtaggtctatttttacagacgcatcgagttactatccgcctgcaaattataggggttcttgtacagaaaaatcgtttgtataatagtgttaaattacttatctgatttataatccgattacactgttatactcgtttcattcaaatctttacaacaagatcttaaattattacgttctaacaaaaaaatatatattgtaaattactttatcatatatctaatttactttagatttgcttaaattacttcctaggcatttatggaagtaacttcaataaatcctaaaagtaatttcgataaatgagaagtgattaataggacaattagtactctattgtgacaactattttgggacaaataagaatcctagagatataattataacttaatacaaaataagttacttaggacgatgaatgcgacacattgttgccacgcatggagaaggagatcctcctgtcgtcccatcactcagcggacaccatgtgagctgcatattcccttcaagaacttatcaataaaggtaagctcgtagtttatagattttagacttgtccattccgcaagttgctgcttatatatgttgattactaatagataacctctcaccacgtgaagg

SEQ ID NO: 44268 - DNA, 1501 bp, Oryza sativa
gtagaatagttattttaagggaggggtgtataatagagctactatatatatatatataatgtgggtaatgctagaaagtcttataatatgaaacgggggaagtatatactttttcaattatccaaaggttataaataattgagttatatgatttttataaagttttcaggagaagggatgcaatttgcacccttgacaaatgattcaaaagctacaaataattgagatgatgtgacttagagaaatagcactccttacacttaatggggaatacatatagacatataatatgccattacttaagagttggtggtaccttgtaaggctaaataagtatatcattgtgtgtgtggcttagtcttttgctacatttttgcttgtaacttatgtttgacaaatacaattttcaagtcaagaatttcatatatatcttttgaaatccattgcaaggcacgagtactttgctagtcgtaagaaaagtagagaaggacaaattaagcctgctatacattctacaacatatatgcaataagacgttccatacatacagactctctgtaatagtcaatgaattattgggagttgttaatttgaaatttggaagatgtaattaactgttgccacgaaagtgataacgcgtatgtaaccctttcggaagtactactcatatagtagtacatgtgtactgtgatcggtggtagtaaaatgcaatcatgcatccatagaagtccccacgcataggtctgtactggaatgaaatgtatggaggcattcttgttaacttttctttgttgtacgcagtacaattttaaggcctaaccacaccagtgccgtgctagatgcacccataatttcaggcctccgtactaaacaaaaacctggtctcgtatacttacaaatactactctctccagtaaagaatatacaaagtaatagttcttttcaaacttctaaaatttttaactcactggtacacaacccgaccagtctgtgtgatgggagcgtgtagcccatcacgtaagcctcacctttgaccggccgtaataatccccgacacataagcactcatagagtactacaaacaccacataaggaccggcttacaaataaaccggcacctataatcatttaaccaactccgcacgatgaaaatatacagaaccggcacatttaaatattataggtgccgattctagaggaaaaccggtactaataatataggtaccggttttttaaaagaacatgcacatatacttatattagagatgttcgtcgtaaagaaaagaaccggtaccaatactgtaggtaccagatttttaaaagaaccgacctctaaaatatgaacttgggtgtcggttctttgaaaaaaccaacacctattaacaaaactgtccggacgtcagattgattgaccgagcgcactactctttatcttttcgattgccaagcacatgcactactccgcctcctccttttttccctcctccctctctccccacca

SEQ ID NO: 44269 - DNA, 1501 bp, Oryza sativa
cctcccgccgctcttcctgccgccgggagaggagaaagagaggacgaagagaagagaagaggaggtgtgcggtggagaagagagaggaagagaagagaccgagagagagaaagacgcgtgagaaagacgcggtctcccttatccgctcctcaggcggctcggctcacagctcgatctgaaaggtgctgtttttttaaaaaaaaaccgacacctttaatttattataagtgtcggtttttactgaaatccaacacctataatataggtgctgttttttttacagaaccgacacttataattgcttaaaggtgtcggtttttcgtgttttcggaccgcggaggtgggaaaaggcttataggtgccggttttagcacttccggtacctatagtaccgatacctatttgaatgttttgtagtagtgggcgaagtggtgaagttggatgagctcgtgcagactgatgaggaacttgtcaaattggccactaaccctcttgctgcacaacatgccctcttgctgcgcgatacacccttgtctcctcacttaatttcctatctaattggcccgccgttggcgcgttagctattttgaaaccagcgtaaaaggtttttttatatcagtatcataattttaaaaccctaattaaaacacagtagaaacgcatagccgtcatgccgataatgtcacgccccgaactagtcccgaccggaactagcccgtgacgctccaaattaacctgttaatcgataccagtcccaggaaacagtgctggtatcacagggagacagagtatcacagcaacataggtctcttttttatagagtagaagtacagtcatgttgggctgcggacagatcccgagatcacaactgcattacaaaaggaaagcggaagccaggacttggaccaatcgtcacaggcgcgacttgggaactaggccgaaaccctaaaactcatcgtagccgacttgctcctggaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacaacacggaggagacagtgcgtctcgtccggtcggagtatgtgcaatgtatcagtctttagatcttgaaacagggttggcacccggccaatagcttttcaaacggccacccgggccaacaacttttcaaacggccacccgggcctagctgatcccatcagctgcagatttttcaaacatcgaaccccttttcacaacagcaatttcacaagcagtagtcagacaaaactacgctaggaatcacctcacatccgcccatgaccgtgggcacggctgttcgaacagtttgttaacctctgcagagggggtacactttacccaca

SEQ ID NO: 44270 - DNA, 1501 bp, Oryza sativa
ttttataacggggcaacatatcctatgcacacaggccctcacgtgtacacacgtacacaccaactaaaaaatgtcaccaaaaaatctagaaaaaaccatacacatactttcaattgtattacacctagggttaaaatcttaacgtcaaattcattatattttagccgtaacaaaaaaaaaacaaaaaatccgacagttttaaggttgcaattttgtcagaattttatcttttttgttattctctatgtagaatgaatttgaagatgtgactttgcgcgtagatgtaatactattgaaagtacatatatgaattttcctagaattttttgtgataatttttagttgatgtacacggtgtgtacacgcgagggcctgtgtgcataggatacgctcccgtataacggagtatacctcaagttttcctattagttgttactgtagacaagaagttgttaagagcaagtttgaaacacaaaataaatatatatttgcttagaataggagtagttttttaaataattgaatatcacatgcataaaacttttgtaaagctctccctctatttgccaaagcgcggcactctggcatatatattctgcagcaaattaaccaagggcggaccaaaggcctggatgacctgggcggctcattagcaggtcactctattatgatgacatgtattttctacaatgatgtttaacttctacgcgtgtgtttgcccaaactctagagaattgttgggttcttgctgcaatagcgagaacaatatgtatctctttcttgatcgaaatatgccaatatttccccttattcgttagcattggcgaagctaggatctagacatgagggcgggacgagctaacttatgaggtgttagttaaaaaaatatatcaagacaatccatggagattttaggactttaattgcatattagagtaattctcttctcgcgcaacttccatgatgttggcatgattttattagaataaggtagcaatcttccgtcgattttgaagaatatggatgagctagtaccaactgaaacaacaatcttcccccccccctcttcatcgtattctatttaatttggcaggcaaaactataatttccatggtttttctttcgcacgttaatgtataaattttcgtaaaaaatcataactgtatgtgtataggacctaaagtcatcaagtaatagcccatcttaatcttatcatcactaacgcagcatgataggaatcggaagggatctgcattttgggttcgccgggggggggggggggggaggttcatcgttggaggggccaggcctccctcttgccctaggtttcgcccctatttgtttgactaacttccgtttatatattcctatcctagctaagagttagttggcaagacgaccgaaaggggggagaggatgaaatatatatccaaaaaaatgatggagaggagattgtattaattcatcttgaaaacatgcatatatatatatatatatatat

SEQ ID NO: 44271 - DNA, 170 bp, Oryza sativa
cgcaccgcccgcaggacggccggaatcgtgcatgccccgaagaagaaagagaacggggaagaaaaaaaaaatgaaacgaaaaagaagggagagaaggccgtcgatggcaacgccggctgccgtgttgccgccgaccgtgccgacgcccggcctctgcgccaccgaataga

SEQ ID NO: 44272 - DNA, 1501 bp, Oryza sativa
agaagttgatgcagcagtattaggggcagagcatgagtaaggatcttcatcatctccttgatcatcagcatacatagaaatatgttcttgcatctcaaacactcgttcttctggatcctcctcttcttctggagtttcaatccaaattgggggaacatttaggtcattaatatgaaacatccgggttccccttgctacttcaagctcctgacttggctcactgatgtccatagctgagggcgtttcttcagcttcatcctcggaatggataggatataatggtggtggcgatggtggtaaaccttgtagaactccctcaccatcattttgaggatttggcccttatggctcatccccacttcatcatcatcatcatcactatctatcccagggacttggtgaagacagaatgacgcgcccacaacacaaatattaagtatagagttttgtttatcatcatataattcttgtagcacatgatatatgtgcttaagaacagcttctcatcgctcagcttcttccaaacgtttggactacatatccatgtgttctaggacttcctcatacatgtcatcagcagctttcatccatatagacatggttgccttcactggttgttgatgacgatctatattctggagggtgcaatagtcttcgcctggttcttgcataggatgaaataaatagcgagaatgcagaaacttgtcttgataaatatggttgaggcgtaggaaagcctccctacatgcatcatataaagcagcttatagtgtatctcgcctatgacgcgtccggaaatagtatatatcatcttctcctttaggtgggttgatctttatggtcatatcatattcccaataatctcccttctgataagcatgggaatagaattctgtttattcacttatctttagcttcgtcattaacctgattagctgatcagtgcaatcattattatggatagaaattgccatctcaatatgttctcgctcatgcctttatgccattaacctgaaatacataaatggaatatatattgtgtgctcgcaagtcaaatctaccccccttaaagcattaagttcgaagtaaactcaaacttaaattggttagtaatccttagggtttgtcctatagtccaaacatattctctgataccagtcctgtcgggtcccaaaactaataacttggatccgactgagattaatgtatcaatccctggatcagtaaatattgatacatgtaatacaactggttcttcattgcatacgttaaagtttacaatactagggtttttacaagggtaggtactcacctaattaaacataggtgctaataatacacagcggctgttctagtacattctgactaggaaggtataacctctagggattttctaagttatcaaagtcatcataataataatcataggggtcctcttgacccaaatctgaaaaagggttaataagagcagggtgagtattcacaatactcagcaagttac

SEQ ID NO: 44273 - DNA, 1501 bp, Oryza sativa
tctaacagcttctagcacaaaatggcaaaagtctattaaactagggatacaagttaagtgcacaactagaataaaaagtaaaagattgtttcttgtgtatggtactgtgttccttcaattgaaccacccatacccggtgtaaaagggtgatctttaaataaacataaagtcggatgaattagcactcaaaaaatctctgattcaaacaagaaaatatctcacaacttcaaagaaattagagagaagatagcatgtttcatacttgaagaaatcatatcttccaaaggaagctttagattaatgtcattgctcgtctccatttatgtctgtcggtgacatgggatcaggagtatcatgactagaggtttgaggcagacacaatcgcacacgtggcctggtacccctgagggatgtcgggcccgagggtgatgcgttcgccctcctcttagtccccccgagggggtcgggccgcaccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgtgggttaggtggcgacaggcgatctgacgcacgccttgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaaggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatgtcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaa

SEQ ID NO: 44274 - DNA, 1501 bp, Oryza sativa
actgcatgtgccccctgagagtcgtcaccctgattctcttgagccgagccatctaaaactcttttcccttctccctccttaaaggtactggtctcaggctcatcgggaaccacctttaccttgtacttttaaacaaattttcccttgcgagtctgtgtgaatgatttgaagaactgttctcgtgcttgttgcatcattgcttcgaagtccttcttctggtcaggtgtgagcttttccggatcaatagccacaatattcccttcattgacttcgctcaatcctggtctttggattttctctttaacagtacccgggctagccgaggatggcgaaggtggcagcttctcggccatgaggaagattgatttctgacttctaattcgtcccaccgggcgtgccaaaagcgtgttgacagaaaacacgaggcctgggagatctgcttaactccagtgcaggtccaaaactcgcgttcggatgtatgagcgtgctagttgatttgatcctgcaatcaacaagaaatagaacaaagaaaccgcaattaatcctataaatgatagccgatcggctaggtgccgatgacatatcatttatttcaagccgatgtcatgcgtacatcgatcggcaaatatcaataagcaaatcagaactaaatctactcgatcggctgtagatattaatgatatataatccttatatcgatatatacttgaatcaagtggttgggatagatcggtcgccttgccgagacagtataaatcacttagatcgaaatatatattaatagtgggattatatacatttatagcatagccgatcaaatggatctagcatgtattggctaatactccgataccactctatattaagatattaaagcaagtagaatataccaaacagaagcctaatgtacttagatgtgacaagatcttaacataaagggcagatttaacatatagattaagcatatggaataaaagtagttaaatcagataagatcggctgaaactccgatactaccctaatcggcgaccagaaagcaggctagagattgcaattctaagcatgacttaatagatcaaactcaattgatgcagcattaagtatgaaaagaaaaacaatatctagacaatcaagccgctggaagtttcatagagtggtagatatatcacataatctaagttaacgtcattgtctaacctaatcggctgccttccattaacagatgttagccgattataggttagataaagatattatcgaagattatgtgagatatatgataactcgacgaattatatagacaagattagagtatcataaagatggaagcactaatcctgagaacataagtcgtcatgacaagttttacctcttgttgaagatcgaaaccgatgcagctcaacccgagagtacgaactcgtcgaaataaaagtaaagcaaaaagggtggcgatacgccgagattgtattggatgtcgtcccttttttacatagggctcggg

SEQ ID NO: 44275 - DNA, 1501 bp, Oryza sativa
agctgcaccacagcgctgtcacaaatagacttcaataccagcaggatgaatgagctacttgtacttccggtcgcaaaataaggtcaattgggtctgcatctaagtgctcgattaatcactgcagtgactcgttcctccaggttgcaacatcgattccttccagtgtgctcgtatcagttgaaccaccaaattattattatgaatcgaagccatcaaacctggatacgcaaaccagggagaggagtgcgtaccggcagtggcttaggcctggagtagtctacatcagggtagtcaatctccgccgtagcaacaagatcccacccagcgcatcagaggaggccggcgagtgagcgggtgaagccggtggagcgatgcggagcgcgtgccagaggacggagtcgaagacgccatcggaaaggagtgggccgagggcgtcgtcgccgcccacacaaggttcgacgcgtgggcgcgatctagcctcgccccgagccgcgtgttgccgtcgtcgagcgccgtgtggtccctcaacagggacgccgccgcggcgtccgtggcgtcaagcgcagcctagaggcggttcaccacggcatcgaacgatcgtagcagcgcctgggcgaaggaggacgcgcaaaggagtttgtggggaggagggcgaaggacggctggcggcgtcgctgaggaggaggaggaggcggcttcggtgcggctagggtttttggaacgcagagcgcaatggacggcggaaaacgcccgacgggtctaatgaacgagcgagcagtgaaacggcgaacctgctagcttgctgtcccttggttgggccccaccctaacagcccatttagagatacccaagcccgcagcagcttcatcacaagcgccggaggcgcggccgcgcgggaagaggcgctccccgagcgcgggaaacggcaggaaccgggcccatagccgcaccagccttgcgcgtgcggagggagcgggatgacgtggatatcagcggaagcgagcacgtcgccccgaaaaggtccggagcgctgtggggaggcgaactcaccctcatctttaatttacaccgatttggtcaacccatacccgtaaagggcaatataattaacgtcgccacagatgatagctatcagtgataggctagaaagggacaccgtcatggagagtcatccttgacggattggaaagaagcattgttgcagatggcatccgtgatggctattcataaaggcccattagagatgtcatctcaaatggttattactaaaagctcgtcatagatgactttttattttttttaaaaaagtaacatgttagtttttttggttccttttggttccttgaggatagaccactgttgacttatttttcttttctaacttagagatgtcacatatttaataaggtacgccgaagatgagatgactaagatgaacaaaatgttttattgaaactccagattacatggcaatagtagaaactgatgatggcatacaatg

SEQ ID NO: 44276 - DNA, 1501 bp, Oryza sativa
ggattgttgctttttccacattgtttttggttgctgaaagctttccttggatgttgagacgctctgttacttttgtgaacatgtggaatgtttgtgtggcccaaaggcatgtttttatctacattggttatttgttatcctggttaagtgtttgatacgctcttgaagttgtgttaaatcgacgtagtcggtgggttcatagtagggtttcttgtgattgcttggctagttgtcctctctagcatgccatcaagttttaaaaatagtatttttctcgatctagctctccattgtgtttgttgattatgcagacctcaagttgtggcccatggtgtcttgtttgtgtgtgtgattgtttgtgtattggttgtcgagcctattggtttagtcctttgagtgaatcctatggtagaaaaaacgtcacggttattctacctaggtggctaatggtgtttctcatatgaatgttcacctttgagtaaaatgttagcttgtgatgttgcaatatgttgtgtgtttgagcatgttttgccttaggttttgttgcatcagccaaacgaaatattttcgtgtagtttcggtgtcacaataggtgtttattccagcagtacatgcatgcatgagtgtacaaagggataatgccccatgtttggctatgtcttattttagaagagccatatagttttctctggtctttgcctcttttgggaagtgggaaggaggttggatggcctagcaatgttcttttggtagtaagaaaaatagttttgacaagggacccaagaagttcaattgtaatagaaagtggagtgttttgtggggctttgatggttatgggtgtgggtacgagaaaagtttgaccttcctaaaatagaattagttgtcgaagggagtgggagctagagcttcatacaaccttattgaagtttaggagaactagagtttgggatcgagcatcaaccaaatgggacagagcaggacctcgaagttgattgtgcctaaggcataacttcggtttctaaatgtgtctctttctaaagaatttctctaatgtatttctttatatgtgaatcattggcataagtagcaagtgttttttttccttgatgggattttttttccctttcatcacctagaggtaagtgtgtgtgatgcttaaggtgtctatctctttggactgttttgttttgaaggtagaattcggggacgaattccttaaaggaggggagaatgtaatgccctagaaaaaatagaatactgtagaggatatattggaagtccgtaaggttttggtgtttgaaattagaagaaaaacaataggtatatgctagctgggctagcttttggccagcccaaggcctagctgtcccctccacatcccaaaaccctaggaggtcccccccacctccccctagccgtcatttggtaccctgggggcgcccacctccccctctagtcgacctcccccatgcctgccctactgcagacctgggaagaaggg

SEQ ID NO: 44277 - DNA, 1501 bp, Oryza sativa
cccaaccgatttaaaatcccagacttctccaaattttcgggacaagatggtgtgtcaacttatgaacacattagccgatttttagctcagtgcggcgaagcatcggctgtggacgctctcagagttagattattccggttgtccttgtctgggtcggcttttacatggttttcttctttgccgtatgggttagtcaatagttgggccgacttggagaagcagtttcatagctatttctatagtggagttcatgagatgaagttatctgacttgacagcaatcaaacaaaggcatgatgaacctgtgcatgagtatattcagagattcagggagatgaggaacaagtgctttagcttaagtttgactgatgcccagttagccgatttggcttttcaaggcatgattcctccgattagggagaaattctgatctgaagattttgatagcctgtcgcatctcgtacagaagataacattgcatgaacagaggtttgcagaggccaggagaagctctaagagggttaatcatgtctgcccttacatgtatggatcggatgatgacgatgatgactccgaaatagctgcagccgaatgggtaaggagtaaaaaggttataccttgtcagtgggaaaagaattctggaaaagaggagagatatgattttgatattaccaaagctgacaagatttttgatatgctactccgggagaagcaaattcaactccccgctggtcatgtaattccatcggctaaggaactaggcaaaaggaggtattgcaaatggcataattctggatctcattctactaatgattgcaaggtctttagacagcagattcaagtagccattgaaggagggaagattaagtttgatgattccaaaaagccgatgaaggtcgatggtaatcctttccttgttaacatggtgcataccgttggtcggacagccgatgtgggacgagcgagaggtttttgcgtgaattcggctagaattataaataagtatcagaggaaatacgacaaacaacaagagaggcattatgaagaagataatgatggtttcgatccttattggaattgtgagttctttcggttctactggaacgaaggtatgaggctaccatctattgaagactgtcctgagtgcagtgatattacagagagttcaagccgatcgtacaatagaggcaatcggctgaagcaagctagagttcccgttcatcaaaggttgggcccggcaaatcaaaatgattacttggaggaagacgagaacgcgaagactcagtggtgtccttctgatatttttacaaagaatcagaaaagaagggttcaaaggttgaggaatagggagcgctttcaggaggtcgagcaagaaattggtcatcggctgaggaaagcaaagccaaggaaggagtggcgtgttaagaatcaagttcttggagccgatgatattgcagccgatgaagcaaagaggttggcaaaagggaaaagtattgtaacgg

SEQ ID NO: 44278 - DNA, 1501 bp, Oryza sativa
aaagatctctctgtgctaagtgagctggtatgttccattttgtcttttgcgtaaagataattaatcaaatatccagatgatagttataataatgatacttcgatcaatatcacggtgatacatagctcgagcgctgtctggactgggctaatttcatgttgtattaagctatctatcaactcaatacagatattttgttggttgggtatgaccgtataactttcgtcctcattgtgctctgcaatccatgatatcataagctgaattatgacaccacacactaataagttctgagtatgaaatgtatgtttcaagcacttctgcttccctgcattagcccaacaaagagcattacatgcacaaatattaggagcaatgttgcttgcagagtaagaactacaaattttaatatccggattaatttggcatgataaaacttcaactgataggatccttagctctctaaaaccctacatgactcatatgctctgatcataccagaacaatcaaaattttacctgtatctgcaggttctgtcaatatcaaaacaggaagagcgcgagcaagttcttgatccggttgtgctgagcacctcttcgcaagattctttgtcgatggtgatttccattactgtcaaatgtttatcagttgaatcttcagccaggccttcgatcgaagaggttctctggaatctgcagtacgctgcacaagtccaggcaatatctgatggggaccagagatcagaagtttcctcgcagacctgttaggctaactgaacataaaacaccttggaggttattgtccatatctgggaaaagacggcgccgcacgtgcaagctaatttgatcttggtgtgcagaagagaatgaccaaactgactgatctcttcctgggagtaatcctgcatttgctgctacttcaacagcatttctgacacatcaacaagttaattaacatgtcaaatgctgtatgctaaacacagatatggtcacgttacgtcctgtaaagagttttttttttctcgattctagcttcccattgctgtgaaagcatccctatgagcagttcttgatttccaaacttccaatcgttgtattagggcattctcatataattaagtagtaggacgagtgatgtgatagcaaaattgatgagttgatagagaagggtatcccatgttagtgtagtaatgagaagatgtaattcatttgccacatgactcgtgctagtgcagaccaaagtgaatatgctccaaaactaaatttgggtaataaaatatggcctaaattctaatttactttaggattcaatgatgcaataatattaattccatttgttataaaactggtccgaaatcactatcgaaaaccaaacacgaaagaaacgtcataggtaattcaaacacgatgatcgcattgaagtacgatatttgttaacgagatttaaccgaagcctacatccctggagtgcttcttcccatccagcatttacagcgtattag

SEQ ID NO: 44279 - DNA, 1501 bp, Oryza sativa
cccgagccacgatggtcaccccagcgtcgttgcactgtgccgtaccacgggcaccgccccacaccgtcgaaaacctcgccggagctccatctccctcgctcgccggtgagctccgccaccctcatcgccttcggccatccttcctcgctgttccggccaccccgcgcttccctaacccctttaaaccccatccccaggtcgcgaccgagctcgtacaccccttcctgagcgtcgctcgtcactggagctccgccgcctccctccgcctcgagcttcgccggccgcctccctacagtgtcgttccccgatgagcgctcccctccctctccctctttctccgcttcgtcggtcgcatcctgggccagctcgcgacgcgccgctgccgctagtggccgtccggtcgggtcgctgccgccgcgcgccgcgtcctcgccgggcagccagttgccgccacccctgtcgcgcggccgatctgggccgtcggatcggccccggcctccatctgagccgcccgtgtgtccgcataggtggccagcacgtcggtgccccatcggcgccacgagtgcgccacgtggtgcactagcccgtgcctccgtggactcggtccacggtaggccaaggctccttgagtcaccgacaggtggggcctgcttgtcggctccacctaatcccctcggttgacaccataaatagctttaattgcgcaatatttcgagtaataattatagaaattcatttaaatggctcaaaacttctaaaattcatagctaattcataagaactccaaattgggccattcaacttgcaaaattcatctaaacttgagctctacatgtttgtttacttttcatatactgtttacttggtttttattagagtttttccttgttttgcgtgccagcgcgtagattccgctgtttcggaagctcgcgattacgaggaaagagttcagaggattcttttgaagaagcagggcaagtcacacattccccttgagcatgttgatcctaatttataaatgttttatcgtttgcaaataaaattgcatgtcatgctaattacatgggatcagggttttatctacttcttcgcttgtgccatattacttgatgttcgtcctttgtcaaacttaggtgataattcgactattttgtgttacttatgttgacctagctagaattatatgcttatccatacttaattaccactagttcacataatgggataattacatcattagacacctagtatatatcttgacgagctgcgtgctcgagacatctagccatgtttcattggttgtaattatccaactaaaacatgacttaatggtggtttgtgggtgcatggtttttctagttgcgcccatagcaaattaaggactggttcgctggatgcactggaagacttaccgcgcgtaccacaagcaggaatgggtaattgcttgacttgtagtatagctttcctttggctgacgtacccaggctagggtgggtgtgat

SEQ ID NO: 44280 - DNA, 1501 bp, Oryza sativa
aataattcaattccagataaaagtctaccaaacgattaacaatgagtcaagaaactaagaaattattatagttgccttggatagctaatcaatcaacaggaggaggtatcaagtatggaataacgataaatcgaaactacgatgctaaccttgctgaactccacgaactgtggccgtaaggaagcgcgaattcggacggtgccttacattgggctttcgcagatatgcgtgaacaccttccctgtcagcctccgcctgcaacctcctcgcctcctcgagaagtaaagaagcaagacgattctccgtctccagatccatcgtctcaggggcggatccaacttgggacatttgggggttcagatgaacccccaatactgttactcttgtatcaaaaggttgaggctctctctgaaattaagagatgagcttcttccagatctacaagagaaagctagggttaacgaacgcacacaaagcgaattccagacaaaagtaggggtgggagagagagagagatgaatccatgaatcagaaggaggatgtggatggatgctgctcacctgcaggatcccctcccctccgctgctttgctcgagcagatggggatcggcgcctctccctccccctgttcttgtcgcaaggagcggaggagacgggggatttctcttctcctttttacgccgaaggggggagagactcgactacggattcggattcggagtcagagggagggaaatagcggggagatggagcgcacgatctgcatcggacggcaaccagcgaggttagcaaaaacgagcgggctcacctggcccacggcgacaaaatccggcccatagaagcactgtctccctcggcgcaggttcggtacttcggttggagggaggctgcccatggtaatcgtgcccgtttgcccatttacccttagataaaagccctattatcacggccgctatgtttgcataaaggagttctttgctgtattggagaggaggggggagggaggggtgaaataggagaggcgaaggaggaagacgacgactcagagagagaacgggaatggataagatcgaatcaaggggtgaaaataggacgggtaagatcgaatcaaggggtgaaaacgggacatgtatttcccgtctgtccatattaatctgtaataatttcagggtaaaataatctacccatatgtttacataggtatcggagccgaatccaggtatttctttttggcggatacaaaatcgtattgaaaaaatgatatcttgaatcatcattttatatactatttaaatttaaattatcataaatcacatcaacttactttagtttatgttgtctagctatgttacgcattattttttacttatattattataatactaaactcctacaataacacgtagggtttcacctagtttctaaaataaaagcatttctacggtgatatttttagattgcggtgcttgtaaattactatcttatttttaaaatataaaaa

SEQ ID NO: 44281 - DNA, 1501 bp, Oryza sativa
cgctgcccggctcctcgtttctcgcgcccactatcttgccccctcgtttctcgcgcccacgcttccactaatcccattcgcccgtttgcggtgcatgaggtggacatgcggctgggcagtcgagatggaacatctcgtgcgcgcgttaattacgctcgccaaccaaagcgccatcaccatatctccaggaaaaatgaaccggattgtcccgatttttagaccggccccaccatgtcaccaggccttaggaagtggcgtcacacccgaccgcttccctcgaggagggcgatcgccctggcataacgccgggggctactgtcggtgacatgggaccgggagtatcatgacttagagacttgaggcagacacgatcacccacgtggcctaaccccctcgggggggtcgggcccgagggtgatacgaccgcccttctctttgtctccccgaggggttggaccgctcccgtctcggccccgagggccgaggcgccccgaccccttgtgggttttgcgccgcgtatatggggtaggtgagcatagcggggctcacctaaccacatttattgcgatttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggttccggtcagatatatgccaggcttcatcctaaccattacaagcaagatattgaatgaagaagggcgaacatgcagatttatagactgacgcgtggtggacaagaatgaccgatttgtgaccggtctgacactggtcatgtcgtcagcagacagccattttcccacgtcgcgcctgcttccggcggaagtggaggtaggtatgggctgtcccatcagaaggtcattcggacgacaaccatacaagtctccgtctgtttatgaaaagataggataagtccccacaaaaaagagagagatggtgcatgtggtatccccttgaggtataaaaggaggaccttgcccacttagaagggggggattttcggatccagaaagatcagagagggagaaagtaagagctctctggttctccagctcttttgtagcttcttcatacacagatccacctaaacacagaagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgtgcggtctcccggtgaggagccccacgctccgtcatctggcgcgccaggtagggggctttgcgtgtgtttttctaagctctcgcattctttcgtgtgcgccaagcttttcctgttcagcccaa

SEQ ID NO: 44282 - DNA, 1501 bp, Oryza sativa
ttcaaattttgtctgataagaataagtataagcgaaaagatgagaccctttgtccgatcgagttgagattcgtgcaggtcccttttgggcccaatctttcacggcccattaagcaagtaggcagcccggccctggaaatgcactgatgaattcgttttgtttaatttggacgctaatcccttacgcccactgacaattcccgcgcgcgccatgcacgacgccctctccacgtagcttcgcttcccggcaaattcaaaaaaacaaaaaaagcaactgttcgtcttcctccccacgcttccatttctctccctttttccaaccatctaaaatctcaccaccccccccccccccaacaacccaaaccttgcactgctcatcgatttctcttcctgacggcgacaatggcgtcgaagaacagcaagctctcggtgtcgtcggtggcggtggcgctggtggcgctgatggtggtggtggtcggcgccgtcgtcgcggcggctgcgggcggcgaggagtactacggcggcgtcgcgcgcgcggcggatgggtgcgagccggggcagggcgtggtgcccaaggacccgctgccggggtgccgggcgtacctgctgcggcggtgcggcggcggcgacccgccgggggtgcgggcgcggtgctgccaccagctgagggaggtggcggcgcgctgccgctgcgacgcgctgcgcgccatggtggaggtgctcgtcgaggaggaggaggcgccgctggcgtgcaagaagggggccatggccgccatcgccgaggggctccccgggcgcgacgagtgcgacctcgacacgcgcgccgacgacggcggatcgcgccgttgccacttggtgattaattgatatctgatgctgtttaatgataaataataatcgccattgttatattctagattatttatttatcaaacgaataaaatgattatggtcgcgtgctatgcttgttcttgcaacggtgtgtaattatcatgtgatgggcaataaagagcaggtgatgagtagtatttcatatttttaccttgtttgaacaaattgaaacaacgaaccgcgcacaattttcttttctttatttttgaaagatcagcacaattttcttttcaagtgtaaatttgatgataagtcagcacatactacgtacatacagtgatgaatcaaaagaaaatcgattcgctttggtattgtaacaaagtaataacttgttaattatacctttctagaagaaaaataaactcattggtcatgcttaaaccatgatattaccttctaggtatacatatactaatttaaatgaaacaactaggtgtgatgaatggtcaatccgcatccatcactcacaccatcaactccctgcacactgttgtgaagggaaaaaatggagtttgtgcgtgggggccaaaggacccgcctgttgtgccgagaatgtattaatgacaatgtttccttaattctgatctaacgcatggatattatacgctagt

SEQ ID NO: 44283 - DNA, 1501 bp, Oryza sativa
ttcttgcatggaagaatgaaaatgaaaagagtgtggtccatataaaacgaagggtttttttttttcgaaatgatgcctagattagctttgaaccacaataaatattacatgcaaaaccataagctactcactcatgataaaaattgtgtccgttctggaatcactttagtatttgtagctacatataaaaccaccattgatgtagcgcttacctgtacaccctctcatacaatttgagactaactaaaattttctgcaacacaaagaaaaacaaaatggcaccaaacaaggtagtgtaatttcaggggttaacgaatatggtgtgatttccgggtttttctgaccgaaattatttgaatttttaacatattttgactgaatttaaataaattttgaccaaaaaaaccaaaaaattcagggagatttatgcttgccagtggagaatgaaatttcaaattatactatggttcttagtgttgctctcgatagttgtctccatgcttgtggcaacgacaacaatggcagaccaccactgctaggtggtgtatacccccagccagctttgccagccaagaatagactactcgatgtgtacccactcccacgctgccgaacaatggtgaagggccagtgcattggcggtggcgcagccggtaacgtggatgagcaagtctggcgagactgctgtaggcagctcgccaccatcaacaacaacttatgtaggtgtccggtgctcagccacaagttggtaggcatgtacaaggagctcggcacggcggctcacgggcaacccatggacgaggtattccctggctgccggagagacaacatgaaatgcatggtggtggcgagcctcctggcattatgcggtgtggatatccatatcggcatcggtggtgtttgctaatggctgggttatcttaggaacccggcgactggccactaggctatagctactttgtgtggtgtggtgtagttactgtaattactgtttccatttgcatggaaacgtatgtatgtggtgaataaatgatgaacttcgatgttcttatgttgattcactagcccgctcgaattgttctttaattcctttgtgcaagagggacactgaaatatataatataattactagtccctagggacaacatgcaatcagaaaaaggtaaaagaaaaaacagccaaccatatatagaggaaacttttagataatacgtaccaagtaaactttcagataatatggttcaggggccttgaaataaattgcatatttgccattgttgacccttttttcagggaccaatcaccacgatgtaccaccgagagccttaggatatgaatataatcgctaataaccgtgatctagaaaaactcctgaccaagatgataattgagatcaaaatcggctagcatattaaatttagacaaattggggtaaacacccatcaggattaacagattcgcacttttacagcaaggatggatggttaatttacaatgcaaa

SEQ ID NO: 44284 - DNA, 1501 bp, Oryza sativa
cctgggtgagattctaagctcctggtctgagtgtggaaggttcgcgagagtggaaacacacaagacacgggcgatgtatacaggttcgggccgctgagaagcgtaataccctacttctgtgtttaggtggatctgtgtatgaagaagctacaaaagagctggagaaccagagagctcttactttctccctctctgatctttctggatccgaaaatcccccccttctaagtgggcaaggtcctccttttatacctcaaggggataccacatgcaccatctctctcttttttgtggggacttatcctatcttttcataaacagacggagacttgtatggttgtcgtccgaatgaccttctgatgggacagcccatacctacctccacttccgccggaagcaggcgcgacgtgggaaaatggctgtctgctgacgacatgaccagtgtcagaccggtcacaaatcggtcattcttgtccaccacgcgtcagtctataaatctgcatgttcgcccttcttcattcaatatcttgcttgtaatggttaggatgaagcctggcatatatctgaccggaaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaatcgcaataaatgtggttaggtgagccccgctatgctcacctaccccatatacgcggcgcaaaacccacaaggggtcggggcgcctcggccctcggggccgagacgggagcggtccaacccctcggggagacaaagagaagggcggtcgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggtgtgacgccacttcctaaggcctggtgacatggtggggccggtctaaaaatcgggacaatccggttcatttttcctggagatatggtgatggcgctttggttggcgagcgtaattaacgcgcgcacgagatgttccatctcgactgcccagccgcatgtccacctcatgcaccgcaaacgggcgaatgggattagtggaagcgtgggcgcgagaaacgagggggcaagatagtgggcgcgagaaacgaggagccgggcagcgttggcaagggtataaagtcgccgaggaagagatttgcttccttcctctcgccattattccccttgtcttcgccgcttgcgccctaactccttgtttcctgtgccctaccttcgccacacgcgctcactcttaaacatctcttcctccggcgtca

SEQ ID NO: 44285 - DNA, 1501 bp, Oryza sativa
ataccgttacgctagatccagggtcagaccagctgaagggcaagaatccgaaagagatagcagaatacaagaagggcttgcacaaggagaaattgattactgtcgcacagtacattggacgagccttcttgcactttcaaaataagagagtcgtcatggccgcttataattttaagtaagttcggtacatttatcttgtacacatatgtcttattttagctgttactaactaattataatgttattaatatgtagcgatcattatatctgtttactcatccaccctaaagacggaaccgtggtagtcttggatcctctcgattacaaacacaagcaatacaaagaatttctaacaatcttacagtagtaagttattatgactcttgcatttgtatatggatgtattacaaataaatatcctccttactctgaaatggtatgacattcatacagtgcataccaatactacaagttcaagggtggagaacagacacgaacacgggagaagctgctagtacgtacctattggccggtaatactccactcactttatgtattccaatagtttcactaattgcaaattataactacttttttctatgatatgtccttcagtgtcacaagcaaccgcgaggaacggtcctttgcgggtattatgcgtgcgaattccttagggttaatggacggtacaggactaacgcggaggatgtaagtctctatactatttactagacagctcttgatatttatgatactaatatattgattaatttcaatgcatgcagttgccaagattagaatgtcgaacaagctttgacgatacaggtatcacaaatgtgcagcgtgatctgtgccacttcatccaccatgagtgctgtcatgtcaaaggagatttcttcgacccagagggtgccctagcggcaagtgacgaattcaaggatcttcgggagtggaacactgctatgccataatgtaactagatgacgttatttgaagtgacaatgtaaaacaatattgtaatatatatattttggcaacacttttgatttatgcaatataagtagatttctcagtaccaaatgcttgataatattccaatatatgtacctgcaagaatttctaataaataatttaaaagtaatttacggccaaattatatttaaatttcaatattttctacctatcttcgcaggcggaagttttcttttttgcaagcggacgattcctattttcgcaggcggaccggactagccaacgtccgtctgcgaaaattatcttcgcaggcggacggcctccccgcctgcgaagatcggcgatcttcatagtcgttggcttacaggcggacggccgccccgcctgcgaagacccttttcggccgcttgcgataatgcttttcctagtagtgcaaattgcaacgggaaaagttatagcagacaatatttctagcctttaatttgcaacatttttcaacaaagtgattatgcgtacgtgcttcttatgt

SEQ ID NO: 44286 - DNA, 1501 bp, Oryza sativa
aatgagaatgcaaaaagttttctcgggttcacgcacagcccttcagctcctgcgcagtcctcagtaaaaatgctctaactttttattggaaagtgatattgagatggggtttgaagcattggaagctagacatgcccctctttccaaccatgtatgccatgcaacccgtaacttgactggctgggtcgtacaagccttggatgttgagcctttgtagcgtaaaccaactttttgttggcgtagacagctgctggtagtgcatgggctaattcctgctcggtgtaactcttgtcatcctcaacataacccatccttcttggcgtagtaatgatgtcttccgatgtaaaccttagcaagacaaaggtagaatatttaggtagtataaaattctcattaaaatttgggttaagttgagcaaagagtgagttcacctctagttgtattttcttagcatggctgtgcataattggaccatgatatgtttgatcgttcttactaagacgtaagccatcaacttggtttacgtcatcttcaaatttctccatgtgatgtataacgtaaccatcagccttgttcacgtcaagtgtagctgggatgtcctcatcaaagatcccgcataattttttccctcagagtctttcccaatgagtattgtttactttgaaataactaacatcatcgatatgataaaccgacattaagaataaatacatttatggaaaaacattaagctcaatccccaagctaacaatactcttttttccttttgcaaattagcaaacattctttgaagacaaaggaaactttgttgatcttacaaattacatcaaggtgttattacttcaagaccacttccgatatgacataacaacaaaatcatgccacgggtagctataaacataatttgctttgaactatccttttcgtcattaaacaaattggataaatataaatatcaaaagattttgttacccatagtactatatgtctgttgacggtgtgtgcatttcttttcttacacggaagaatgaaaatgagttcaaataattaaagagtgtggtccatatcaatccactttaaaccaactttttgtcaaaatatataatgctcagattagccgtgaataacaaaaaatatttcatgcaaaaccacaagcaaattgctcatgccagtcatgcaaaaccccaagagcatactaaccacgcatgaacagctaaaacaattttgtggccgttcttcaaagttgaatcactttaattagtctttctatagccacatatagcatttattttcttccacgtaaggatcaaacaaattcaaataattaaagagtgtagtacatatcaatccactttaaccatctgttgtccatatgatgccccagattaggcgtgtgaatcacaatagatgtttcatacagaaccacaagcaaatccataaatagctcatgaacagccaaaaaatttctatctgttcttgaatcactttggtctttatagct

SEQ ID NO: 44287 - DNA, 1501 bp, Oryza sativa
gatgtattccataggattttccatttattcaatagtgtccaatctccttcgttccaaatggctaggaaaaaaaaacactataggttcaaaatcccaaaagatcctttattatcgcttactgcaaaagaaaccttaggtagctctatcatgtttgatctaaagatagttttcttaacacggctagcaagatgttgccatcagaaaacatatgcatgactcaaacaacatgatatataatcatcactctaagcaaatataagctatgttccgcgcacccacccgataaaatgttcacgatgcaccttcttccaaatcctctctagctagttatgctaaatcccttcaactttcttggccaaaccccttctgaaataactaagtttagggcccctttgaattggaggattgttataggaattttggaggatttaatttcctaaggaatttttcctatgaaacccttgattcataggaaagtataggaaattttccttaagattgtattcctatagctcaatttcataggaaaataagcaagaggttcaacctcttggaaactatcatttgctttgtttatttcctatggtgctatcaaagggaccctctttatatttcctgtgtttttcattcatgtaggattagtaaaacataccacttcaattcctatattttttctattcctgtgtttttcctatcctgtgtttgaaaggggcccttagttatgcctttattagacataaaacattacagtgttaggctaaccaaacaaggccatttatccttctcaactatcaagtgaccaagatagaaacagaaaatggatacattgcttttctatcaagatgcctgttgtattttgaccagagagatgtacacacaaattaggaagaaaacatgaagtggtccaaaacgaactataggtgtactgtaagcatgcatttgatgaggagggggtacaaaattctaattcaaaacgactctttcaaatacagaggattgctacggtgagaaaggccagcaaaattccaaaaggatcgaaaccgaaaaaccaaaccagtttagctttttagtggacacttgggacactcgtcccaaatgtttcagttactccctcccatatcgtttgaccccgactcgcccatcaccgtcgagtcggcgatgaacggacaggatggcgcgagccgagcacctcactacctcactgacccgctctctcttctctcatctatataggctgagtttgaaaaagggaagatagagaagattgggaagatacgcaaaacgagatgagtaattaatatatgattagttgagtattaattattttaaatttcaaaaatagattaatatgattttttaaaacaacttttctatagaaaatttttacaaagaaacacacccgtttattagttcgggaagagcgcacgttgaaaacggaacaaactatctcacgatctcaccgtttagtccttgatgcaccaccttctccgacctctctctt

SEQ ID NO: 44288 - DNA, 152 bp, Oryza sativa
cattctcgccgagccacccattccgccacctccacccctcccccgcattaaccctcctcctccgctcgccgcgccgcgccaccgatcgatcgctgcgctccgtgcgtctcaccaccttgctaggaggacgaacgccggcggcggggagggga

SEQ ID NO: 44289 - DNA, 1501 bp, Oryza sativa
tttggagtcaattgaggaaactcaagtctgaacaatttcaggacctcaaccaaaaaagtgctgcatgggaatttaaacccggcgtagaagaaatcctcaaacacaagagtgtatcccagcttgggagaaggccttgattctcccactggtcgaattacaacgtttcgaccagatatccaaccaacatcaacaagatcgtttaagtttttttccttaatcgaagaggcaccaataccacaagaagtatcttcgtggctttttgatttcttggacttcgacttttccgcagttttcttgtttttccccatgttgtgtagtgagaaaggaagaaatcaagcaaagcaccaaaactcgaatggaagaaggaagaaagagatttagttcgagtattttgtgatttcgagttgatggcagagcaaacgagtggtggcgtgggtcacgtgatagcgacccctcctggccttatatagcgcagggtggtaagggtcgcgggtttacgagcggacacgaaacccgaagcgacgcgaccccttgagcgcaccaatgaaataccggcacgtggcattcaaaaaaaaacacaataaataaataaataaaaatgaaaaataataagaataaaaataaatgaatagtaaacgtggcgtatatgcatatttgaatagtgtgtttcgaccgaataggaggacggcggttttccccctttttccataaactcaggcacggtttcggccgaaaacacacatcgcccttacccgtgaggggcttgttgtagcagggtgcaaacaccttttcctccaattcggtcaaaacactacgaggttttgcaagacctaagtatccagaagggaaaacactcattttgagtggaaactacctttccaagaggaagaacaccttcccaaagggaaaataccttcccagaggaagaacactcattcgaatagaaaatacctcttcgggtgaagaacacctttttagggacattccataatcgctaatacaactacacatattttggacaagttacaatttcacaggtgttttccaaggatgaaagagaaggcaaaggggaattcgaattcccgggaggaagaagacggtccaggacggaaaaggcatttttcccaagagttcgaggaagagcactactcgaacaagagaagatgccaagggaagattccgtggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaaaacatcttgaatacaaaagtaatcctcaaaagttgtgtttgctgttcgagctcgtttctaaggataggcgggaaaacacttctttccggcctatccccgatcttgttcgtgacctaagg

SEQ ID NO: 44290 - DNA, 369 bp, Oryza sativa
tcctgcagcccgccagctagcacctaaaagactaaaagacccctggagatgtactagaatgcccccacagacgctgatgtggcaggggcattagagtaaacttacaaagacccacaggggtaaaaatgtaatctcacgtgtacgaccactggttataaaagccagtcaaaaacctgtagcaggacaagacatcttgaatacaaaagtaatcctcaaaagttgtgtttgctgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaa

SEQ ID NO: 44291 - DNA, 1501 bp, Oryza sativa
gaagattttggatttgcaaactcaaacaaattgaaccataacacaaacatgttatttgtatatagacaagttaccgacgagacaattactcaattatgaggtgataaatttttttagtaatatcaggcaaaactctttttgatggttgaaggaacgcagaagccaaattaaaaccttatgtcagaaatatatgttataacattcataccgccattcctgcatctcaaagaacaggccacgtgcctgatcaacctggttatgcctcgcatatagtcgtatcatcatgccataaatgtcgttacgagcacagtagttatcctgatttttcatccagcagaacacatggacagcatgctgtaaattcccagaaattgtgatctcctacaagtgatacaacatgtgtaagcgcgttattacctgaaaaggctagttttatgttagcaaatcgagagatttgagcctcgtctacaaaatttgcatgtgcagctggtactaccataacaacacagctagatcgattgaattgttcatgatttttgtaatttcaagcaatcgataacattttggccccaaaaccagtttgtcattagtgcctccacgcaaggcaaccatggcagccacattgatgtatatcatcagcaattttcaattcatgaaatgctacagagcgtggggatgatggccttacgcggatgaggagagggaagttgcggcgggcgaagcggccggcccagcagttgagcacggcgtcgacggcgcgggcctcggcgcgcgggagcgcgagcacgcgcgcggcggcctccgacaccttccagtcccgctgccaccggctcccctccacgcgcaggcggtggcgcgcggggagcgaagcggcgcccacgccctccacctcggcgcgggcctcgcgccggccccggtcgtagtccacggacacggcggggcggcgctccgcccaccccggcggcgcggcgcccgggtgcgccagccgcggccgcggcggccgtgggggcgcgcggaccacgcgcgtccgggccggtgacgctggcgccgccgcgtcgggcgtcgcagccggcgaccgcggcggcggcggagcggaagacatcgcggcgggtggtggagggggggagaaaacctttaccgttggggcggtgtgagagcgggttttccggataaggggcgatcttttcctcaacagaaaaaccaggaaatgaactccatccgtcctaaaatatcctcgcgaaattagaatcagattcgtaaaacgagaaagcattctgttatatcctagatttttatattttaaaaataagatagtaatttacaagcaccgcaatctaaaaatatcaccgtagaaatgcttttattttagaaactaggtgaaaccctacgtgttattgtaggagtttagtattataataatataagtaaaaaataatgcgtaacatagctagacaacataaactaaagtaagttgatgtgatttatgataatttaaatttaa

SEQ ID NO: 44292 - DNA, 1501 bp, Oryza sativa
ttgaagtttaaaatagttaatactttattaattatgtgctaatggctcacctcgttttgcgtatcttcccaatctcctcaatcccctccttctcaaacacacccttagtttgcaaaatccgcactccgtcagcatggatgccatgcctgccatcctctggccgacgcagcccagcagcggtgctattcggtcgacatgagcaccatgaaattcttttttttcacaaaatgaaattaaataacaacgaaatattgctacccaattggcaagatgtattcagaagaacattgaagttcatcatttattcaccatatgtatatatgcttcctgacaaatgaaagcactagttatttagcaaccccacagagtcatacacacagctagctttagtagcctagtgaccagttctcggggtcctaggataacctagccagtagcagacaccacctgtcccattggggatgtccacgttgcagaacgccgggaggctcgccgccgcgcgctccaagtcccctctccggcagccggggaacacctcggccatggggtgcccaacatcggtggcgccgagctccctgtagatgcctccaaccatgtggttgagcgccgagcacctgcaccagctgtcgtcgaccgcggcgagctgccggcagcagtcctgccggagttgctcgtccacggcgccgccgggtgcgccgtggcccacgcactggcgcttcaccaccgcccggcagcgtggcagcgagtacatcgggtagcccattcctggctgacaacgctcgccgaggctgtacaccacctggtctttgtggtggtccgccatggtcgccgtcgcggcgagcacggagacgatgatgaggagcaacgccgagaacactaccttgttggaagccatggctttttgtttgcagaaaatctttagtctgaatttgtatgagagggataggtttaaggtcttcatctattggtggttttatatatagctataaagactaaagtgatttaagaagggacataaaagttttagctgttcatgagctaatagattaacttgtggttttgtatacatataaaatattaattgtgatccacgcctaatgtgggcatcatatggactaaagttggtaaaagtggattgatatgcaccacactctttattaatttgaaccttccgtggaagaaaattaaagaaatgcacataatgtcaacagacatatatagttttgcatgcaaggtaacaaaatcagttcatctttatttccatggcttgtatagtgatccaaattgtggaacaataaaaagaatagttctgaacaaatactttaaaaagaatgctctggaagctgcagtaacgaaagctgcatcactagatttcagaaaattaagaaattaacgtgcctgatgaagcatataagtattggagttttctgaaacacaaatatcatatatatagatagctttacgcgcacgttggataacagggttatattaacaaggcacg

SEQ ID NO: 44293 - DNA, 1501 bp, Oryza sativa
gccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaa

SEQ ID NO: 44294 - DNA, 1501 bp, Oryza sativa
agactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctccatttgatggattgctgcgattttgtcaggatt

SEQ ID NO: 44295 - DNA, 1501 bp, Oryza sativa
gtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcat

SEQ ID NO: 44296 - DNA, 1501 bp, Oryza sativa
tgctctaacgccaaaaacacacttttctggattaagcttaactgagcattttctcaggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctat

SEQ ID NO: 44297 - DNA, 1501 bp, Oryza sativa
tcaatctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccga

SEQ ID NO: 44298 - DNA, 1501 bp, Oryza sativa
ggttttcaaatgtttcttgcaaatctttgccatgggtaaatgcttgtttactctttaccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctcctt

SEQ ID NO: 44299 - DNA, 1501 bp, Oryza sativa
caactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatgacctcctggaccatgtatatgacaaaacttactgtaacattcttctgtggaatgacctcctggtccatgtgtttgacaaaatttggtttggtcaggtttattttctcttccttttcctctttcattgttccaccatcgtcctctacctctgcctgaattccaccattgtcctcgaccttttccagattgcccccaattgtttctccctctgcgagtgttgtcccattg

SEQ ID NO: 44300 - DNA, 1501 bp, Oryza sativa
caacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatgacctcctggaccatgtatatgacaaaacttactgtaacattcttctgtggaatgacctcctggtccatgtgtttgacaaaatttggtttggtcaggtttattttctcttccttttcctctttcattgttccaccatcgtcctctacctctgcctgaattccaccattgtcctcgaccttttccagattgcccccaattgtttctccctctgcgagtgttgtcccattgatgttttcctttttctctttcattgttggatccatctccgataaaatttacctgtttcttctgatcttgtttatagtcatacttgaaccttttccagggctttccggtatagacggcttcttcctcttgcactctcaactcatcttcttctcctcttgcaaaactttccattctttcaaacaagtcttttgctgtctttggtctatttctagcaagatcgaaacgaagaggaccgggtagcaatgccctttttgctgccgctatgagcatttcgtcatctacatgcctgatctgacatcttacccttgaaaacttcacgatgaaacttctcaatgtttcccctggaagctgcttca

SEQ ID NO: 44301 - DNA, 1501 bp, Oryza sativa
catgttttcttttactacctttaagatttcttcctcaacatgtttttccaagttttctcctatcagaatgaattccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactgagaccactaaaggatcttgatgagggaaaagtattccttctgcatcttcaggcccaaaggaaattaccgtttttgagtatactggtggatttgactgatagcttgtcccgacatgatttacctgtctgacatatgcttttctttgcctttttgactcaattcctaacgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatgacctcctggaccatgtatatgacaaaacttactgtaacattcttctgtggaatgacctcctggtccatgtgtttgacaaaatttggtttggtcaggtttattttctcttccttttcctctttcattgttccaccatcgtcctctacctctgcctgaattccaccattgtcctcgaccttttccagattgcccccaattgtttctccctctgcgagtgttgtcccattgatgttttcctttttctctttcattgttggatccatctccgataaaatttacctgtttcttctgatcttgtttatagtcatacttgaaccttttccagggctttccggtatagacggcttcttcctcttgcactctcaactcatcttcttctcctcttgcaaaactttccattctttcaaacaagtcttttgctgtctttggtctatttctagcaagatcgaaacgaagaggaccgggtagcaatgccctttttgctgccgctatgagcatttcgtcatctacatgcctgatctgacatcttacccttgaaaacttcacgat

SEQ ID NO: 44302 - DNA, 1501 bp, Oryza sativa
aaataattcaattccagataaagtctaccaaacgattaacaatgagtcaagaaactaagaaattattatagttgccttggatagctaatcaatcaacaggaggaggtatcaagtatggaataacgataaatcgaaactacgatgctaaccttgctgaactccacgaactgtggccgtaaggaagcgcgaattcggacggtgccttacattgggctttcgcagatatgcgtgaacaccttccctgtcagcctccgcctgcaacctcctcgcctcctcgagaagtaaagaagcaagacgattctccgtctccagatccatcgtctcaggggcggatccaacttgggacatttgggggttcagatgaacccccaatactgttactcttgtatcaaaaggttgaggctctctctgaaattaagagatgagcttcttccagatctacaagagaaagctagggttaacgaacgcacacaaagcgaattccagacaaaagtaggggtgggagagagagagagatgaatccatgaatcagaaggaggatgtggatggatgctgctcacctgcaggatcccctcccctccgctgctttgctcgagcagatggggatcggcgcctctccctccccctgttcttgtcgcaaggagcggaggagacgggggatttctcttctcctttttacgccgaaggggggagagactcgactacggattcggattcggagtcagagggagggaaatagcggggagatggagcgcacgatctgcatcggacggcaaccagcgaggttagcaaaaacgagcgggctcacctggcccacggcgacaaaatccggcccatagaagcactgtctccctcggcgcaggttcggtacttcggttggagggaggctgcccatggtaatcgtgcccgtttgcccatttacccttagataaaagccctattatcacggccgctatgtttgcataaaggagttctttgctgtattggagaggaggggggagggaggggtgaaataggagaggcgaaggaggaagacgacgactcagagagagaacgggaatggataagatcgaatcaaggggtgaaaataggacgggtaagatcgaatcaaggggtgaaaacgggacatgtatttcccgtctgtccatattaatctgtaataatttcagggtaaaataatctacccatatgtttacataggtatcggagccgaatccaggtatttctttttggcggatacaaaatcgtattgaaaaaatgatatcttgaatcatcattttatatactatttaaatttaaattatcataaatcacatcaacttactttagtttatgttgtctagctatgttacgcattattttttacttatattattataatactaaactcctacaataacacgtagggtttcacctagtttctaaaataaaagcatttctacggtgatatttttagattggggtgcttgtaaattactatcttatttttaaaatataaaaa

SEQ ID NO: 44303 - DNA, 1501 bp, Oryza sativa
tcaaattttgtctgataagaataagtataagcgaaaagatgagaccctttgtccgatcgagttgagattcgtgcaggtcccttttgggcccaatctttcacggcccattaagcaagtaggcagcccggccctggaaatgcactgatgaattcgttttgtttaatttggacgctaatcccttacgcccactgacaattcccgcgcgcgccatgcacgacgccctctccacgtagcttcgcttcccggcaaattcaaaaaaacaaaaaaagcaactgttcgtcttcctccccacgcttccatttctctccctttttccaaccatctaaaatctcaccacccccccccccccccaacaacccaaaccttgcactgctcatcgatttctcttcctgacggcgacaatggcgtcgaagaacagcaagctctcggtgtcgtcggtggcggtggcgctggtggcgctgatggtggtggtggtcggcgccgtcgtcgcggcggctgcgggcggcgaggagtactacggcggcgtcgcgcgcgcggcggatgggtgcgagccggggcagggcgtggtgcccaaggacccgctgccggggtgccgggcgtacctgctgcggcggtgcggcggcggcgacccgccgggggtgcgggcgcggtgctgccaccagctgagggaggtggcggcgcgctgccgctgcgacgcgctgcgcgccatggtggaggtgctcgtcgaggaggaggaggcgccgctggcgtgcaagaagggggccatggccgccatcgccgaggggctccccgggcgcgacgagtgcgacctcgacacgcgcgccgacgacggcggatcgcgccgttgccacttggtgattaattgatatctgatgctgtttaatgataaataataatcgccattgttatattctagattatttatttatcaaacgaataaaatgattatggtcgcgtgctatgcttgttcttgcaacggtgtgtaattatcatgtgatgggcaataaagagcaggtgatgagtagtatttcatatttttaccttgtttgaacaaattgaaacaacgaaccgcgcacaattttcttttctttatttttgaaagatcagcacaattttcttttcaagtgtaaatttgatgataagtcagcacatactacgtacatacagtgatgaatcaaaagaaaatcgattcgctttggtattgtaacaaagtaataacttgttaattatacctttctagaagaaaaataaactcattggtcatgcttaaaccatgatattaccttctaggtatacatatactaatttaaatgaaacaactaggtgtgatgaatggtcaatccgcatccatcactcacaccatcaactccctgcacactgttgtgaagggaaaaaatggagtttgtgcgtgggggccaaaggacccgcctgttgtgccgagaatgtattaatgacaatgtttccttaattctgatctaacgcatggatattatacgctagt

SEQ ID NO: 44304 - DNA, 1501 bp, Oryza sativa; identical to SEQ ID NO: 44283

SEQ ID NO: 44305 - DNA, 1501 bp, Oryza sativa; identical to SEQ ID NO: 44285

SEQ ID NO: 44306 - DNA, 1501 bp, Oryza sativa; identical to SEQ ID NO: 44286

SEQ ID NO: 44307 - DNA, 1501 bp, Oryza sativa; identical to SEQ ID NO: 44289

SEQ ID NO: 44308 - DNA, 1501 bp, Oryza sativa; identical to SEQ ID NO: 44292

SEQ ID NO: 44309 - DNA, 1501 bp, Oryza sativa
gagttatgtctcttccttcttcatctttttggtcaaatatcattcttggagaatgtgcccctacttcgcttggagtcattgcttcatcgccataaaccaatctgaaaggggtcatgccagtcgaccttactaccgtagttcttagtgcccaaagcactgatagcaaatcctccggccattttccttttgctgatccttctaacctcttcttgatagcttccatgattttaccatttgccctttccacagctccatttgtctgaggatggcctacagaggcaaagttgatttgcaaattaaggcctttacacatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtattt

SEQ ID NO: 44310 - DNA, 1501 bp, Oryza sativa
gccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctcatttgatggattgctgcgattttgtcaggatttgcctctattcctcttttggacaccaagaaaccaagtaactttcctgctctaacgccaaaaacacacttttctggattaagcttaactgagcattttctcaggttttcaaat

SEQ ID NO: 44311 - DNA, 1501 bp, Oryza sativa
acatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgacc

SEQ ID NO: 44312 - DNA, 1501 bp, Oryza sativa
agactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctcatttgatggattgctgcgattttgtcaggattt

SEQ ID NO: 44313 - DNA, 1501 bp, Oryza sativa
tgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctcatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctataccacaatgtcatctacgtatgcctcgacattccgtcctaactgcttagccaagacttttcctatcagcctggcaaaagtcgctcctgcattcttcaaaccaaatggcattctgataaaacaataa

SEQ ID NO: 44314 - DNA, 1278 bp, Oryza sativa
ctgctctaacgccaaaaacacacttttctggattaagcttaactgagcattttctcaggttttcaaatgtttcttgcaaatctttgccatgggtaaatgcttgtttactctataccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 44315 - DNA, 1391 bp, Oryza sativa
tcaatctctgcacttctcttgtgttttttggcggctcatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctataccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 44316 - DNA, 1221 bp, Oryza sativa
ggttttcaaatgtttcttgcaaatctttgccatgggtaaatgcttgtttactctataccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 44317 - DNA, 564 bp, Oryza sativa
caacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 44318 - DNA, 599 bp, Oryza sativa
catgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 44319 - DNA, 1501 bp, Oryza sativa
ttagctgcccgtcaacttctcctggatcgtctcgtctaatcttgtatcgtagtgctttgtaaacagggcatgcttctaagttctcgtactcctcaccgcgatataggatacaatcattcggacatgcgtgaatcttctgaacttccagtcatagagggcagactatcttcttagcctcgtacgttgtctcgggcaatttgtttccctccggaataatgtccttgatgagtttcaataaatcgccaaatgccttgtcactaaaaccatttttggccttccattgcaagaacttcagagtggtatcctaactttttgtgcccctgctcgcaacctgggtacaacaacgttctgtggtcctctaacatcttgtccaatttatgggcccccttttcacttttgcagtcctccttggcgtcttgcaacatctaaccaagatcatccgcaatgtcgttaccatcaacatccctttcctcctcgtccgtttgatttccttcaaatccagcgtattgaccaaagtccggaatattgtcgtcttccacttcatcttcttccatttcaaccccttgctctccgtgggatgtccagcagttatagcttggcatgaaccccgactcaaacaagtggaaatgaatagtcctggatgcagaatactccttctgattcttacacttattgcatggacaacaaataaaacccttatgcctgttagcttcggccattctcaaaaaataacgcacgccgtcaataacctctttggaccaccggtcagcgtacatccattgccgatccatctacatgagatgaacaaaaattgtacacaaataattattcttacaataatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatataatatgacaaagaaaacattggagaatgaagttgctaaccttttaggcacctccgatttgtatataatcaccaaaataaattcactagaaattttggcatgacctcccctcttttttgaagaaattttgaagcttgctcgggcagctagaggaggaagaagacgaatatctaagggtgagactttagtcccggttagtgttatgaactggggctaaagatccccgtgatctttagtcccggttggtaacaccaaccgggactaaagatacttgttaccaaccgggactaaagatcccgggg

SEQ ID NO: 44320 - DNA, 1501 bp, Oryza sativa
gcggtagagtagtgttggtggcgacgggcggcgaggacgggaaggacgaccgcgcgtgggcggccggtggccgggaggacgtcgactccctggcgcggtccgtctccgctcccgtgtaccgtgtacgcgcgcggattttcggacgtcgcggcggtgctcgatcctatggtccgaagtgtgcgcgcggcgttgcgcggcctaatggcgtggctcggcgatatgcaaagcggggtgctgacgcggcgagtcgagacgcgtcgcgcaggccgcacgtctcgtcgtgatgcggttgggccgttggggtagtgttgcgggtagcgcagcgtggccagttcgcggtcgacggcggcatggtgaggatggcgtgacgtggtggtcgcatgtggcgcgcgtcggctcggagacaggagctgcaaggacggacggcgaggtaggcggggacaaacgtggcgtcaccagcgtcgttgtctgcgcacgccggtacggcgactcagggcagggcgtggccggcatcagcgggagaagttgtggggtggttggcaacggcgacagggcgggcaggcggatgatgccagcagctctccgtgtactggcgatgttgcggcgttcggaccagtggatctatgatggcggcggcgtgcggtacctttggcgatattctgtcgagcagttggcgggcgtgcagcttggggaggccaagtctggctgggccagctgggctgcggcccgggtggagaaggaggaggggaaggctagaggccgcgggagagagaagaagggaggcacaacgagctttcccagtaggctcagcccaacagaaggggatgggaagggagatggttgggccggctgggattggcgcaaaaggaggggaaacagacttagtgctaggatttgaattctagggagatccttctctatgggttgaatgatttgttgtttgactataatgatttgagtctcatgtctcccatttaggttagagtgattccaactcttgtgataaagtaatatccattacaatcaaaatgttggtcattataatatggattgttttgctttcactttgggaggatatgtgaatggttgcatttatttattatttggattctcgtaacccattagtagttttgcaatttgtgaattaaatgcgcatccccaattccagggcttttattaccgaaatatatttttggttgaatgcctgcattatatctggattggaaattaaattggcatttaatttctccttggtagcattgtatatgcctcattcgaggtttgtaaaataattcattcagtttacttggtatatttcgggatttgattattcgtggctttgttttagggtggatttccacacaaggaaagcaaagatgactgcatgatgcaaaagtttttaaaagttcaaaattttactgatttttttcaactggatttttagggtgttacaatggtggagattaaatttctataactaaaaaccgtgtatgccaatatg

SEQ ID NO: 44321 - DNA, 1501 bp, Oryza sativa
cttgtggttgagtaagttattgccttgaatataagaatgatttgtgcaattgatcatgagttcaaggattggcaaacacaagagaaaatattttatttttttacattggttacatatggttgtggtacaatttaatgtctctataaaatgactctaccatcttatagacattttataaaatgcatttttgtttgtagagacaattcaccgtaaggcacttattaggcatatctaaaaaaaattaggcattttttaaaatacctctatagtatcgtaaaggcatttgaaaagtgtttctatatagtactagaaaaatgtctctacaaagcatttttctctgtagtgacacgactcaaaccttactaaagttaagatacaaacaagaccatatacgacggtctcttaccaaatctctaacaaaccaactcaatatcttaattaataaatacaattgccttaaacgagctctatctcttattggcaatgacggttatcccaatctagacccatgctgagcccaagtcacttcatatcggccgcatcggccatcggcttcatcaagcttcaaccagcctcgtactctgtttcggccaatatggtatccagtcgatgtgcaatcggactccaagttcggttcgattcaacaccaaatccgcttcgattttcttccttcttttccgaatctgatgccaaattccgttgttaacagttatacattataagaatggtagatttatatgtttaaataatgtgaagataatgatttgacattgcttgcatattgagttctaaaaacataacaaaactgtaaatgatatatgatgtttgcatgacatttaaaataattgctagtgggtaatgatgtgacataattgcgtatgatttaaaatactctagataagtaattgctagtaagtgagcgatgtgacgcacttacatgttaaactttagtaggtaatgagcatcttatagtaagatagaatatgtcacttagagcaggtacaagagcaggctataagctagttataaacatattttaaagagataaaataggagagagaagagcagcgggctacagatctatagtcaactgcagcacggactccaaaacgtaatgtgtatatgataggtgggaccaggtattaatagtatagtaagcactattgtatgaatcgactattaaattggttatagataaattggagcttgtagttggctatagtattaaacttgctcttagataatactcttgcactcattgagacaacgagacgttgtagtcattaatgtaccaatatttttttattattatcgttagttctttttctctacaacatgcagcaaacttgtatcatgtatacttgcatagcaatgatattttcctttctcccttctttctctttcacgtcatatatgataatagagagaggacgctaataaacaattaatgttacatgtgctaatgttcaaaggtgaggaatagagcagtcacatgaaaaga

SEQ ID NO: 44322 - DNA, 1501 bp, Oryza sativa
ttggccaattcttgaaaccattagagttatcaaaatgtcggttaagtcccttgggcgaagccgttgggcaaaaccgaaggatgaggaccactgggtttgccatcaagtttgggcgaagccaggtagtgaagaccggtggattcgcatgttagggaaccttatgcatctaggtgattgatatttgagatatagtttagatgaaggaaattcttgtgttctatctcatggcaattggggatttgtttttaaaatcaaaaattcatttgaaagcttaatcctcatatgactttattcctacctaccaaggtcatacaccaaaatattaatgatgaaccttattaatgtgtatgacttcctgtcattatattgagctttaccaaattattgtgactcgtgttagatctctctcatgctctctcgatcaaggttgcacaaccattatgctaagcttctacattgtaagttggcaccattccatccatttccgttaccactgaaaaaaatatgatgaataaattctccatccaatttatgccttcttctcctagaaaaatccttggaaaagaaaaagtaacagaggggaatgcatggctatgaaaaatattgctctttcaaaaatatggagcaacattgaaaaaaaattaaaaaaaagaaagtttacaaaggagaaaattggagaagaaggcatatacaaaggagaagcatcttctttatttcccattttttcacatatatcatacactttccaggtgcaatccttgatccgagagtatgatcgactatcttcttgagtccatttatttggttttgcaatatatatatatatatatatatatgatgcaggtatgtcccgaaattatccctaccaaactccacataaacggccttcagattagggaataattttggcaaaatatgcattggtaaggatccacagacattgcaaaatatttgagtgattgagggtaagtcattatgaggagaaaagctgatttgtgaaaatttacaaaacccaaaagtctgagatggagtatgagaagaccggattcaagactgttgcatttttcaatcgcccaagatggtaagtcggagtaattccagagttgttggtaatcctcttcttatttcttttgctctgttaattactctgattataatagaaatatcttttgattaacttagttttgcttcatgagaattatctcttggttagttcctaattagcatgcaggatcatcgttcactataatccagtaaaatatagtgattgctttagtgtgtagctaacattaaagtaagttattaactgcgtagacacagtgtctaggtagttgattttcggtgtttgctccgcatcccacggtaggtgtgaggtgggtgtagaggtggtgatagccctcgagatcactgaagtcctccctgtccgggtgcgtaatagagcgatatctgggagcggcgagctggccagtgcccgagcagtggttctacacgaaccgggtga

SEQ ID NO: 44323 - DNA, 1501 bp, Oryza sativa
gctgggaatgaatatctctagtaatatcgttaagaaatactaacagtgcactagatgctagaaagaaatggtgacatagtgatttatactggttcagcccctcgggatgaggtaataccctagtccagttgtttggtgcctaaccctccaggggtgttgccaatacccagaggatgcgatatcccttataatccgggtacctgccatccgtcatgatatgacggaataggtttctatctctctattctccgctacttatagtaacagattatataggcctgggcccatatcacgcaagagatccagcctccgagtaccatgatgggctatcctggtacgataacttccacacaaccatcggagggagcaaatatcacgagtgtatacagtcctcaacgaccaagggcgtccgcacgtggacgcagtcctcaacaacgtccgcatctggacgctataaggaagagcgtccttcctatttctttaattttgaaactatgtttactacttatttaattttagagttattaattattacaaattacaattaattttcttgttatccatcgatacgtaatgggcagtgcttcgaactttatttaaggaactgtctatatgagattcatatgattttttaggcttccatcatgcactgtctcaaccttcccatttatttaagcaaactctggaatgaattacattcgatgcacagcataacgtggcttagtaggtagggtatgtataaaggtagagtctaatataagctctctatactaattaatattactagagattatctataatagtagagacaataagatttctataaaccattaatgcaccaaatatttttattattatgcttatttccttttctccaccctcatgcaacaaattttccattaataaatgctaagagtcgactttgagctgttatcatgcgtagtaacgatgtttcccattacttccccctcattcttccacgtcactaaatttatttgaatgacaatgaagagagcccgttattagatactaccatttgtacatgccctaagcttatttatcgggaagcttatttatcgggaagactgtaagccttcttaggctgcgttcggagataactctttctctccgcacggaaaacggaatgatccattaacgcgtgattaattaagtatttgttaattttttttcaaaaatggattaatttgatttttttaagcaactttcgtatagaaattttttgcaaaaaaaacaccgtttagcagtttgaaaagcgtgcgcgtggaaaaagaaggagaagggttggaaaccctgagtagcaaacacagccttaattaatgtcaagttgttgtcctacaatactccctcggtccctcccacctatcgttgacctttgtgattactctatggtaatggcacactccaacactccattatattatcggtctgatgaggatgaggtgttagcttgttcgtctcacccatatcatttcttgttagg

SEQ ID NO: 44324 - DNA, 828 bp, Oryza sativa
ttctcgatgattggactaatcgctaaaaacaaggagaaggccaaaacgtaggccctagtggggcctagaatgttagccgattggctgcctagttcctagccaaccttctggtcctaattgtacattctttcttgctcctttttctttccgtataatttcctcccgttctatccaattttgctcatcgattcatttaaaaaaaacaaaagtaagaacagatcaaaattgtactaaaatctccaacaaaatcactctgcaacttcacgccataatatttttttctctatgacactgtgaaagaaagggggattgataaactcatattcaaaatatgtgaaaatgaaataaaaaaggattgtgattcacatcaaaagatgcaagaaccaccctatgcattttttttattttactcaaactgttgatgtttctgcacaatttggtgcctagccagatttaaaaaggttgaattggatttttataccaatcctaccatttgtcgcattacagctgcattttgtatacaactataacaatcaacatgcatcgctataatttgaattcactacaatttcagtgacatgtgattcaagtccacttaatctgaatctactcaaaggataaaaagtgaccagaaagtgcagagatgaatagtgtccgttttatagtttatggattttttaccaaagtggcataatacttagattttaacaagtcagattgaatttgatgtaaaataattgttctgttcattcacaagaataattatatattgtggttgtgggagagcaatataattattcctatactgatactttcatcaattcatta

SEQ ID NO: 44325 - DNA, 1501 bp, Oryza sativa
tacattgcgcccaatctcatctctgagcaggggggacaggacatgtttgtgaattctaagaggactattgttgattaggtttctgttcactagagcgagaagcactccgtgttgttcctgttaaattttctgttcacacatgatgcatgggtgcagggcactggcccctgaatatacttgccctgaataaatatgcaggaattgtatttgcatggtgtggcgggagtgcgcgattgcgcgcgcgaaaactctctgtaaagtggagggagcgaggctataaaagttaattggcactttagtagtagttactatttatacgcttgattggtcaagttagtaataaataagcgctcggagatggctcattaccatatttgcaatattgcagtagcatgtgataatgtacgtagcctatttacgcaaaccgccaattctggtttgtggtcttagtgcattgttccagtgttattagcttctcgatgttgcagatactatgttgaagtactccatgtttgcaagtgttactaagtagaacattgcttcctagtgggattaaattactaatttagcacttaaatttacttggtgtgagtgtgcacatgcacttgcatgcgtgaggggacttgtggagagggaaagagttggtatatcagtaggaagtgatgttaaatcgtcgagttggtatatcagtacacagaaatggcttttaggttaagattattgtgcgataacacgacaaatgcaatgtatgataacatcgatctctcctgcatggcatatgcaatgtgttgctatccagtcacttttgcattcatcgtgagtttttatttctaaaaaacaggtgccccagccttgtaccgctaaagccacacaagtggccaattataccggataagcgaccgattatgctgcacaaaatactaaaacgtgggatgactgcacgaaaccacttactgttttttaaaatattcattgtatgtatcattcatagcagtataatctagaaccattaagtgacccctagcacatatagtagttgttcatttgtagtgtattggatataatatttgcttggtgcatgcacaattgcatattactgcaacaatagtttctagttttgcaagccacgttttaatttttggttacctgatacagtcttcattttgctgctccgtagatatcaattgaaatattttgagtgctgtactgtttttttttctgctaatttttttgttcaaacattctatatcaatccaatcacacatccctaactattatctatttattttcttgtaggcttgttttggcgattgatcacactgtagaaatcaaattccaagtgaagttgccaaacaattacctatctgctgttattgcttccatggtaagccatcagaagtatttaataattttgggacctcattcattttcaagagaacaccacttcaaagtagctattctctctttcatgattctaacttctaattgtatgtctgcatta

SEQ ID NO: 44326 - DNA, 283 bp, Oryza sativa
atagaataacccaggcctacttccagatgtatgagatttatagctgaataaatcatcatgatagggactcatgtcaggcctttcagcagcttgttggtcacactgcacaaaatggtacgaatcttagacaggtagtgtcaacagtccattggttcatttcagcagacaacttaattgcgaatgtaagcttcagcaccactgaacaactaactactcctggtccctggagacatgaatctactacatgatataatacataaacattagcactaacaaaaagagc

SEQ ID NO: 44327 - DNA, 1501 bp, Oryza sativa
gggtccatagccccttttagacagtggcgtagctaaaatttagagtaaaggtggtccattatacaatttttattatattatctagcatatatactatagttttaatctcgatcaaatttttaggtggtccatagatcatagtgccacctagctagctacgccactgattttaggccttctattgctgggcctaatgggacaacgccatattagctcaggttttatcaccagacgctatgtataaggtgtgcacctgggcaggcatcaacacgtgtagccaaccgccgcaaactaatcaaacaatagaattaaccacagctgacgatgagcagtggcattatcaggcagttcatcaccggggcactccattttctgcactgtgtgattattagtacacacatgttcctaagatcctagtcacaattgagtgtgtttctgatttgattccatcggggagaaatgacgtaaagccaaggacgaaggacatcgctgctgttgaagcatagcttcgcctgcttggcatcacagtgacaagaatcacaatcatgctgtacgaatttaggcctgctggatactgacatgtggcgtaatagtggccaaaccattgggggccaaatgtcatgtcgacatacgagatcataactgtaccaacacacagcacaggcttagactatctccaacaggctaggcatagcgacacccaaacccaaaatatgtgctccaggctactgtagcggaaaaaaacagggtccaacagagtacccatactaaggacctattttgggttccagccgaggcggaacccaaaaatgagcgccctctctcctcgaccgaaacacctggcgcaactgtttcgcgggaggtggagagaagaggaaagcgcacctggccccggcaatagggaaagctccgccgccggcgagatctgctctgagctaggcttcgcaggtatggatctctctccaaccccaccctccttcatccctggtcccatctctcctctctctggacgtggatttggccgcggccgctcgcaccctagccaagggcgcatcacgctgcatgctgtgcctagccccgacgacgccgctcaaatttttgttgaccgcaccctccccagcatgtttgtgccatgtttaattgaatctctgttgtaataggatgatggataaaagtattggtggctcaagtgctcgcgctagcgaatctgaagaaatatttgggacagatcagtgggcttttgggttttctgccgctttgcattcttttgatgttcctccgaacccccaggtttattgcagccatgcatatgatgattttctttatttacatatctatacatcgatgattaacagttcttttcatcactagttcaacatgcatggctcgtcccaaatgtcatgcccacctataaatgagcaacctagccaggggctctccattgacaacaacattggctctgaggaccctccatcattgaaatcacagagggctgcaaaga

SEQ ID NO: 44328 - DNA, 1483 bp, Oryza sativa
aaatagagaatgagataacacataaaactcttatgattgcctttttttcctcaaaagtatactgaaaaggcaaaactttattgcttattcgtcaatcgtcctaaacagtaattgactcggttaaaaaattataagacctcatcttttcgcttatatttatgtttatcacttaaaatttaaatttttaaccttaaatttgaagctgattttgagtttttttcatcgaagtttatttttcactctatgcttttagatcgctaagaacacgtatataaaagttttattcacagatcacttttcgtttgcaaatatgccgaaacgatggggccgatagtttttcgcccttcgacttttcccctctgaactttggtaccaaaaggcgtggccttaattacgtactgagcaacttggttagctacatatataggttaactggttaagtcaatgtcatgcccccttagttaggcaggtagaggcttgaggttactatggaaatcgaatcaattaacatagcttcacctatatgaatggagcccaactcacctatatgaatggagcccaactcgaattaatacctatagcttcagctctactacactgctaacctctccggtcataagtgcatgtcgtttgatttcgtttcagtctttggcatttggctgaaaagttttattaagcttatgattatgaaaatatttttaagataaatctatgcatatcattttctatgttttcaaactaaatattttattaaaatttatgaatagtgccaaatgagtgtaacttaacctttttttttatttcatgtagtttcaaatcctagacttgatacgaacgcttgcatttacaattttctaaatgtgtttatggaatagggtgtgcgtgtatatataaggggtgagtgtgcgcgtgttatgaacgtctatatttttactgtaattttaaagggtaaattggaaccatgccattataattttgcaaagtttgagatatgccatcggtatctcaatgacatgtaggacccacccgagtcaatgatatgtggatcaggatgacatatctcaaattttacaaaattataatggcatagttccaattttcctaattttttttaaaagaagaaaagtatagatgttcatacaccagaagtttaacctgaggaaaaaaaacatgaatctccttcctttttagggttatggccgttgtctttcaatttgaaccagttcagtgtttaccatttttattaccaaaggtccagtatttaccacttaattaacactgctagtggtgattaactacaactaattgtcaatctaacactcccattaactaactgcgtcatcgccaccgtcgtcatggcatcttctccagctatataaccatccttgtgcctctcttgccacacttaattagctcgttctcttgtgtcaagaaaaaaaaagaaagaaaaagctcgccgccgccgccaccgtcgccggcgcga

SEQ ID NO: 44329 - DNA, 234 bp, Oryza sativa
ccggcatcatgccggggttcggggcgggatacgacggcgggaaggcggacttacaggaggcgaactagttggtgacctgctcgtcgaggccctgggcgcggccgccggcgccgccgtgctgcgccatggggctagccatctggctggccatcttgctgcccggagaacatggcgtagaagtcggcctggttgaagctggacgcccgcggcgtgggctcgcgcgacgtctgcagc

SEQ ID NO: 44330 - DNA, 430 bp, Oryza sativa
taacagtaaaacaaaagatcagaattatacaaaatttaaggctgattatgtatgtaagatagataaaaaagaaggcaaaaagcgacagaaccagttaaatgctgcacctccatgtgtggaaggattatttagaaaaacaagaaacagaattcaagaaagaaacagagaaatatcgttgtactatgattctttctgcaagtaagatttttttttccctttgaattcttcccctcagaggagtagcaactttacaaagtcagacaagaagtcccttttcgtgaaaccaaattccttcaaaaattaggagtaattatgaccaggaatcatatttgacaatgcgctcattcaccagctcccagaaggaaagcaaccaaccaaagcttcattcaatctcaacatggcttagccctagagcaaaagaatcagcata

SEQ ID NO: 44331 - DNA, 1501 bp, Oryza sativa
atacccctgggacaaaaacttctaaagtttgataaaaaaattctgaattatcatattttaagtttttgacaaaaattggatgtttacaatcttatgtttataatattgatatttcgaaatttttgtccaaattttggatgtttttgttccaggagtattttgatcatttggataaaaaatgtataatactagggaaggttaaccagacggcgatggtaaattgtagaagttaagtaaaaaaaaagtgacatattgtaaaacgtgacaaaatcagtggtaaattgaagacatgtaacaaactcagtgacatataatggattttctctagaaatattgtgaaagtatagtggtgatatgagtgagcagatgaaaggccaagggcctttgcactcgatgaatttgcatatcatgattgcattgatgacgcagtagttacgacagggactcaaacaaaggcatgcagaaactgctgactttcgtatgcatttaacacatcactccttacaccactgatctttgctcgggcgtcaaaatcagcaaatatccatgcaaaaaaggcaatattgcaaagaaaataaaacggtactccgtacttcattagtttggaactcggctagccactgccacttggctataattacggtgacaatactttctagacaggggttggtaagctgctgctatgtactgatcatagccttgcaagtactaaaatccaacggtggcaaacaatcttgatgacgtgatgcaccatataggatgaaatggaattaactacatttagtatggaccaactgtatagatttataagattagcaccggccccatcttgtcattgacgctaacctatatccccaatcgcagagctgtaacaggccagcacctaagcccctccattgccaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcagccaacgatctccatgctgcaccgtcagtccatgcctagttttcttgcccccctaccaccataaatacgcacctagctgtaagatggatcacaaaacacatcgatccatccctctaccagtacataaacaagaaagataacaccaaaaaattagctagctcgccaatggccttgttgtcctccttccggctcgccgtggcagtggcggcattgttggtcgtcggctcatgcg

SEQ ID NO: 44332 - DNA, 350 bp, Oryza sativa
gccgctcattctgctttgcggatggggcaaatgtgatttgtggatactatgcagctagtccaggctgctgaataagctaaaagatgtactaatgattgatgttatagtttcaggtcttaatatggtttgttgagcaatttgtatccacaagaaaacctcaagtgtaagtgcagttttcacatcatttccgacatgctaaaaaaagatgaacgaatttcattggttcggggcatactaaaactttggaaaatcagttgtacacaaccatcttgaagattggcgaactatacttttccccataaatcttaaatcttatgtattcaatctatattccttaaagaaaaaaacaa

SEQ ID NO: 44333 - DNA, 1501 bp, Oryza sativa
tgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgctctaaactttttagtagtcaaacttctataaatgttatcaaatttataggaaaattgatcagcatctataacattaaattagttccaattaaactaacatttaatatttttttagtatgttcattttatattgacaatgttactatacttttatataaactgaaccaatttttttaaaaaaatgactagcaacaaacttaaaattaaattaaaattaaagtgacttaggatatgatgagacgaaagtaacagctctttttctctaacaacgaactggcgtacgtggaaggaacacggccacgatatcgtacagacaagagaagccgcttcgagaagacagccgctgtccatgccgacgcgactccacgcgcgccccgcgtctccctccgccgcagcagcctcgtcagctcgcgagatcaacgccggcccagtcagcccagccacatcaccgcccactccaccaccccaccccgcatggcccggatctaataaccaacggacgcggctcgcgggcccaccggcccacccacgcccgcccacgggatctctcgctgactcggacgacgacatcgccttcgccgctttcacagtgtgggccccgcatgtcggcgccacggggggccacgcccgcctgcgctggatccgagtcagcctcgcgtcgctgtcacactgacgcagccgcgtgttatcttaatcagccacaactttttaatgcctaacctttaaattaagccgcgacgagcactgcacggtggtcggaggaaggcgatga

SEQ ID NO: 44334 - DNA, 1501 bp, Oryza sativa
tttaccacattatttcgaaaaaaatctaaacaaatagatttaggccctgttctttttaaattattcaccggattattaaaaccggtaatttgctctacacttcggaaaacacgtttttctaaaaagaacttacttctattctatttgctaagtttatttttcaaaatatttaatgtatccctataatcaaaccgataatccgtgataataatctgttcaataatttatcttaaacagggcctaagcataacacaaagcataaacagcatccaattcaaacggatcaagacttaaataatcccaaatctagaaacctaagaagagcccatgactacctcgaaaggtagaaactttcaagggacccaggtgcaaaaaaaaagcacacgccaaaaattgattacttaaatccaaatccctcctccagttttgaagcccatcacggcagcaagaggcgactccctcccagcacttaacccaaccaattagtgccacttccagcttaattaatccatttgtttatatctccctcctcctcctcctctctctctctctctctctctctacgactcccacctccacctccgccatcccaatccgatctcccgcgagctccagatccacctcccgggtcgccgccgagctcgccgcggccacctcctcgccggaatcggccgctcgcgagctccagcccggtgcccgttttcgcgccattcgtgcgtgcgagctagcgagctaagctccaagagctgcgcctcctgcgctgcggtgaggtgcggcgctgtgtgagtcctctcgcattgggcttctggttgctcggatagcttgggtaattcttctccgtgcgtgatttagcttgattttttttggtggttccgattttttacgtgagcctctttttggtaaggattgtggcttaggctgtgtgatttagcgtgggcgtggttggtgcttgtggtggcgaagctgtggattggatcgagttggaaatggcgttctgggttagcgaattggatcgggatgatttggtcgtagtttgactttttccgcgagccgccaccatggacttgagcaacgctgcctgcccctgtggaaatcacctgatttcaacgcgtagatcacctgtttccaaccaattgcaaccgccagcttttgctagattcatcgagcagtttagaaatctccaaagtatgggagctggtagctcgcatcacagctggtcatagctgaatcgcgtactagacgcatcaagatttgtgcaaaaacaatcattggccaaatggaatgttgtttgtgattgtgcggctgaattctgtcccttatctaggagctttcttgattccttgattaatgttgtgcttacttgcaattgcaggaaggtgtcaccttgttagttccctcaaatttcattgggccctggtgtagtaacttcacatcataattaccagagtttgattactttgatggtggtaacttctagatgatctgaacatatggagaggag

SEQ ID NO: 44335 - DNA, 1501 bp, Oryza sativa
tagttctctgctctttaaaccggcccaagcccaactaagccaaagcccatagagttctgctcgaaaatctctctaaaaaagggctaagaagtactcacaaaccccaaaaattgcagagcttcatttattgcatcttactccaatggttactcttaaaaaaaatctaatcccggagagaatttgaataagagattgttcaatttgtctttaggattaattcagatttgaccatctatggttgtattgagctaatacttcatttaccgtgaacgtgtttttaaaacagttaaatggtttattttgtgcgaaaattttttaaataaaattttctataacaaaaaaatgtaaatatattttcaaaattataatagttaatgtttactacctccgtcctaaaataaagcagaatctgaacatatatagttgtctagattcatagctaaaaatgtttttattttaggacgcatgtagtaattatttatacgctaacaatgtgtcttgctttacgtgccactaactagctaagcccaacagctatatcaaacttacccgaagccttcttttaaagaaggatcatgtgcccaaatttggggttggagtaacggataaccagcgttcccagtatttgacaaaaaaaaaggcgctcggttttgtgaaaatttggtgcttcgagctggatcaacttgacaaaccatttcgtaaactggtctaatgatgaaaagatattaaatcaaagtgagtttcaattttttgacagaactgatcaaatttcacatgttttcaacagttttcacaaaaaaaaaaacttatgagcgatttacaatcaccgaacggtttacgcaaacactgctgctaactgtaaattgttctgcccgtcccaacactgacaaataaattcccggcaaacaattctctaacaaaaaagcttattaggcatttccatgttgatttaacctctggttatatatatgcacttcatgcaacagtaaaataaattatgcatgcatgcaccagtagaacgattaatacaactgaccaccagcactagcttaataaattcaacagagttaaaaagtgaaaaacaatcaataaacttatataacttccaaaaaagaccatctattgtgccaaacgaaggactggaatgtaattacgtaaaatcaggggggtcacggaaggatatatccttcctctcttcgtcccgcgcgcgcgggcaccaaacccccctcaaaacccctcctcctcctcgtcgccgtgtgcttcttcctcgccttccccctaacctcttccacgcgcatttcccatcgccgaattcgcgatcgatctcctcctccgccgccgaggaatcgatcggaagagctccccggaggcgagccgtacgtcctcctcctcctccgtctccggcggccacgcgcgcgatctcccccgacttccgcgcgccgcgaggtaagaggtatggttcccccagcctccattcctcgccgctccgcacgcacgcaca

SEQ ID NO: 44336 - DNA, 752 bp, Oryza sativa
atgaactgtgttgtgatatatgtcttaaatatcaatgagccatgctcattatctttaagaggctagccctaaacaaaaaacattaaagcactaaccctgggtattggcaccaatcgcacagatcctcagccaaacagaattctcacattaaaagttgattaaaaataatggcttcgcttacttaaccccagttctgttgcattcttgcatccactctcactagctcccttggttggcttcgatgctagtgtgctaatgcctaagggttcaccatgacattgtgttcatatgtccacctcaactgagtcagcaagggcaagttaaaaggatttgggtttaagggaaccatttttgctcaaattcctctggttgaatgaaagtgtgtgacttctttatttttttctttttttttggcaattggtgcacaaactactaggtgctagggctaagtgtaaactcgaaaagctttggctagacttgcaacgggctgaagtttatataatgattatgtcaataagaaaagttaccaagcaaatacttgatatttattcacctagttttagagaaggtatgtagcaagtagcaatatcctttagttaattgtgatgtatgaactttcttgtaagactcatctgatatctgcactattttcttttgctggaaagaaacttatagtattcataagtgaaatgtgcttggtttgaatccatcataccttaacaaaattgtatgtttctgtcttgtcttgtagg

SEQ ID NO: 44337 - DNA, 371 bp, Oryza sativa
cgtggtgttggcctgtttgggttgggtgttccatgagccaagacagagagatccaggtcgagacaaaagctaggtaagctggcctggtccgcaacgatgaatggatggatggacttggtaattaaaaaaaaaaagaacaaatggatctcatctcatctcatgcaccggcaggattccaaatgctggcccggatgtaagccaagaaatcacattcacaggtgcaagattgggcatgttgcgtgttttgtgctttgcacatggggggaacccatctcacattccaatggaaacatacaggaagtaaggtgttgatgggagaaaaatatatgatgttcaagtagatggtcatcgtgcttattcaactatcaaca

SEQ ID NO: 44338 - DNA, 160 bp, Oryza sativa
caatttgatgtttcatttctctgggcattcgatgagcggtgaatgttgtatggtagtatactgttatgaattactctacttattaatatggggggcaaaagaattcaagtttgttaggttcggaggttttgactcctggttttgtaatttgtatttgttg

SEQ ID NO: 44339 - DNA, 1501 bp, Oryza sativa
acggagtacatgtgactcttgggatgaactgttcctatcagagatattgtaacttttattggcatgtaaaaatacagtggaaaaatattttcttaagtcctattgattatttgatgttaatgctgcaattagactcaaaagtatttctttactcttgatttattctacattttgaggaattattgattgtgcagggactttgctgatcttaaatcttattcctgactgactgtcatgggcatggaacatctgctgaacaccgcgagtccttcatcaggttctagccatgctttaacttggtatgcattgtttcaatgtacaaggaaccactactgactgctcatactttggttacatcttacccaaaaggctttattgaggaaatgagggagctagagaagctgagaacagaaacaatgatgaaatcctgccaaagcactacaagcagggctggagcgataagatgtccagtaccacgcaagagtggcaggtatacttacaatccggttaactggttttaatatgattctaaatctaaatttctttgtccacaagacaattgtggtataaacaaacattgtcaaataccctcagggtgtgttcggatgcctctcttcccaacccctctccctcgttttccgcacgcacacttttcaaactactaaacagtgtgtttttttaaaaaaaagtttctatatgaaagttgcttaaaaaatcaaattaatctatttttgaaaaaaaaagcaaatactacctccatattttaatgtatgacgccattgactttttgtctaacatttgatcattcgtcttattcaagaaatttatgtaattatcatttattttattatgacttgattcgttatcaagtattctttaagcatgatataaatatttttatatttgcacaaaaattttgaataaaacgaatggtcaaacgctggtcgaaaagtcaacagcgtcatacattaaaaaacggagtacttaattaatcacgtgctaatagactgtcccgttttccgtgcgcactgcgcacattcccatcccctggtagcgaacacaccctcaatattctaatagatcacatgttatcaaattcatttcatcatagtgtctaattgtctattgctgcgttggattgcttgaatcatcttgctttggctgagtacattgccgtttgtgttctgcatgttcaatttgactctattgacacactcacttctcatctggaatttttcatattcagataagttcgggtattttgattttaactgcatagcatcggtgatttattttgctgttcaggtcatataaggagtatgatttaacacaggatctttctgatttcattatgagcaaggttagcttatctcttttctctttaccccatattttttggctgttgctcaaatgtgcttccaaattaagctagaaatgcaatctacaggcttctcctccatactttacgggatctccaccagttcgagcaagcaatccactt

SEQ ID NO: 44340 - DNA, 1501 bp, Oryza sativa
ggtgccgaatccctggaaacagtcttgacgacagggacgtacccggaataaaaaaagagaaaaatatgagcaaaaaggctcaagaaaagaaaaggtaaaaaaattctctttgttgttttgtgctaaaaagttatttgagaaagagtgataaatgcaataggtatatgtgtttagtgtttattcttcaacctatgtgcttgttaagatgttgcattataaatcgtatgaaaatcatgaattttgattgttgattcaagcttaattgtaaaatctttggttcatggttatactttaatgcatgcttgttatattatagatgggttcatcttctttttattgcaacacatgacttgatatgctatatgtatgctaagctcttgaacattaatgaacataattcctatgcttgatgaaatcattttcaaaagagggagaagtaatgtgaaaattttttggagcaaggtgaatttttggagagttgttgagaagagcatgttttttggttcaattgggaatttctttcttttaaaaagggggagaagttttcttttggatttttgagcacgatgtgtacgtttttacgaagtgtgctttttaccacttttgtttttatttttccaaacacaaaaacatttttaatgggtttgccaatgtgttcatcaagggggagattgtaaaatcaaaggtgtttattattattattttgtgatgaacaattggcatcggagattattggttttgttatttggaatttatttacgaagtggttttggagatgattggatttgcaggtgctgtgattttatgtggaccggttagaccgggcatgtgctgccagtcagaccggcgtgtatcgcgcggtcagaccggcgcagcccgcggtctgaccggccgactctgtgtcggtttcggttttgggttgtttatttggatatccgtgattatttcatgattatggcttctagatggatactatacgaatgtaatactgttgtttgctactaatgagtcaagttggagatagcttggtctcggaatatggtttctttgtttgttccatgtgtaggtgactcgatgcctcgggagagtatttgcggtgatagaccgggagtcggcttggggataagacgacgtccgtggtggtcagagatcatgcaggatacttaggctagagttgatgcacgtggttgatggagattccatatggcatacgatggagttattgtgtgcgtatgggatgcggagtcgaatttggaaggagtccaaatttggtacgattggttatgtaaagtttctttcttgtactagagggtttcctaaggtgtttaggactcctagtatgagtttggttcgtggctctaggctgcctacctcgggtataaatagagggggagcgtgaggcttcctggtatcgcttttaagagaaattgagttgagttttaagttagggtttcgagtttagtcaaaatttttgtaaggagtgctgtaggtgcactttgta

SEQ ID NO: 44341 - DNA, 1129 bp, Oryza sativa
cctgtcgctaaaagctccttcatgttggcgtcaataagagggtacctgaaagtcaccatcaacagattcagcaggtttacatgatgaattatgagttaaactgagaaaattttagaacaatttggagtactccatacccagttcgaccatctctccaagattgcaaacagtgcctgatcctggctccacttggactctacgttccttggaccccctacagtagtttaaagaggattatacctttttccagccaaatctaactattctacatatatttagctgaaataactgtgtattttcaggataaacaataaaagtgaatttcagagtgatacttctttttcatgcattatctagggacatgagagagagagttatatctttacctaggtgaaaaatggagttcccatattttgctgatatgaaccggaagtaatctctccatatcaactcaaataaaaccctgaaaacattgtcatatcaagaaagtatttcagtttcaccattgacttctaaggaagttggaaacccttaattgcaataatctataaatatttcacactccttacaaactttatagcatatgtaataactctcatttctcaaatagtataataaacgagagctgaaaaaccagagtttagaagtgataaaactctggagaaggcataccagtatgtagaatcatttgctattctctgcttctcatatctctttacctgcaccatggccaaaaatacagcatgagacaaagctactgatctccagaggttaccatgaatttattacctcttcacaaatataacgaggcgaaagactgccagaagcaagccaaggggagaacttggtggagtagtctggacctagcatgccattcctggtctctttgtagactttcagctggtctttcttccagaagtactcatgaactcttcccagagctgcactctcccctcccacgaaatgcattcccttctctgactatagagagaagcaaacagtgacagttacaacttataggtgaagttctcaaagcttatctgccaaagtggcaaagtacagttgatcactgaaaattagctcaacacagttaactgaaatcactgaacctgcctttgtcatgcttagg

SEQ ID NO: 44342 - DNA, 1501 bp, Oryza sativa
taaaatagtaaatgtaaaattagctgcaaattattcagtgacactgtcgctgtgacataaagctcccgcgttaactgttcagtgcatggtcggtggtgtgtggcgtcaggcgtgagcaacagtatgcaaacagggagggagatgagacagatcatcaaatctctgatcgatctctgacgatgagtgattgaacttccagaagcagctcccaggatggtccatggtgaagtcaggccaaaccgcaaaagccagaaaggaagccagcatgagaatatgcgtatcagcttattagccatcgtcgaaatttaaattttgaaatttaatttgaagctgattttagggtcttttgttgtaatttattttttggtattagcttctaaatcattaagaacatatcaataaaaaaattacccacaaattacttttaagtcgctcataagccatttactgcttataccagccctagcttaaggaaattgctaggatattagaagcactccaatatttgggatcccctaatatttatattagagccagttaattttgttcgcttttctatcaaaatttagtagggccaatattttagtaagaggttaatccaaataccccgtgtaaaccaataccaaaacttgtacgcatgcatttctctcgtattctagtgacaagtttggcagcaaacacaacacctaccataccaaagacatccatacataaaacaagacatggggaaaaaaataaagcaggaactgcaactgtaaaaaaaaaaggaaaataaaaagaaaatgaagaacaaagtagatgaacaagtccaacaatgaaaagagaactgaataaaaaccagagtataaagaggtactagaaggaaaaataggacttgatcggcagggattgctgttgtagcaattgaactgcttcagccagcatagagaatttcttccatcctcttctctctcactcttcttctctctggggctccgggcaggacggcgccgccggccgatgggtggggaggaagccggtgacggggaagcaaggcaacctcctctctgtgctcgccgacgaggaggagcggcgggcgaccgcggcggcggagctggagccacacgcgcggcaggcggaggtcagtgagctccttccaagtccaaatacggcgatgaggcgggaggaacgcggcgagaatagctggagtgagaccaacgaggcccatctctctaaaaaagcccattacggcccacacaacaaaagtaacaagcccattaccgaccatctcgctaaaaagcccaacaagccctatcttgctaagaggcccacctctctaaaatcatggaccaacttgctaaaaaaagcccaaaaaaggcccatatacctgccctttcgtctacctccagttcctctctctctctctcctctcctaaaaccctcgcctttttctgagactcagagcggcggcgagcgccggccggtcgccggcggaggagttggtgtggagagggcggggaga

SEQ ID NO: 44343 - DNA, 1501 bp, Oryza sativa
tcgccgatccgacatatccaatggtacgtgtgttcatccaaatgcgcatatatatatatatatatatatgctctatctatctttcggcgatgaattcgccgccgtccggccacgcgccgccgtggtcgcgcggcggcggccttcgatgagattccgatcgatggttctttcgacgacggcgacgccgatcgacatgcatatgcctgccacgccacttggcactagctagctccatctatcgattctttcttttctttctccctgctttttgcaatttgcatgccctctctcttccgtctccctttccgttctcgcttttggccttcgttactttcaaatctcttgacatgcaaatgcattgaaaaaaaacatattctcaaacttcataactcatcaggtccatatgtcagcgacccacgttaaaaaattgcattcgaatcgaccgacctctcttactgcaagctctccatttttctcaccgtcaaccacacaagatagcacatgacggctacagatcgaaagcttacacgaatatatccattctgaaagaagaagaagaaaaaagaggcatcggttaatttgcttttcgttgcagaaaagaaaccaggcgtacgcaactacgcatacatacatgtcggcctcgatccacactccaaaacggaatatatttctttttcccctccttgtttttcttggcccgattggccggccattgcatcgctgacctcttctccacccttgttgataatttgatttataatcgagtcgtcgttctcgccaattggccggcgacaccttcagctacctcttagattcctttcctctcatcgttttctaaaatcacacgtctacatatatagtaccgaaagaaaaaaaacaattaaaaagttcagataaacatattctgtcacctactgctaataataatgggaatattatactacgtcgtgttgtacagaaaaattcgatcttggtcagttggtcagacgtttcgcgtccttttctcccctcccactacctcccgttcgttgtaatttagctcatttcttcgcgttgccgatttggaaattggaagtttcacacgcagcatcgcttgttcttgttcttaattggttatctgactgcgacactacgtacaataataattaaggtagtagtagcagcatatttttttttcacttgtgtgatttaattcgtctccttgcatttttctggttctctgttgctgttgttctcttgtgccagcctttcgttttcctctgtttgcttcgatcgatctgaaactctcccatagttttactcgtctctgtctgacaaaattactactgtagattaattactcttttgtattaatatcatattttgcatcgaagcatgcaactggggttgcttggtcattttctgagcccgtgactgacgacgagacgaacaaaaacctcaccgtccagctctcgccaatcgatgctgatgcaggttgagtcggggagcgaggcggcggcgg

SEQ ID NO: 44344 - DNA, 1501 bp, Oryza sativa
taacttatgaaaacctcactgaccattgttaccctaccaattatgttcacaagaactctgaactttggccatgtagataaaattcagtctaactgatttcattttcagtcgttcaacaaaactttaacctacaaactaagcagaaaatcagtgaccaatactgaatttgtcatgattgtgtttcagggcgtgtcaccttcagaatctgtggtggtttggggcgaggtgagcgatgccatcctgaagaaagactgggagagatctagtcaggcgaagcgacgagtggaggacacggcgaggaggctagacagagagaggaacgacaagggagaggtctggattcccaagcatttctcgctgtctcaggacaagaacggcagctgggaatgctcgccgctggagaaatctgtgcctccagctccgatcattgtcccctcatgactgtagattacatgtaacagatgatcctatatatactatataaatctataacatagctgatgatttgattttttttaacttgtcaagtgaagtatggccgattctttgcgtttttatagttttcttcaataacagaattatctcaaacagtagctactcataagatcgggccgcatgacatagcctaagattggttgagctacaaccggtaagcggtagaaatatgaaaaaaacgatcatagtaatttatagggaaaacttttatatttatattatgaacggtctaaaatacaatggtagattacactaaattcggaaaatagactatgatgaaaaatcacaagatcagctttaaaaacaagtttaaaaaataaaaaaaattagctgcgacgatgagagcatacacagtggcaaatcatcgatctccgctgaaacagttagggagcaatttttttttcacaaatatgtgctatatttttcatttcttgtaatctatctacataatttcttccccacttgttaattaagttagcagtgggagaaacatctaggagtaatttgtaagcaagttttacaactgctatacatacacgaggagttctgaacttctgattactattgtcagtgtcagaaaatcctacaataactcttgcttgaaatggaacaagagcaatgcaggtagcagcagcagcagagaccacagctggttgtgccgcgtgctcgccgccgacgatgacggcatcatccgcttgctcgccgacgacggcatcgtcatccacgccggctgatcggcgctcccggcaccattgatgtcctccgtcggaggcggctggtagctgattatcccggcgccattgttgccagccggaggaggtgtgctgcctccggcgccgttctggccattggccggcgacggcgagctaatcagcggagtgacaccggaggtgttcgacctgtgcagaccatgggcaaaagatcgtcggaatgtgagtgttgagatgcgagctactcccttcgttttatattataagactttttcgaattgtccatattcatataa

SEQ ID NO: 44345 - DNA, 1501 bp, Oryza sativa
gcctcttagcaagatagggcttgttgggctttttagcgagatggtcggtaatgggcttgttacttttgttgtgtgggccgtaatgggcttttttagagagatgggcctcgttggtctcactccagctattctcgccgcgttcctcccgcctcatcgccgtatttggacttggaaggagctcactgacctccgcctgccgcgcgtgtggctccagctccgccgccgcggtcgcccgccgctcctcctcgtcggcgagcacagagaggaggttgccttgcttccccgtcaccggcttcctccccacccatcggccggcggcgccgtcctgcccggagccccagagagaagaagagtgagagagaagaggatggaagaaattctctatgctggctgaagcagttcaattgctacaacagcaatccctgccgatcaagtcctatttttccttctagtacctctttatactctggtttttattcagttctcttttcattgttggacttgttcatctactttgttcttcattttctttttattttccttttttttttacagttgcagttcctgctttatttttttccccatgtcttgttttatgtatggatgtctttggtatggtaggtgttgtgtttgctgccaaacttgtcactagaatacgagagaaatgcatgcgtacaagttttggtattggtttacacggggtatttggattaacctcttactaaaatattggccctactaaattttgatagaaaagcgaacaaaattaactggctctaatataaatattaggggatcccaaatattggagtgcttctaatatcctagcaatttccttaagctagggctggtataagcagtaaatggcttatgagcgacttaaaagtaatttgtgggtaatttttttattgatatgttcttaatgatttagaagctaataccaaaaaataaattacaacaaaagaccctaaaatcagcttcaaattaaatttcaaaatttaaatttcgacgatggctaataagctgatacgcatattctcatgctggcttcctttctggcttttgcggtttggcctgacttcaccatggaccatcctgggagctgcttctggaagttcaatcactcatcgtcagagatcgatcagagatttgatgatctgtctcatctccctccctgtttgcatactgttgctcacgcctgacgccacacaccaccgaccatgcactgaacagttaacgcgggagctttatgtcacagcgacagtgtcactgaataatttgcagctaattttacatttactattttagagattatcgatgccaagaaacaactcaacagaatctctgctcaaattaactgattattttactactagggctgtgtttagttggatccaaagtttaaattttggttgaaattggagatgatgtgactgaaaagttgtatgtatatgacaggtggatgtgatggaaaagaactgaagtttggatccaaactttg

SEQ ID NO: 44346 - DNA, 464 bp, Oryza sativa
cgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccactgcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaacacatatccatattcttatttctcttatatctgtatttcaataaaagcattttcgatttcctaaaggctgtatctgtgctg

SEQ ID NO: 44347 - DNA, 1501 bp, Oryza sativa
gccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctacaaaagagctagagaaccagagagctcttactctctccctctctgatcgttctggatccccctccgaaatccaaaatcccccttctaagtgggcaaggtcctccttttatacctcaaggggataccacatgcaccatctctctcttttttgtggggacttatcctatcttttcataaacagacagagacttgtatggttgccgtccgaatggccttctgatggaacggcccatacctacctccacttccgccggaagcaggcgcgacgtgggaacatgtctgtctgctgacgacatgaccagtgtcagaccggtcacaaatcggtcattcttgtccaccacgtgtcagttcatcaatctgcatgttcgcccctcttcatacaatgtcttgcttgtaatggttaggatgaagcctggtatatatctgaccgggaccaacgtgccatctccaggagctaacacgccggctctggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacttcatgcaccgcaaacgggcgaatgggattagtggaagcgtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtca

SEQ ID NO: 44348 - DNA, 201 bp, Oryza sativa
agccgtgagtctctcataaacattggctgatactgcaattaatatatgcactgatcatgttaagtagtactactgtatatttgtagtgccagcctaactatttaaaaatacgaaatggcattgtactagccgtattaataccctagaaatccccgacattttgtgctgttcacgaggtggaggtgcttcttctctttcagg

SEQ ID NO: 44349 - DNA, 1501 bp, Oryza sativa
tgtgaacctttttttttaaaggaaggcaaaagctttgtctcgtaaatattaatagagatggagaaaaaatagatcaaaaatatgtatagggtaagcctcgaaagctaaacccacaggaacccaccaaaagagattaagtgatatctcccaaaatatcgaactcttgaagcttcgaggctctagccttgacccaagctcgagcttcctccttgatcttggcaacgatggacaccggcgttgaggcggtgcttcggaagattcttgcgtttcattcgcaccaattttcccaggaaaccaagatcaccagggttcgtaaaggaatgcgggggttatcaggggagtctaccacaaggctccaccattgttccaccgagtcatagtcgctccatttgctcatttggaggtgagtttgggtccacctttgtatttctgtccagaccctctttgtaactctgcagtgtgccagaaggtggaccgctgattatacagcacagcgggtaggtcttctgattttgccaacctcttttcttgaacctgtcagctgtccagagtctattttgggtgactagctaggagaagaatttgcattttagtggggcccagcgtgtgcactttcaagtagtaactaaacagtattatctattcatcgacagcacaagagagttcagagcccattcgacttgaagtgaacatatataggttttccaagaacttgcctatgcagtgccggtgagtctctgcgcgtcgtccctgtcgcggttgaagatgaaattgctcttgtgatcaagcaaatcgcggacagcgatgaagccgaacacatggagcggccactccaatccccctctcaattcggttaccttccatgagtagatctccatgcatcgaaaggtttgtcgttgtaggtgtggctcattggccctctagtagctgcaaaattaaaaaatatatataaaaaatagataaatcgccatcagttaatcgttcctccaactccagtgcgtggaacaagaagggttgaattgaatcaatagatcaactacactggatcaaatcgcaagaagaagaaaatgtactgatatcctcgaaaccgcacacgtcggcccaaaaaagcgagaatatgaaacggtagtcgtcagggttgggctcctcgtaatctccggtccgcggcttcttcttcttcttcttctcctccgagtcgctgctgcggttgatggcggcatggttgctttccgagtctcactgttttgctgtgctgccgaccaactgcactgcaatatgccgtttgcagtcttcattttcaagagggttcttttagtttgtatgagcctttcaattacgtttctgtgcgattgtatgtgtaatgttctagcagcagtcatcgattataggttccattgtttaaatcctgctcacatagtcacatattttgatgcagaaattcagttaaaatgaatcaatgctgttatagctggctgtcttttttttatctataaagatatac

SEQ ID NO: 44350 - DNA, 614 bp, Oryza sativa
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 44351 - DNA, 242 bp, Oryza sativa
tagcttgtcaaaaatgttgtttacagtttttttttaaaaaaaaaaatttgtggaaagaaattgttgaatcgatcactccgtgacatgaaactacaagcataaagaatcagcacatcgtttagcttattcagatgctagaacaaaatgtaagtcgcattaataatatctccaacatgaataagtggtaatggatagaatggaagcgaagccagctttgagaggtgctaagttaagcttcatat

SEQ ID NO: 44352 - DNA, 1501 bp, Oryza sativa
taaacagcacttgtggatatttttaacatgtagatctcaattttagaaaaatttagagacttgaaccaactaaatccgagctaagatgaattagttatgaatttttaaagattaaatcggattaaatcatttatttagattttaattgaattatgacgcaataaagaattatttttgaaaaggaaaaaggatttattgcgtcatcggctcgggttcacggtgaaccgggtgcacggagacggtctacaaaacgaacggccgagatctaatctaatccaaacgaacggccgagatctaactgatctaccgcggtctacggctgacatggcgctgacgtcgacgatgacgtcatcaccggcggcgactcggcacctcgtgctcgccggcgaacgacggcgcggcggcgcaaacgagggcaccagcgggtagtgggcgacgcggcgaactcaccgaaggctcggacgacggcggacggcaaaagacggcgacggcggtgaggtcgaagcggcggagacgttcgggtcgacgacgacggcgatgctccggtggtcctcggcggaaacgaaggatgggacgaggacagcgacgacttggcgaacccgatggcggccttcccgagcgacgacgacaaccggagcggcggcgacgcacgactggacttgcggcggcgacggcggcgcacggcttgacgcggctagagctctaccggcggtggagggctaaggcgagggtggcgacgaagagaggaggtcccgggggtccttatatatggggtagggggcagcgatggaggcccacggcggccggcggcgagatggaaggtttaaggttaggaaagaaaatcaaatccgaatcgagatcaaatccggcgatttccaaacgaaattagatgaagtttccaaaagagaaaaggaagaggagatcccgaggatcatttcccctctagcaatttgatcggatcgggaaagacgcggccgaatttggaaggaggtggcggcggcttgcgcgcggctagggcgcggctgcggcgggaggaggaagacgaccctgacaggtgggccccacctgtcagcgggagagaggagggagagtggcggctcggctcagcgggctggctgggccgggcgcgcttgggccggggagagagagagggggttttgggccgactttcggcccaaagctaaaagaggactttaaaacctttttctttttaaattattcatgaaatgcaattccatttattaaaaatactttcttggctcaaataaatcccagaaaaatctaggaactatagaatcaagtgaagtatttaataaaattttatctggcccacttctatattggaatttattatttaaaattagatcttttcttctaggcttttaaaatcatttctaataattcaatttaaacaacaatttataaatttaggattttcagggtgtgacaaaaaccaataatctccgatgccaattgttcatcacaaaataataatcaaaaa

SEQ ID NO: 44353 - DNA, 1501 bp, Oryza sativa
taaacaccttaggaaaccctctagcacaggaaagaaactttacataaccaatcgtaccaaatttagactccttccaaattcgactccgcatcccatacgcacacaataactccatcgtatgccatatggaatctccatcaaccacgtgcatcaactctagcctaagtatcccgcatgatctctgaccaccacggatgtcgtcttatctccaagccgactcccggtccatcaccgcaaatactctcccgaggcatcgagtcacctacacatggaacaaacaaagaaaccatattccgagaccaagctatctccaacttgactcattagtagcaaacaactgtattacatacgtatagtatccatctagaatccaaataaacaacccgaaaccgaaaccgacacagagtcggccggtcagaccgcgagctacgccggtctgactgcgtgatacacgccggtctgaccggcagcacatgcccggtctgaccggtccacataaaatcacagcacctgcaattcaccttcaaatctaatcatctccaaaaccacttcgtaaataaattccaaataacaaaactgtcacgcccggaatttctatccaaaattccaaacgcttacatgtgtgtaaaccctcgtccaggaatcagccgaggcacacaataacaaattgataatagagtacaattattactctaattaataagcgaatataaagtcattacagaggtagatagttcctctcaaacaataaaaatctaagcagcggaaaataagataaacggcgcaggcgtctccatcccacaagcagcttgaccagcgctacgcctaatcctccacaccttcagcatcactgtagaactcctcctctgatgaatgattgcaaggtgagtatatgacatactcaacaagccacgcaacaaatatgcaagtgcaggggataacaaaggatggcataatatagtctcatttgcataaatggcatttaataaatacttcagaatttagtaaaacagtaaagtatttaattaaacaatattaatccaacgatatacaacatacccgttgtataggcccaaccattctgaataaccattctcggctgcacagttctatctccaaaccaggaatacatcattccaaaccaggagctaacaagttattaccaattacagcatcatttattatggtgagaggtatgagactaatcacgaaagacattgttagacccgcccataaccgcgggcacggctattcgaatagttttactctagctagaggtgtaccactgtacccacaagacacaacctcaacatcatgtcaaccatgcgtcgcaatacttaacaagtacccgaatagagattgtgacaataccattcgcataacacaattaaaagcagtacagcgttcctggatcataatcacccccttataaacaaggcatggactccccagcgacccccgtgggcttatctccgccacttcacagtctggtgctccacaa

SEQ ID NO: 44354 - DNA, 602 bp, Oryza sativa
gcaggtttcacttgcactctatccattaccactcattaatatctatccattaccactcattaatacctgagatgggattaatgtgacttacaatttgttctcgcatctgagtaagctaaatgatgcatcgatgctttatgcttataattttagatcacaatatggtcgattcaacaattttttttcatgaaaaagaaaaaccaagtgtaaatttgacttttacaacatttttaacaagctaaaaatgagaaacggactacatcgaattggacatactataaaactttggaaaatcaaacaccaacaatcatctcaatgaaaactgaccaaatactccctccttcccaaattgatcatcatatatgcttatgcaccaagaccaaggataatttaaatcacatcaatcaagacatcaagcacacattctcccacaatgcatgcatcgattaaaacaccatgccaattacaccttagcatgcacatattctgccatgctgcagtaattgtattctgatgaaatctgtgtacatgcaggtatatgatgattaatttgagaaattttgaattccattatatgatgatcaatttgggagggagggagt

SEQ ID NO: 44355 - DNA, 1501 bp, Oryza sativa
cttacaaattgacactccaaattttttgttttgttgtactacaccaaaatattctggcaaaccgccactggacactgcatcttcattgaaatataatatgtacttaactgcggaaacgtaatgaccgggacatgtctatttttccacatatctcgcgcttaaaagaatatagtctgaaaaaaaattcaatactttcacaccctgaaattgaggcttcaattatttgacattgtggcccaatatcattaactcagcttgtcctatatcccatcatcacgagtgtcaacattatcaaagtggcaacaaatacaatgtcaaattagcaattctctcattaaaaaagaacatatgaaggccaacttcatttttggaacatattactttcttagagatttaagacaacacaatttcaagaattttagtttagaattatgtgctttggatcatacttaccagcttaaaaaaataaaacgtctaaaacagaaccaaagaacatttttaaaaaagccttatacatataagcgttcacacatatatgataataacttaaagcaccatcaataagatgcccgcgcgtgtgcgcgggcttccctcctagttgtccacaaagcacaaaaagagtcagccgatgaagcaacaagagaagtcatcacaaagcccactttgaaccgaaggaaaggccatagaacgatcctacaagtaaagcccaaaaatgtcgagtctttagggccgagttattactgaatggcatgtaccatcaatttgtcttcttgtgcagttatagaatccgattgacccgcaggccgcaggcagtggttgctcaatgcacattttgtttcagtactttatggaagcctcctcatagctacatgcctgcatttttttggtcgaatggcctagaaatctagaatcctaccctttgcgactgaagacgtgatctagctgtcgtccatctcttcgaggttagctatctaacctggtcactggtagccatggcatcaacgacgatcgacgagcttaattaattaacaaatgggatcaatatccatgcattgttgggcgttgataccatggatagtactatcaactaaagttttgctagctggtaccctctgtttcaacagaaagctcaattgttccatcattccatacgtgcacgctctagctcaagcattccactgttttccaagaacagcttgcacctacctaaccttgctacccatctgcaccctgtttcacacaattcccattcatcgctcatggatgtaacatatccacggcacacaaggacagactagcctagctagctacacatcttaattttctgttaattcatgccatcgatcgatccatcgatctggagtatatataaagacgtcacccctgcctccaatcttcacaccaaacgtaaatcccaatcaaccaagctctcaagtacgtgcttagctagctagctagccagtaactgaacatacattattcatagtgattagtgagctaa

SEQ ID NO: 44356 - DNA, 1501 bp, Oryza sativa
ttgaaacgagtccaaagtccacaagattatgattatatatcgacgaaaggagaatctctaatgccacgtagaggagcagaaaaaatccgaccgtgcagactcgttttctctgagaggtcaggtggcattttttaaataatctgatgaggcgttaaggtttggtaaacttcgttttaattagagtttaaagaaaggccagttggtgattttttaagactaaacatcagtacatattcgtgagctatacgttagtgtctactacccctctgagtcacacacggttgagctgaaattgaatagactgttcttgatgaaaaataacaattttgctctagacaaattttttgtgtggacgacatgacaaagcaattaaaaaattttcatttgcaagatgatgattgcaataaattaattaatgtatgaacctcctatatttccatagtttgacagtcggcacagtgggcaacatcaggagttggtgcttcagattcctttttttaaaaataattacaaaaataattgcgtgctgcgaagttagtttttcctatctatagcactaatcaaattatgaaacctgtcacttgcgatatcattcgacgaatgtctgcttcatattggcatgcatgtgacaaaactactgcgtgctgtggttgtttaattaggcctgcatcttactcgtacttaagtactcaatcccaatattaattacctggttggttgatttgattagtcaaccctaggaggaggataaggattgattgcctctggagatctgggtctgctggtttgtcatggtctatagcacttgcaattaaatactacttcgacacagcactctgcaataaaatttcgtaaagatatgccacttgtgaattgcgtttctccatctcaaagtacaccacccattgcattaggtaagagaaaatgatattaattgcagtacaaatcaattacatgtgcatgctgtttaagtcaagatgtaccggatgatccactcggtcaaaacaacaattaccagcggattttacctatcaaaagacatatcactatcgatgccctactagtatatatgtcatcactatcgactaatagtgcaaacgaggtcgagcgtgtctacactacctttagatgtcaacatttcgtactatcgaggaaacgtccgcacttattaaaaaataaattaaaaattattacgccattaccgtgtcgaaattttactggtgccttgactcgctcacactgtcacacatattgggatcgatgacccctgaattttttgttttggagctagacgacttggaattgcaagctttgcaagtcataaaaaaaacacgaagatggaaagaaccacccatgttagtgttagtgtgacactacgagagaagagaagaagaaagacccaaaacccccggcaaaaacagccaatgccaacacaggccgcacccacatcacagagagggaaagatcctcctcagcacgtgcttcctccggtccacgcagc

SEQ ID NO: 44357 - DNA, 1501 bp, Oryza sativa
caatcccaatattaattacctggttggttgatttgattagtcaaccctaggaggaggataaggattgattgcctctggagatctgggtctgctggtttgtcatggtctatagcacttgcaattaaatactacttcgacacagcactctgcaataaaatttcgtaaagatatgccacttgtgaattgcgtttctccatctcaaagtacaccacccattgcattaggtaagagaaaatgatattaattgcagtacaaatcaattacatgtgcatgctgtttaagtcaagatgtaccggatgatccactcggtcaaaacaacaattaccagcggattttacctatcaaaagacatatcactatcgatgccctactagtatatatgtcatcactatcgactaatagtgcaaacgaggtcgagcgtgtctacactacctttagatgtcaacatttcgtactatcgaggaaacgtccgcacttattaaaaaataaattaaaaattattacgccattaccgtgtcgaaattttactggtgccttgactcgctcacactgtcacacatattgggatcgatgacccctgaattttttgttttggagctagacgacttggaattgcaagctttgcaagtcataaaaaaaacacgaagatggaaagaaccacccatgttagtgttagtgtgacactacgagagaagagaagaagaaagacccaaaacccccggcaaaaacagccaatgccaacacaggccgcacccacatcacagagagggaaagatcctcctcagcacgtgcttcctccggtccacgcagcactgtgcacgaagtggaccagccgcgccacggcgacgacgcgagcccgcgccacgtcaaccggggccccacctgccaacgtgagatgagacgactcggacgagacgacgccgcggccgccataaatccccaatcattggaagcagttattactcgggtagatatcatgtaaaacgagctaattattagaaactttaaaagttttgttgtacactcgtaaaaacagatatgaaatacattttcattaaatttgaaatccaaactcaattttatttgagagaaaaaattgataaattttagacgtgtttactattcatatcaaatttatctttttgtttcactctgatacaaagtgaagtttgaacttgatattttgtgatgagaatatatttcacatatacatctatctataataatttttttcataaatttagaaaacttttaaatataatttccacacttttttaatacttaactcgttatcgctgtatatgtagtaactcgttattcatccatccatccagcggatagcatttttcgcatttctcttttcttcctttattttttcctccttgtcgctgccgttgccgtcgcgaggcgcgggggggcgcccaccttttctacggcgtcgttgcgtgcccggggttctcttcttagctgcgtctgcgttgccagccagcctcatctcctt

SEQ ID NO: 44358 - DNA, 187 bp, Oryza sativa
gctcaaatgtctttgctctttcattgctcaagactagcaggaaatccatagctgacgtcacactctcgctcacgaattggtattggcggtaacgtggcggtattgcctgacccgttgcgaacctcgatatcacgctttcaaaacgcgatatccactagttgacactagggatgaggaaaagacaagg

SEQ ID NO: 44359 - DNA, 382 bp, Oryza sativa
ggtatgtatgcacatgtgctctcctcttcctccctatgtttttttctcgatctatttctgtcggggggtttgatttagttagggatggcgctccatcgtacctgcttgctagttgctatcgtgttggaaggtgaggtgatgttatcgtgttggtcatcgtcagcgctgcgcctccccaagtttttaatttaggttcccttttgaagaggtgttgaggatcattacatctaaacataccattagtataattacatcgcaacccagtagtattagaaagggtatgtataacccacataatttttgcaactacaagatgtttcttaagagtgatcaatgagcaacattagttttttacaacatacacctttgtcatctcgcagat

SEQ ID NO: 44360 - DNA, 881 bp, Oryza sativa
cctccccccccccccccccgccacgctcgctcctagctgctgcaatatttgagaggagaagatgagagcaagtgaagaagaggataagggagagggggaaagaggtggaatggtaggaggaaattaaaaagataaggagcaagtgtttgcgatagtggaggagaggataagtgcgagggattatatatactacatgttaaattttagtcccgattggtagtaaagattatttagatctttagtccaggttataagatcctcagccccctgacaggccactgacaggccttatcagggatgaaccgggactaaagttccaatcgggactatagatcacatagttccgatggaatttttaagcgggactaaaaatgcttttttattaatctagtttttgactgacccagcaaaggtcagttctccagttgtggtataagtcaacagttaattaattgttcaatactacttactccgtttcaggttataagacgttttgactttggtcaaagtcaaactactttaagtttgatcaagtttgtagaaaaaaatattagcatttttaacccaagacaaatttattatgaaaatatattcaataattgattgggtaaaactaatttagtattataaatattactatatttgcctataaactcatctgtgacgggctccaactccaacccgtaaaaggtgactcggtcccttttgacggggtactttagagcctagcacggatgactaattggtgatatagtcctcttgcaactcaataacaatgttgcttatagttggccaaaagcccgaggcctgatagcccggcccggccatggcacggggttttggtccggcccaagcacggcacgacctctactttggcacga

SEQ ID NO: 44361 - DNA, 367 bp, Oryza sativa
ctgcagccctggtgatatttgttctttgatgtgtatggtgtgtacacaggaaggcttatatgtataggatacgttcttatacatctatgtgtatttcttcggaaagaattattacacatcaagcattagttatggttttccacgtgacctagcatcctattcgtgtccaagttgaaaggagcatatttatcattgagatgcccatgggctcaccagcaagcattgaattccaatgtattctgaatgaaacaactcacacagctcatcctccttgtcttggtgtcatggtgacatatatacattgtgctacacaactaagtaatataagctggtagtttaagctggccatacatgcatccatcatcca

SEQ ID NO: 44362 - DNA, 1242 bp, Oryza sativa
agcttgctattcacatctgaacatatatctgtagggggagattagttttgattaatgttgtgctctcaagtttgacaatgtttatgatatcttattttagatttcaaaagaggttctaaaaaaaatgattattatatatcacctttttttttggcaagcggtgatgaacagaagaagaagtatagacttacaagatgggatatgatttgtccaaaaatcaaggtggtcttggagttcctaatttacaaattcaaaatcaatgtcttttgagtaagtggctatttaagttaattaatgagcaaagtgtttggcaagatctgttaaaaaggaaatattttaataataaatctctaacccaggttaataggaaacaagggaattcccatttttgggcgggttttatgaaagttaagaatacgttcctaaatatgggtttctggattgtgaataatggtgaacaagttatattttgggaggataaatgggttggtaactattcctttaaagataggtacccatctttatatgctatagaaagaaggagaaacttcttggttgcaaatgttatgcattccgtttctttcaatgtttcttttaggagagctttagtagcgcagaacctgactaattcgcataatttgtatgcttcaattgtgcatcttcatttgacagagtagaatgatatttttagatggaatcttctcggttcattctatgtacttaataatggttacgttgaaaggaataagtttacttgtaaactcaaaatgccttttaagtaagatttttatgtggtaaagggtttgtctgaacaaaggataacttgactaggaagaattggcatgctagtttgaaatgtttgttttgcatgaaaaatgagactatccatcatttatttatggactgtcattatgcaaaatttctttagagagaattacagttttcttctggtttaaatattccacatagtatatctcatacctttgggaattggcttatggggattgataaaaaatctaataaacttattttgctaggagcttctgctatatgttgggctctatggttgaatagaaatgatatggtttttgacaaatcaccatctatatcttatatgcaggttctttttaggtcaatacactggctctggtcctgggcataactgtaaaagtgtgaagaagatatcaagttaattaaagctgcatgtcgtaatgttgagttaacggttatgcaattttttac

SEQ ID NO: 44363 - DNA, 1501 bp, Oryza sativa
cggggctgcaggggttgagaaaggcgtagggatcagatcatcagagaaatgcgggagctttatccccacagaaaccctaaagtaatcctcttcttccaaaatgattctatgaaagaaagtcagaagatgaagatctgaggagaacctggagcgacgacggtgggttcgtcctcgacggttgggccgccgtccgcggttgccgtgtcctctcggcgcggcttcttcgggaccttctccgcaacagtcgaagccttgttcttcgtcatctcgcagtatggataagaggccggcggggaggagaatgaagatcaaaaggcaatggtggaaggaagattagagaatgaaagtgaaagggcgtcgagcgaagtgaacggctcgcccctgtggagatccccttttatagcccgatggcccaacggttcggtttccgagatttttcccacctaagttttcgggagtctgttgaggaaagtggatttagacttcaaatcaaatgaacagatactagaaccctggcattgtcctcgggatcaccttgccttctcgaatttccgagaacggtcataagggctcacatagacaaccgggtacgaaacagacatcggatgacatttgagttgaagtcgggggctactgtcaggattacggataaggggtatcctcgttacccaaaaatacagagtacaaggaaaggtatacctgcacgaatacagaaagaagaccaagatatacaaggaagccataggagaatacggaaggagtccgtataccaagactaagacggagacctactcgtagaagataggggctttcctaagccgtgcgggcctcacggtccgagtcctacacgaggactgctggtagctcacggtataaaaggattaccacccctatgggtcgaggacggatcaatcaagccacaacagaagtcagaagcataattccgtagccatagccaccaaaaccgtcgagattgtattcgattcttccgactacgatttcaccggattcctgtttccacacattgtactctgtactcgggatctttcccaccagcaatcccatataaactggaagttgggttattaccttctcggggcccaaaccagtataaaatccttgccttagctttccagcgatgtcgtactacattagtccttacgccaacgtttctatgattgctacataccccgtctacggataccagccgttgacagtattgatagagaaggagggagaggttgattctgggatttttcaggttaaactgatgggccattttttctatggcgcttgcataaacagtggatgaaaactttgctcagcgcacatctatttttctgtcgatgactgataaatcgaatacggggtcgtttgtacccagaaaattcgttgataccaagactaacaaaaatacatgataaacatagagggagatatatttttatacaggttcaaccccgtcaaggttagtagcttacaaaagcacgtagcgatgtag

SEQ ID NO: 44364 - DNA, 1501 bp, Oryza sativa
attatatggcatcgatcaatgatggtcactttctaggccaacttttgcgatgtctctgcatgcggaaaaacggattgacaagtcttagcttatcgtcttatccaggcatccatgcatgcgccatgaagagagagcaataatgctctgttttttacgtcctctgtttcgaacaaacgaagctgttgaaagcagagtactgctctgtttttccgtgacgaatctgttttcccacactgattttaccataccggcagcgcagcacacaggaagaggctagctaacatgcatgcatctcctgccctgttatcaccaaaaaaaaaaaacaaacatactcatgagaattcgcttttgtgatagacaagtacccaaaaggaagatgagtggcctaattccctgccccttgcgcaaacgacaatgcaatatttgcagaatgctatccagctgttgcccttcaagatgtatgaacaacatcctagtacatacatactccctccgtcttaaaaaaaaaaagacaaaccctagatttccgtgacaacgtttgactgtccgtcttatatgaaatttttttataattagtatttttattattgttagatgataaaacatgattaatactttatgcgtgaattatctttttaatttttttataattttttcaaataaaaaggacgatcaaacgttagacacggaaaccagggtttttttagatggagggagtacagcacgacacgattagttagttttggatcgagatcgaccagcaccgatgacgtggtagccgctggtcgagtcaacggtcaaatctcatcaacatatccaacccacatgcatcaaatccatccattaacctatacgcatccaaatcacgcacaccacaatagaccactacctaggtgcctagcagcagctagaccccaagaaaaaagattgctccctctggttttcaatgtttgacactgtttacgatagaatatttgaccattcattttatttaaaaaatttatctaaatattattctgaagtatttattttgttacgagttgatttattacaaaagatattttaagcatgacttatatttataaatatttaaatattttttttaataagacaagtggtcaaacgtgcactacacaatcaacggtgtcaaacattaaaaaccggagagtacattacataatcacaaatctcttcttctctacatttaagcaattctacggtacttgaggagtgtcaaacattaaaaaccggagagagtacattacataatcacaaatctcttcttctctacatttaagcaattctacggtacttgaggagataccatgaggtaccaaaattttagtgtaaaggtaacataagatatcaaatttataatagaaaaaataatactttatagtacctacttaagaaccgtaaaattgctcctctacacataggagtacatcagaaatcacttcaagcaagctcacagccactgtacactgacactgtcgttgca

SEQ ID NO: 44365 - DNA, 1429 bp, Oryza sativa
caaagataattgattcagtcttggatgcctttttgagggaggagaaccaatttttatcaccggtcatgtgccgcaaacaaccggaatccacgatccacacgttctccttccttgctaccaaagcctacacacaaacagaagtcgaagcctcagtactggggttagatgataataaaaatttaggaatccagtactgagacacacgaccaaaagatccaataggcatatatccacgtgcaaaattaattttagaattttcagaaaaaatcctctgaggccggtctgaccgagggtgtgcagccggtctgaccgggggccggtttgaccgaggcttcaccgccggtctgaccggtggtcggtctaaccggggctgttcagctggtctgaccggtcgccggtccgaccgcgggacccaatgcggtatgaccggtttcctcgagggaaaacccgatttttgccactttgattttgcaaaagtaatctctctctcctttttctgtttatgagctaatgtgaaacaaaaaccaacaatatattcatctttgccacaaaaagaacaagtatacttttcacgttgtttagacacattattagcattagaagatttagcaacacaagcaacaacaggaggttttgcatgcacaacattggattttgaagaagatgcattcaaggtagacatgatgccagcagatttaaacacagttttattagtatcaggtttaaccaaaatctcaccacttctagcaccaacacctaacacaacaggaggatgtctagaattatgagcataagaattaaaacctaaaccacgattatgtgtgctaacctttgattgatccaaaatcatgttgaggttctttttaccatcagaaaatctttgcaaagaatttttcaaataagaaacctctttttccaaattagcacaattttcacaatctaccatgacacctttgcttttatgacatttggggcagaaagcacttcattgtttttcacaacatcttccatgtactcaacacgacctaaagcatcttttagtttcatcttattcaaattacatattaagcaatccaaaacatcatgagattgttttaactttttagcagaaatcatgttaaacatcaaactagcatgaaaagtaatttgatatttttgaaacaattttttagttaaaaacaacttatccaaagtgcgtgtgtgcaaagcaaaactacatgtttgatggaaacaaaacaacgaacacacagaaaatagggaaaccctgtattttattaatcatgattcattaacatgaatgtttacaaatacatgagagctcccgcaggagttcgccttttgccttcgtgaggaatgcttaatgaaaaggtatgctgactggagattgcgtgcagtccgttgattcccgacgcctaacaatgaggctacc

SEQ ID NO: 44366 - DNA, 1501 bp, Oryza sativa
gatgctgctgttgcatcatggctaactgaacattcgacggtggcgcgaagttattagacattgcaaatggatcgttgggatcaaatgggtttcctgcaacgctgccgttgtaggttgcactggctatttgctgcctccttgcttcatcttcatacaggctgtctagcagtagcttgtcaaatcctccagcctgttgggcaaatgcagataagttattagctattgactgattttagtagtaacttggtatcagctgcaaattatgattatccttcttgctagtattgagctttctgaaatcctgtatagagtggtaaaaaatacagcaactagaaagaagataattaccaactgattgtcaactggtcgacttgtgtgggtacttggtgcggtaaccagtgccaattcccacccagacttgtccagcgcaaacaaatcttgtgaagctgaggccttgttttcattccctgaaccatccatagtacaatatttagtagcagatacaatctttagaaactaaaaaacagtatccgcacatgaaaataggatcgacgatgataaaatgcattcaatgctgaggtgttgtccttatcagctacttagccaattatcctatatgacaaatatgagtgaaagtagtatatctgaaccagagattgcatctagtatatacctggtgccacaattgcagagccagtgcattactttcttcaatatttgcaatcagggggtttacttcttcgtcgaaattctgcacgcaacatagaaatcagcgtggaggatgcgatgaaataggcactgagttggaggagatggaacttactaacagatccccagtagttgctagtggtaccggctctgttccttccacggactcagctgtaggctgtggctcttcttcaggctctgaaggttcttgttcctcctcatccactggtttctctgtttcctgtggagcttcatcttcgttatcactaggtgaattctgctcctcgctttcctgtttcagcagcagaaacaaatcaacagaactgctgtggaatcttctttctgctatgaccttctctttgtagttgtaccaaccgttaacgcactcaccaaacttttacttgctatgctgacacggggtgcttctctgatgtactcttccattgttataaggaatgaagggggaggctgcatatgggtaatccatcaaaacaccatgaaatcattgtaactggagatttagcagataggaaataactgaagtgtaatatttatacataggaataggcaaatagccaagaaaaaagtaaagaaaaccgtaggccattatcacgtaaatgtgattttgacaacgggtactaattaggaatgtttggtatatcaggatattcgtgcttctttccgcgtccgataaaactatttcgttttatgtagaagtaatgaacctactgaagtcaagattgggaaggattcttcaatttaaaacagggatgaatcactgaatgaatgtacc

SEQ ID NO: 44367 - DNA, 1501 bp, Oryza sativa
atgactgggcaccgacgaggcaaaggtcacccgcttcaccaaattctctccgcactccgacgtggtggtagtgtactgtgaccgggttttggtgaaacaaagccatccgttccacattcactgtattcaacattaaatctgcaccaacctcaaccttcggcgagcaaacaactttgaagacgacgatcataaagcgcagcttaatcggaggtattacataggctcgtcctgtggatgtaattaaccggtagcctcattgttaggcgtcgggaatcaacggactgcacgcaatctccagtcagcataccttttcattaagcattcctcacgaaggcaaaaggcgaactcctgcgggagctctcatgtatttgtaaacattcatgttaatgaatcatgattaataaaatacagggtttccctattttctgtgtgttcgttgttttgtttccatcaaacatgtagttttgctttgcacacacgcactttggataagttgtttttaactaaaaaattgtttcaaaaatatcaaattacttttcatgctagtttgatgtttaacatgatttctgctaaaaagttaaaacaatctcatgatgttttggattgcttaatatgtaatttgaataagatgaaactaaaagatgctttaggtcgtgttgagtacatggaagatgttgtgaaaaacaatgaagtgctttctgccccaaatgtcataaaagcaaaggtgtcatggtagattgtgaaaattgtgctaatttggaaaaagaggtttcttatttgaaaaattctttgcaaagattttctgatggtaaaaagaacctcaacatgattttggatcaatcaaaggttagcacacataatcgtggtttaggttttaattcttatgctcataattctagacatcctcctgttgtgttaggtgttggtgctagaagtggtgagattttggttaaacctgatactaataaaactgtgtttaaatctgctggcatcatgtctaccttgaatgcatcttcttcaaaatccaatgttgtgcatgcaaaacctcctgttgttgcttgtgttgctaaatcttctaatgctaataatgtgtctaaacaacgtgaaaagtatacttgttctttttgtggcaaagatgaatatattgttggtttttgtttcacattagctcataaacagaaaaaggagagagagattacttttgcaaaatcaaagtggcaaaaatcgggttttccctcgaggaaaccggtcataccgcattgggtcccgcggtcggaccggcgaccggtcagaccagctgaacagccccggttagaccgaccaccggtcagaccggcggtgaagcctcggtcaaaccggcccccggtcagaccggctgcacaccctcggtcagaccggcctcagaggattttttctgaaaattctaaaattaattttgcacgtggatatatgcctattggatcttttggtcgtgtgtctcagtactggattcctaaatttt

SEQ ID NO: 44368 - DNA, 450 bp, Oryza sativa
cctacttcatcgatggtaagagttcttcagaatctaaccattcagggatctcgatttcccccatattgctcatgctgcctaatcatgaaatttttcaacaaactcgcgcaagaactactcgaattcagagcaaatttgtgactattgtctattcattcattgtttccttatcccttcggcaattcctaatcatgaaacgcttgaacaaactcgcacaagaactgctcgaattcggaacaaatttgtgactactcattgttttccttatccatcctgcaattcctaatcatgaaatgcttcaacaaacacgcacaagaactgagcagaacaaatttgtgtatttcattgttttccttatctcttctgcaattccagtctaatttggcttgcctatttagtatctaccctactgttcttgcacttaattttgcaccgttgctcatttttagc

SEQ ID NO: 44369 - DNA, 1501 bp, Oryza sativa
ttgtcaatgatcgcagaaatcctaattcgcgcgtacgcgctacttctccaagtcgcgagcgtgccacatggccggtcctcctacgaccgagcctgcgcgcttcttttttctttttttccctttttttcaagtaggcgcaactactgtgtttctttcttcttctttttttttttgccgttaactaccacacgcgtctaagagtaggagtcaatatttgaaaacgttcaggtcaagatttaaaaacttttaactcagattcgaaaactttcaagtcaagatttaaaaactttcaactcagatttgaaaactttcaactcggacttgaaaactttcaactaaagatttgatactctcaattcaaatttaaaaatttcaagtcaagatttgaaaacttaactcaagtttgaaaacttttagctcaaatttaaaatctttcacctcaaaattcaaaatatttgataaaatttgaaaacattcatcttaaaattcaaaacattcaacttaaattttagaaacatttcaactcaaattcaaagctctgatattgaaggtgaaagattgaatttataaaatattaaaaaaaatcatgcgcgcgtgtggaaaagaaagaagcgattaaaaaatctggaaaaaaaagcgatctaaaaaaggaaaaaaaattacgttaaaataggagatctaaaaaaaaaagaaacgcgtaggacgcggctggcgcccgcgccggcagcatcccccaatgatcggctgggccgggaataacaataggcttgatgtacctggaatttagcaaatgactacctgcttcgtcaggactatttggaaatgagccctttcctggattatttgcaaaaagaccctactctgggttgttacgggcttattcactttgtggccaaaatcatcccaaccaaaatttctttatgaatcttgttggttttggatgaatttagtttgatttctttacaaaattcgatagtgtttttatgcgagaaaattttcaaaactaccaaattttgataagatgataccaaatttaatcaaattaaaagcagtagtaataaattgaactctggttcgatagtgttcgatttattactggaactgggaagctctccgcgtccggttcactcgccggacgccggcggcgcatcatctcggcacaagcaacggcgatcgccgccgccgccggaggaggacatgatcagtgcgcgcgcgcgcgcgtgctcgcttgtgctgaatcgaatgcttcgatcatctgagtaggcacccatggcgcggtgcgccgatggatccctctcatttttagcaaccgccgaagtagccgggcagcttccaccaccaccaccaccaccaccaacgcgcgagcctcgcctcccctcgtctcgctcttcctcttcgtctcccagctaaaattggcacaccgttcgatccaccccccccccccccccccttgcgcgaggctgcgggcgcggcggcggcggcgggcgacggcgagggcagc

SEQ ID NO: 44370 - DNA, 685 bp, Oryza sativa
ccattgtttggcagcatatttgcaaacgagaagtaatttgtaaataaaacttttatatacgtgttattagtgacctaaaagcaaaggctgaaaaataaacttcgatgaaaaaaactcaaaatcagctttaaatttaaggttgaaaattcaaatgttatctgataagcataagcataaacgaaagagatggagccattcatctgtatgttttgataatgaggaaacacacatgattggtgtcctctcatgtgttgaactttgtttacaatattatgctccttttatccggttagaattttgatcttgatcgagcagcaatgtaaagatctatgcattcaacatcaatagaagagttataccgtgtcagcatacttgcactgcataagcttcatcatccccattttttttcccctgaagaaaccttcatcaagattttttacatggcacagagccacacagatcatggaaccgtgaccgagattgtaaatctgtaagcgcaagatcgtgtaaaaaaatatgcaacagcaaaatctccaagcaatagttattcataatgccccgtcaacacgttgtggttttttttttttggtaactccgtacatagtgaattcaaaagccaaaggtcgatataactactttctcatcttagaagtacaaatgctcccgtttgttttctcatcttagt

SEQ ID NO: 44371 - DNA, 671 bp, Oryza sativa
ggttcaataagccagtggttttatgagaatgtctacaataatgcctgcacttgctttgcttcttttctgaccctggcatcaccattaactttcgcatagccttcaggtggtgcttgtatttctcctgaatatcacattagtacttgcttgttatgctttcgcccttgactcattatacatagcacctttccccttggcatcatctggttgttgtcagatagtcaacaatgtgctttcataattgatcaaatcattgatcaacactatacattatttactgctttccttctcttgttacaaactcttttatgggcttgtgtgtgttttggttatgtgcatttatgcagaagccggaagttttcttagtatggttctattaacttgttgtaatcgtctgagattaataaaagctcctttatcaaaaaaaaaattataatcttgaggtagtctcctagcaacagtaaaaggctcacgtacgtgttaatggctgtgcatcctccagaatctttttgagtgcttattttggaatgaaagtttgatttgttctttgccatagaatttaggttgtacattctttgacacaattggtatcataactagctaggtactaattaacggaaatactcgatggcagaactctgaattgattctaggaaggagaggagatctca

SEQ ID NO: 44372 - DNA, 382 bp, Oryza sativa
agagctcgcaaaccggtggcgcttgccgcggacgcgtggtggtgtcgcgaaggtttgagagaaggagagtgggagggagccgatggtaaatatagcagtaatcgtagggcttttccgcaaattacacggtatccggttcggatttcggaaaactgcaggctgcctccgccggttttgccccaagtcggcttagggacctatccgtaaataaaattattgcaaggggttattcgaaaattacccgccgcctttacccttgtcgtgtacgcgactcaactccctctttcgttggagaggcggcggcgcgaaaaatccgaagctttcgcgggaggagctagggtttgtgtgtgtggttgggcgcgcggcgagcggcgggagatgt

SEQ ID NO: 44373 - DNA, 273 bp, Oryza sativa
aagctaagatcttggagaacccgccgcagaacctaagccaccctctagggtagagtcgttagtcgcgtgtttccttgcttgtgtgtgtagcgcgtggtttgcatcagtggggtgtgatgtaaccatgctaggttgtttgcttaatcaacttgcagaataagtaaaacaaacaacacatcaacaagaagagttagttcctttaaggtcctgtctctagttctggtctattctttcctggcttgtttcctctctcacctcaatccctgtcacaga

SEQ ID NO: 44374 - DNA, 367 bp, Oryza sativa
cggaatcaccattagctgggatcatgtgaagccacatcatcagaaatatagcagccgttggattgttgtgcatcttaaatgtcagccgtcgatacaataaaaatgctttactgattactttaactgctgtctcaccatggcatcacctccatggcaaccctgacccttatcaactattttcccccattgctttatagaatcaacagtagcctaaattgcatggcctaacctttctatttatatgtgctacgagtcaatccaagtaaggtataaaattttaattatcgttgtccaattctggttctgccttgaattttgggagaaaggtactaccgatgtgctgaccatgtcttctctacattgtaga

SEQ ID NO: 44375 - DNA, 197 bp, Oryza sativa
tttgggggtgaaagcttttttcctagttggtttagactaaagagcctgctgactttaaggagcctggtgcttttccaatgtggggtctgaaaatctgtcaatcccatcgtttccttcccttgaacttctaatgctatcaggaaatatttggctgaaaacagtaacaattcttggtggttcgactggtggtgaaacga

SEQ ID NO: 44376 - DNA, 213 bp, Oryza sativa
tggacaaatcatatcccatcttgtaagtctatacttcttcttctgttcatcaccgcttgccaaaaaaaaaggtgatatataataatcattttttttagaacctcttttgaaatctaaaataagatatcataaacattgtcaaacttgagagcacaacattaatcaaaactaatctccccctacagatatatgttcagatgtgaatagcaagct

SEQ ID NO: 44377 - DNA, 1501 bp, Oryza sativa
ccgtcccgtcctccacccctctttatatggcacagtgtgacgggggcccaccagcgattgggctgggcgcccccgatcagggcgcgggtcaaggcccccttgagccgttggactcaaggggagggagatccatctaacatggaggactctagtaccggcgaagatggaggaagatgtggaggctacaaggctcttgctgtatgccagaatccaagaggtgcgaggggaggaaaggcatgacttccaagctggcgccaaaggatcgagcgtctggccgagcagagttcttttcactgtaattgctttgcatttggctcctgtgtgttgtggagagggctgtctccagggtggggacttctgaatttctggattgactactgttgctgtccggaaaatgagtcaatcaagagctagtctgtctgtcttttttgttctggcttgttagtgctgtgccagcagcagtaggtctgcaagttgctttgtgcctctctagttcgctggcttccccagcagtttattttgtttctgtactgaactcgtatgcttttagtaaaagctgggcatgagccttctctctaaaaaaaaaaaatactagctaagctaaatattttgagtgatagaagaattgtaaattaactgtgcagtatcatgtttctgtgtttgagcaaagcctggcatttctttggctttagcatctgtaagtacaaatgaagatatgctcccttcaaattttcctctctttctagttgaacctctatggctgcctgctcagatatgagtatatgctagagcttctgtatgaggtatcttccttctgtaagcacccttaaaattgaccatacgacgaatctggattcttttggaaatactgttgtagaaattagtgttggaagtattgtttcttgtagttagttggtgttgctgattgctggaatgattatatgatcagtatcgatccctctgttaagagaaaagataggttagcatagtccactcttgcacaccatgttctatgcccatgctgccccagcctataaatccaactgctacatataatatccacaaaagtttacagaacaaattgatttgatcatactatcagagtgctttactttgtacagaaatgtggattcattgagaatacagcaactaacaaacaaagattaacctgcaagagctgtggtcctttgaacagaggctggagccttgtttaacaggaaggtggcaactcattgtatgtaatgggtgcctgcatttacgctcgacatttctaagtcgaatgtgcctttttcatgttgcatgctagatgaaatcatctaaacaatgctaatgcttgtttcttcactgccattaattgatagttcttaaaatgcttcacttcaattccctgtgtaaattgttaattttcaaaacaactaagttatgttttacaaacctagggtgatactggctcaaatatatctctaggaaagtaaatcacactcctatgtcaatgtttagc

SEQ ID NO: 44378 - DNA, 1501 bp, Oryza sativa
gacaacgacgatggccggccggacttcctcttcctcaacaacgactggtcacaaccctaaatcctctcactccctctttgtgcattcatctattgttgttcatccattgcaaatagaaccacccgactagatctaaacctaggtgatccaatagactaccctaacaatggtatcagagcaaccctagtgtttagattggttcgggaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgagtgcacgcgcgcgccggcgagggggcccgcggcggcgccgccatctccttcggccgccaccctctttctctcacttcgcggtgggggctagagacggtggggggagaagagaagagaaaagaaaagaaggcgccgccgtgtttccccatccaccgccgtcgccggccatcgccggccgtcgccgaagccggggggagacgagagggcgcctaccacaccgttgcaaggccgctcgacggcggcgcgctctgcctagggtgagcacgcgcgccagcgaggggccccgcgacggcgccgccacctcctccagccgccgccgatggtgctccggccgccgccgatggcgccgccgctccggtgtagagagaggagggagagaggagaagtgaaatgtacggctagggttcggccggtcgggaggaagggtttttgtttccccgaactcggcggctgaccgtccgatcctaaccctagcaaatggatggccggatggtgacggtcggctggtggccgcgggccggacgggccaggccggccaaaagtccactttaggtctctcggccgaaagaaagaaggaaaagaagaaaaagaagtttaataaaagtccctcggccgaaggaagcattttcaatatgtttaattattgtgattatttctaagcaatttgaaccaacgtgaaaattgtttagagaatagataaatgtgagaaatgcttctgaacatgtattttgtatattttcatgcaaattacaatagaattttaaattgtttttacatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacataatatgtgctatgatgttgtaatttttctgaccaacgttgataattgcaatgttatagttatggctttatgtgttatgtctattttcggcccaacggtgatgtagacttaatacataataattttaatgttaattttgttctcacaatacatgattatctcaggtggctact

SEQ ID NO: 44379 - DNA, 1501 bp, Oryza sativa
acacagtactaaggaatatactgcatcatctttcagaacaatgttcctacaaaatttcatatatattgttttgtcataatgatgaattgcaaagctaatccgatgacttagaccacacaaaagtttttccctggatattgtacattagcttaggattatcttccattctttctagtgcactgtctcagtcaggcattattgctggtccagcctcatcactcttaaacacttcaactacagggagggggtccctcaagaagacttgacccaatgcaagtggaattctaggactcgaatcacacggccgggatttaaatttcggcgttgatcattgaccgctggaaaacttgacaaaaatgaaaaccgcgtctcaactttcttcagaagctgacataagtttggggacacatagtcctcggtgaaatggatggtgatggcccagctttggtcaagaactatgccaattgtaacagcatttcattacttaccccgttctatacttcaactttctcgttttccgtcagcacgctttccaaactactaaacggtgtattttttgaaaaaagtttctatataaaaattgttttaaaaaatcaaataaatccatttttaaagtttagagcagttaatctttaattaatcatgtgctaataagctttctagttttgctggaaatatttgcaagttgcaaatttaccatcttccatcagcttcgttcctcatcagtaaaatatgagagaagctcatgctatgtgcagctgactgaataggatatacatatactctcctttcttttattttctagactcttaactggtgcagagtgtgcacagaggaagaatagaactgcaacttacaaaagaacatgtcaactccaaggaatattcgcaggcagggtgcttctgcttaaaagctcatcagccataagctcttcaagagagctagggaggagagagaaagaaggaaaggctcctcttttgagaagacgaggttttagctcagactattgcaggaggaagaggaaggagagagaagcatggctgccttctgtaagaccaaaatccttctcttctcctcagctacagttgcatttctttcctcttcatattgacaatagtttacctctgtttattcaaaaaggaaaaaaatgcacctcctgtgtgcttcacatcttcctttcctgtcccatgctgtggttccaatgctcctcttggcagcatctttttacatgaacctcgatgtatgtttatgaaatactaggtatctgaatctgtagctctcatggagtaattcatatattttcttcaagttagcactgaagcatttctaccttatatatgttcttcagttcatatgatactgatggtaatgcatctttctcgtggaatgataactatcaaaggaattggcttcttcacttctctatttccttgatcaagaatgaaacttccaacttttcagcgtacttgaacaattcaagtctagtactgttaattgagtg

SEQ ID NO: 44380 - DNA, 558 bp, Oryza sativa
  unsure (1)..(558): unsure at all n locations
gctttgcttgtgtgcttcgcgtagcttctgtcgttccggaggttctcgaagcgtggtttgcggtcgtcgccgaaggttcggaaggccgttctctctgagtaaggcaagtcacatcatccttgaacatattgaatcctagtttataaaattattttgatttaaattattgcattatcgctttatttaaatttccgcgttatcactgttttatctagccatgcctatttacttttgttatgaccttattattgctattgttattattatcttgttcaccctaggaaaataaaaccccaactagtgggtactctattcatggttccactagtatgaatttaggtagatgcttcgctgattaataggacaacattaggtggtttttataactttagactttgggaatattcatatctcttggatactatggaatgggtggcttatggtggaattggacatacccctctcttcctctttcaaagcccctaaaacctgtntttcgatggggtttgggtgcatgccagttgtgggaagtagcaccccgaccaatataaggactaa

SEQ ID NO: 44381 - DNA, 543 bp, Oryza sativa
agcacacctcgtacacgtgtgccacataggattggaaaaaatgtttgggcatccgcagccgctgccccctacgatttcacctccgttgctgttaagcttgtcgtcgttgccgcctaggattttgcctccgtcactgtttatattcatagcttatcattgccaccagcgagtttgatggcaagtgagagagtactgagaactagaagaactcatcaaaacaattacaagtgaaatgatttggtttccctaattccgtgtatttccaagtgctagtgttgtgagaaagggaaaaaaaatacgcatgcgatttatgcacatgtccgaaagcaattttttcaatcgtaggttgcatgccatgtatacaaggtatactcatttggatagttagataagtaaatgactcacttaactcacattagtgaactaaatgtgcattttaaaagtagagtgatctacctaacacacctaaacaagttaagtgaccttccatgcattttactcttggaacaaaatggttgtcaaggcgtcgccaaagcgtcacta

SEQ ID NO: 44382 - DNA, 1101 bp, Oryza sativa
ttctgggagccctgtttagccgggagttcctgttccgcgcgtacgcgctaggaacggaggcggcgcgcactttcctggcgtccctaatagtgtcgttctttttttttaatgaaaattcgccaccgtatgtttctttcttttgtttagttgactgaaacaaactttcaactcagatttatccaggatgtggaaacttttcaactaagatttgaacactctcaagtctagatttgaacacagatctaaaatttttcaagtcaagatttgaatactttcaacttaaaattaaaaattttcaactcagattttgaaactttcaaatcttgatttaaaaattttcatgtcagatttgaaaactttcaactcatatttaaaaacattcaactcaaatttgaaaattttcatccaaaacttaaaaactttcatcgcaaatcttaaaaactttcaactatttaagtccagatttgaaaactttcaactaaaatttaaaaactttcatctcagattaaaaaacgttcaactcaaatttgaaaactttcatctcaaaactgaaaaactttcaactcgaatttaaaactagcagaaattaaagatgaaagattcaatttccaaaataaaaaaaacacggaaaaaaatcggcaaaaaatatttcagggcctccccggctccccacggtggaaaaaagaagagagaaaaagggaaaaaaaaaggaagagaagagctacttgagggcgtgggccgtgtgggctagaaacacgcgccagatacgctaatagcgcgtacgcctaattagccattaacagccacatcagctaaaacatggcaaaatactgccttaaaacctcgattacgtagatgcttttttttttcggtttaaggacgcgattgaaattcaactccaatacgagagacctaaagcgaaccttttccttttccaaatcctatatatttcttttgtcagcccatcaaggagcttctatccgaatccaaatttaagttaaacggagcccaacccaaggcagctagttgggcggcccaggaggagataaaacgtattgccgcatcgtctctccgcaaagccgagagaactcgcggcggaac

SEQ ID NO: 44383 - DNA, 1501 bp, Oryza sativa
agcccaatcgttgctgcttgaaatctacagaatatataggtgcagcagtgcaagctttgtttatttggcagcacaactcttgcccgtataggtttgtaattgaattagattatacgtgtactgtgtacaccgccaaagaaacagaaaaggacaaagactcctagtatgtaacgtacacagttctatagacttatcttttctactgtaaacagttaaaatctagaattgccaaaggttttaattgatcttgtattgggttcttatatggactcctatttcagtattgcttatttttaattccgaatttcagttattttttagtttgtatttctacttggactcttcttttctttttcttcgattattgtgggaatttctagcctccacagcgaatgtggtggcttcttttcgagctgtcttaataatataatagatttatatagagataacaatgtagttattagtgtagttacaatgtaactagcatgtacttagaatataacttagatgtaacttaaacaaatctgccataaacatgcgatgatgagactagcttgtgaaaaatagggtttagatccgatagcaaaatatctcagcacaaatcttagcgcggaatcgacggccaaaaaattcaatagttttcactcaggaaagctgtcgacagttagctagtagaaccgtttacaatattacaacatctatggtttatgtttcgcccatagtttagagttccactaatctctcgatcaaatctctaatttaaggacatagctgaagaataggtaattttgtgatttacatagtgtaagcgaatttttatgaccatattatatagtcatgttaatataaatatgtgagcttgcaatttaatttatccaatatctttatctttacctacttaaaatatttatagtgcttataccgtcccacctctctatctctacgattataaaatttaaaggtgtttctatagttccacctctatatctctactattataaaaattaaaagtgtttttgttaggggcttggtacgtcatccatctttcatacgtatccatcgttcgtctttcacactagtcctatcatatatatcgcatatatgggttagcagataggatgggattcgggaaggcccgattggtacatcgcgagtccatccatgactcctctttgtccatataagtggctccgtcgagcattgttctccatcactaattatatacgttggcatactatcaaagagttcgattaaattacatttccgtttgtcatctaatttttggtttcatctatggccggccaccatcaccatgagtacctgcataatatatatgcatacgagttgtaagttgagtctccaattgaaaataatatacatatacgatgttgctatccaacttcagcatacaatcaaagcagcgatgaaagtctcacacacgatagatgattcaggccgtaatgaatattgctgtgcgcctgttagttgtgcccacgccgta

SEQ ID NO: 44384 - DNA, 1136 bp, Oryza sativa
ctttataataagatctcacatgattatattatgatgaaaaattacaaattacttttataatatatctaaattatttttagatttcactaaagtacttcttggacatataaaagtaaatttaataaagtctaaaagtaatttacatatattataatagaagtaacttaagacaaaaggaaagtaactttgtcataacattagaagtaaatctgttgtaaggataaaaacataactctatctagagactaaattaatcagcacaaattatggaattgactaaaaacaataataaaagtaaccacctcatagcattatgaatgtataggaagtaatttaatcaaatctaaatctaaaagtaatttatatatatgataaaagtaacttagtatataataaaagtattttacaaacataaatattttttcatcataatataatcatataagatcttgttgtataaatttaactgcaacgaacacaactgagtaatcggatcttagatcatataagtatttaaatgaggatgcatgtggcaggtgctactacttttagtaagaggggtaatgagttgatacacactgtactatttttgggtaaaaaaggatggtcgctggttagcactaacaagtgcttgcgctccctgtagtcgtgtccatatttgtaatttattaatgaaaatacaaattgataaaatttaaatttgaatagtgcaagtatcaattattcgagatcaaagggagtatatattactatttggaattattatttcaacaaaattaatgataaacaataaagtatctttttaagattcggaggaattgagaggatatgcatgcataggtgcaaagtcaagggtaataaaatgttccaaactatacactataagcatgattgcaatccaaatgagacataataccgcgtaaatcattctgataaaaaaaaaacaattttgcaaaccgtcaaaaagaaaagaggcttcaagacttcaatatgttacttattactccctccattccgcattgatcatcacataagttttttcaccacgaccaagaaagatttgacttctctacattttatttcatgtgaatatgtagtggaaaaaatcaagaaatatacatagtttaactccccgc

SEQ ID NO: 44385 - DNA, 562 bp, Oryza sativa
tgagccattgaattagtcagcttagatttatttaatcaataagttcttacataaatggagagacatataattggcgacaatttgttaaaaatatattgagaaaatttgttcaaaaaaatcgaatggttggtggcttcaagttgagtatagcttctaaatatctagtgaataaagttaggaaaagtgcaaatgaaatagttgaaaaggactgtgtgaccgaacatgggtgtctgaaatgtttcttcatcattcgtgaactcctatttttgaatatgataagcttgtccagatagcttttttgtcttttgttcatgtgtgcctcatctggatggtcatatagctattagttttgaaatggctgtgtggcaactgtccattgggatattctagattttagcagtaatgcttattggatttaaatctgaagtagtcaattcatgctgctaatactattctgatatatccacttgctaaatatacgtgacatttaaagatgatttgttgctttgtgcagatatgctattgctatactgatgaatccatgatgcaaccttctctcagt

SEQ ID NO: 44386 - DNA, 1501 bp, Oryza sativa; identical to SEQ ID NO: 37139

SEQ ID NO: 44387 - DNA, 1501 bp, Oryza sativa
gtgcatgataatgtggccgttcgagtccgactcgataaagtgtcgtgtgtgcacgagaacgtagctgggtgcgcttaggacaccttttttctcatccgcatcgcttactcacgcagaagcaccatattcagtcaatctataccattataatttgagcctgctatgatgtatcaatctaacagtagaagtcactataattggaataggtaaattatttttacccgttgcaacgcacgggcatttttgctataaatctaatatagaacatttacacatttggttgattaacacataaggtagtcatggtcatatctgagttagttgtgtcctcatcacccaaccatcgtccccagcggcggcctgaccaccatcctcaacgtcgtcgcaaccgatgggagacgacacccctgttaaagagtcgttgtcacaaccgatgggagatgacgccccttctggagagctgctgctgatgttgccgttgtcatcagcgctgccgtcgcaaccaaggggacatggctcccctgcaagagagttgatgctgtcgtcatcgtcaacgccatcgtcgcaaccaagggggcacgactcccttgctagagagctgctgttgttcctagtgcaacctacggatgcttctcaacagtcaccaaatcatgctctactccatgttgtagcctcaaaggaggtcgtgccaattgccgttgttgcaccctccattgacatccaagatgagtaatttctcctctcctaagcttgtttgtttgtgcatttccagttggttgttatgtttgtttacaatgtgtggatccacaagatggatccatattccacttttattttcatagtgagaattattcgcgcgggcaatagatttggctgtgcatgggtgtttgactggccaattgattctaacacaactaattttaatgactttgttggtgacatttgtgaaaagtatacatggggcatagatgaaactgtaataatgcggtaccttgatagtgctttgaatctgtttcgcacaatttcttttgataaagatttgatgacaatgtttaaatgtaataatacaagaaagattaaatggcttggttatgtgctgcattgagaagaatgtcttggataatattgatctcgataccgcattaatgattttgcatcaagaaatgcctaaaggagtattttttttatgagaagcaaatggatgtctgtcatcttttgttttatcaagtattattaatgaagtccctgaagcttgatccttagtcaagaattcaaggtaaccatagtaattccattttactgctcttttggtatttttagcaacatatatagaggatattatcaatatttattttcagcatgattagcggatgaatgctttaaaagtatacttttaaaaatccaaagtgcatatgtgtatatatatagagagagagtgtgtgtgtgtatgcctaagggcccatgtcatggagttggcctagggccctaaaaaatgtagagc

SEQ ID NO: 44388 - DNA, 1501 bp, Oryza sativa
cgtatgaaagatggatgacgtaccaagcccctaacaaaaacacttttaatttttataatagtagagatatagaggtggaactatagaaacacctttaaattttataatcgtagagatagagaggtgggacggtataagcactataaatattttaagtaggtaaagataaagatattggataaattaaattgcaagctcacatatttatattaacatgactatataatatggtcataaaaattcgcttacactatgtaaatcacaaaattacctattcttcagctatgtccttaaattagagatttgatcgagagattagtggaactctaaactatgggcgaaacataaaccatagatgttgtaatattgtaaacggttctactagctaactgtcgacagctttcctgagtgaaaactattgaattttttggccgtcgattccgcgctaagatttgtgctgagatattttgctatcggatctaaaccctatttttcacaagctagtctcatcatcgcatgtttatggcagatttgtttaagttacatctaagttatattctaagtacatgctagttacattgtaactacactaataactacattgttatctctatataaatctattatattattaagacagctcgaaaagaagccaccacattcgctgtggaggctagaaattcccacaataatcgaagaaaaagaaaagaagagtccaagtagaaatacaaactaaaaaataactgaaattcggaattaaaaataagcaatactgaaataggagtccatataagaacccaatacaagatcaattaaaacctttggcaattctagattttaactgtttacagtagaaaagataagtctatagaactgtgtacgttacatactaggagtctttgtccttttctgtttctttggcggtgtacacagtacacgtataatctaattcaattacaaacctatacgggcaagagttgtgctgccaaataaacaaagcttgcactgctgcacctatatattctgtagatttcaagcagcaacgattgggctggagcggcagaacccaatgatagcgggagccgaccatagtaaaaagacatgatatttacatagacattacaacaaacagatcaatacttgcagccggcaatgcatcaaacaccaaaagtttctttgatattcatgaaagtacacatgatatcgacatattgtaattagtgtatatttttcacaggagatgaattagtgcaagccgctataaactgacagtcagataaacgtttagattatagtggattcacaatttaacgttcataatttaacggttgagatataacacctatatataaatataggaattagagttgtagtgctaatataggagtacaaagcgccctgctcgatggaataatcgagatccaattctaaaactgttatctaaacctatttgattccagtggaaaaaaaaagcaaaacaggaactaggtaggcagaaagc

SEQ ID NO: 44389 - DNA, 774 bp, Oryza sativa
gtcataaatcccttttttaaggttttctttattagatgcaaatcgattaaacttcggaaattcataactaaatcatcgtaactcgaattcgagtggtccaagttgctaaatttttctaaaatcgagatctacatgttaaaaatatccacatgtactgtttatgcttgtttttgtactgttttggttgattttgttctttggctttagtttccgacgttccgaaggagagcgttttcgttgaggaaggttcggaagcatttgcggaagctcaaggcaagtaatatagatcccaaacaaccctttgagcatgttgaacccgtttaaagctaatgttttattttaacttatgcattattttcgaatgtcatcgggtggtgagcctttcccaattaattaatggccaaagatgtctttattttcctatgggtaataaattgattagcttgtaccttatatattggattggttcagttagatgctatatgtataattgcttagccatgcttagaaacattagctcattaatgggatgaatcatactacattattaattatggttatatttaatggtagctcacaatggttaattgtgttatgttaattaattgataactaaaacctgattaaggtgggttgtgagcatatggttttgatggttgtgctcatgacaattaaggaccggttcgcgagctactgttgtgaaacatttaccgtgccaaccacaagccagcatgggcaacggctttatcttttgtatagcatgatttattatgg

SEQ ID NO: 44390 - DNA, 208 bp, Oryza sativa
gtcataaatcccttttttaaggttttctttattagatgcaaatcgattaaacttcggaaattcataactaaatcatcgtaactcgaattcgagtggtccaagttgctaaatttttctaaaatcgagatctacatgttaaaaatatccacatgtactgtttatgcttgtttttgtactgttttggttgattttgttctttggctttagt

SEQ ID NO: 44391 - DNA, 207 bp, Oryza sativa
acactctcccccacttttccccaaaaatcggcgccggtttgaccctccacgagcaccacgtcggctccggccattgcgccgattccaccttccggccacgatctccctccccgcgcccatataaaccctccccgggctcccttcccccgtttccccctctccccgaagcgccccatgcccggaaccccctcctccccgtgaaaccta

SEQ ID NO: 44392 - DNA, 1188 bp, Oryza sativa
gccccccccccgaacgcgcccttcccccgccggcggcgccactcctcctcatcggggtgccgccgccgccccggcagctctctccacatggatccgacggcggggaaggtggtggaggcgtccgccggcggtagcgaccctctcccgcaaggatcgggtggcggggagggtggttgtaacgccccgattttcgttcgggattaaaaatcattaaataatgcattttctagaaattaaataaaagttaaatcaatttaatcaagtgaaataacgggagaattaaaattttcccttataaatcattggccgggaatattttgtaatattctttgtgacctaaaatactctccagatttttccgcgaattttcggaactcaagaaataattttagaagtcacaaagttcatttaatcaattaaataaattgaaaaccaaagttaaatctccccttcctccttgggccattttcggcccaagatattttccccctccttggcccgctcgcccctctctccttccctcctccctctcgggccgacccctcccttctcggcccgatcgactttccctcgcgcaaagttgtcacgcccggaatttctatccaaaattccaaacgcttacatgtgtgttaaaccctcgtccaggaatcagccaaggcacacaataacaaattgataatagagtacaaataaataactatttaatattcgcaaataataaattattacagaggtggatagttcctctcaaagaatacattctacgcagcggaaaataaaataaactaaagcaaactacggaacagctatggcaactccactccacaggcatctcaacccggaacaagcctaatcctccagatcatcaccttcactgaagtactcctcctctgatgaatgaatattgcaagaatgagcatatgacatactcaacaagccacacagcaaatatgcaagtgcacaggataacaaaggatggcataaaatagctcatttgcataaacagcatttaataaatatttaagagaatagtaaaacagttgaataattaatcagtattaaataaacaccatataacacacccgtgttgcataggcccaacctcatctgaacaaccaaccccggttgtacaaatcaaacctccataccaggaatataccattccaaaccaggagccacattaattaa

SEQ ID NO: 44393 - DNA, 180 bp, Oryza sativa
caacgacgatggccggccggacttccttttcctcacaacgactggtcacaaccctaaatcctctcactccctctttgttcattcatctattgttgttcatccattgcaaatagaaccacccgactagatgtaaacctaggtgatccaatagactaccctaacactccattgcttcaaaaa

SEQ ID NO: 44394 - DNA, 1501 bp, Oryza sativa
cataaaaatacattgttttgtgatttaagttgtataaaacaacacatattttgacggtagtgctattccacgtgctacagcgcggaataataattcgagcgccgcacaccgccttctcctcccggtttttcttttttaccaccccacatttcctccgcatcgcaccttttctcgtttgatttttttcgttttttaccacccatcttgtgtgtttcttttttttctcttttccatcttatcatgcttcattaatgggcccggtcacgtctcaaaaataacgaatttactccgtggagtttttgatttactcctagcctcccacatctgctcattctagagtaacaaatttattcgcatgaatgcctcattctaaagtaataaatttactcgcatgaatgcctccacatcgtataacgccatacttagatggtcgtaaaagaattactactagcttacaacgctagtaattgttttaccaatattatttaaattttgtggtctatgagtaaaataattactacctttctctcgatatagcccatgatgtaatagccaccgtgtagtaatatgtttactgatgtgttcaatacacagtataagagtaaaaactgagattttgtggtatgcgagtaaaacaattaccaccttcctctcgatatagccatgatcttgtagccaccgtgtagtaatatgtaaaaactagtactaagagtattattgatctgtatcacaaaatagtcgtatgaatgaaaaagttacaggctcaatcacacacaaactataaaattactcacaggtgaatcaaactagaaaagaaaataaatgattcagccgaaaatccattatggaatcatggaaggatgtagcggtgtggtatagagatgagctcgacgttgcgcaatagcagctatccatcatctagcaagcacaaaaaaaatgcaaaaacattctcgttcatgtaatacagatgatgagcaaaagaaaaatagcaaacaatctccatcaccagtggactccaccctatcctctgcggccagccacatggagcacgatgtgcaaatgtagaacctgtgcagcccatcaattgagatcaggtaatattggagattgcatgttaatttgatttgcaaaaaaaattagggcttcatgtgtgaagttgaaggaaagtatgcagatgcaaatcagagtgttatttccttacttgcttgttctatcaatgtcgtcgacgtggagcagtcgttggttgttgctattagcccaggtgaacacctccttgctggttaaggtgttgcctagcgtccggcagcgaggctcgaaatagtgccttcgcctcaaccgccgccggccaccgctcgccggccaccaccatcaaccgccacggtgtcgtcgtcctcctccatggtgtgtcgctgatctgtgggctgggatggtggatcgattcagatccgaaaaaaaaaggaaaaaacagagtgggggcgagagtagttggttgggtacgaga

SEQ ID NO: 44395 - DNA, 1501 bp, Oryza sativa
ttcttgtgcctctactcgctatgcttatgggccaaaccaagcagctgggcgcctgagctaaatcaatcagctaggccaaacaagatgtatgggaaggagctgctgttggatatgaatcaagttgaaggattcaatgttatctgtgcaatttggccacttttacaacatgtccaatttaaatgattaataaagcatatcagtaaaaaccaagagcgcatcagcgccacatgctaggccagcaacacatcgtaagtataaacggcacgatagggcgcgctataacgacatgttggctatcgagagtcgatgatcgatggttgggctgcgtgagagaatggacgctatggagaataacgtccacgctagagttgggctgcgtccatactactttcatagcatctagattggatgctatgatgcagttggagggatccggctcctctgactttgagtgaaaacgtcagaggcacacagtgttttggggcttacgctacagtacaaaacagttcctctactgtagtcactgtagcaacggcagaaaacaataaaaaatattgtttatatatcatattgtagcgatcgatcttgtccgttcactgcagttcagaccgttaaaaataccacaattagaggactgtgcgcctctgacgttttttcccaacgtcagatgatctcattcccagttggatatagtgtccatagtattttcatcagtcacctcacctatccgatttattactacttatttaattcaaatgaaaatgattagaaaaattaaagagtaaatttcacaaaactacacattttgtggtctaatttgcagaaaactacacactttgacacttggtacttaagtatatatattttggtagtgtagtttcaccaaaccacactatcaatgaatgtattcacccgtgagatggcgtggttgtttcaactaggacgaggacatggcatcctattaccagccatcgcacgaaattaataggatgcaacgtcctcatcctagatggaacaactatgtcatctcacgggtgaatccattcatcaataatgtggttttgtgaaactaaactaccaaaatatatgtacttaagtgctgagtatcaaaatgtgtagaactactattaggagcgcagcgcgccaaacatgcaccagcccaggccccccccacctcacgtcccgtcatcccactcttaccattgtcggaataaacgatttactcctatcgcgcgcctcaaccacccacctttattcgagtaaacaatttacttcgataataaaaacaactccactgcttccgatcccaccccacgtctcgcatcgtgcacccaccattatcagagtaaataatttacttcgataaaaacaacttctctactggcggtatatattctatttttctcgtacccaaccaactactctcgcccccactctgttttttcctttttttttcggatctgaatcgatccaccatcccagcccacagatcagcgacaca

SEQ ID NO: 44396 - DNA, 458 bp, Oryza sativa
ttatggaacttgcactcgtcgatgacatttcttggattttctcctaatagaaaatatgtgatattatgatatttttttcttttaacactgaatttgctcctaccttgataatagagtgaatctactcagtatcacagagttcgtcacaattcaacaatatgaatctgactttgtcgacatccataatataccatcgcctttcccttaacctctaaatttaccatcatgaccacagaccgttaatttgcattgaagacctagagtgattgattttgcccctctagttgacagaattgagagaaggctcacctccagctctatgttcctgccctatggagggagactaacccttgtaaactctgtgttatttgctatccttacatattacatgtgctcccttcaactaccagtcactgtaattgaagcaattgacaaggctatgaaaaactgcttatgga

SEQ ID NO: 44397 - DNA, 313 bp, Oryza sativa
gcctctttatattatttatattatgtgttggtataggtgctacgtatatcttttcttgtatcagtagaattgtaatcacatttttatttaatagactcaatcctactttgcaaacgaaaaggagatgtaacctgtttttcttgttctaatagtttcatataacccatacaattgatcctcacttaaagtagttattagtatttctctctcacgtagtgcttccatcaccttaattattttgcgttggtccttatggttatgcaaaaatgatgtggttttttttacaacaaaaatatatactctcctttgcagg

SEQ ID NO: 44398 - DNA, 1501 bp, Oryza sativa
cttcccgttcgtcctcctgtccggtccgagtccctctgacgacgcgactttccccacgccgggatcgagctccggggaggggagctgcgagctggtacgtacgcttgatttcttcccttgccaccgcgatattccgatgtatccgtgatgtgtcgttcatgggtagatcggctagggatttggcggcgttgaggaaagcgatggctgccgggtggggggaattgttgtattagactctcgaagctgatatctggtgtggatttgcggtggaagccatggtcggaggcccagtgccttccgggagttgttgggttatcgggagcccggagggcagtgcggctcgccgactgctgccatgatccccgtcggcaaaatctccagattgggggagatggggggtaggaaccatttggattagtagtgtatacacggggtttcgtttattatatttagagcgctctacatgtagacagcacacagcagctttaacgtatggatggtgtatcgcagggaatgtatctcgaagacattggattaggctattattacatttagagaaccagattgggtttgcgataactagaaattgagtctgttatgaatttattgatggagcggacagggaattacgattactatctgtttagcttttcagttgtgaatgatgattatttcaatttagctaatcaaggttcctcaatcaaaccgttctaactttttctatttatgctcttggttacattttgacagaaacactttgtcatatcagtcaacagtagagaggagaccagatgcaggtcagttctaattcatctttggttgcacatttcttgtatagttagttaggtatgtaatgtgatggccaactcttaatcaactaattattcgggttatgttttactggtctcactgagacgtccatgctaaggtggtaacatttaataggacaatccacatttggcagcaataactgtactcatcttttcctttagtaaacggtttggcgcctagtatagggctcgcgtgtttgcatggaagagttggcactcggtagttggagagctttgccgacggttaccaatgtgaccagtactggtttttgtacacccatactttcttgtcgtcatacactagcaaaagtttgtgtacatcccttacttttactaatggctcaattatataacttgatttacttcactacaataaaacttataaatgtttggaagatcatgtccaagagactttcagtattattgttaactggaatgagcttaactactactccctccgtttcacaatataagtcattctagcatttcccacatttatattgatgttaatgaatctaggcatatctatctatctagattcattaacattaatatgaatgtgggaaatgctagaatgacttacattgtgaaacggaggaagtatgtgaattgctcctttagtttggttcctaacatgctatctgaatgtcttcaaaatattttctatcgaa

SEQ ID NO: 44399 - DNA, 1501 bp, Oryza sativa
atctaaaaattaaggcctgggtatgcatgtacgacacatatacacgtaaatggtgccgtatctaaaaatactaatcgaatgaaattgctcccaatcagaaaaaaatacaaaagttggtttattgaggacaacggatcgaaatacatactatgtgtttggtttatttaaactttagtctaatactcaaattaaaaatatcccaatgcttggacttcctgaaactcaattcaaaattgtgtttggtttgaccgagcaggaattttagaagatttttagttgctataattaaaaatacccctatgtttggttttatgtactcttgtgctcactctggttataaatatttagtgtttataacaaagttcgctcatacctttaaaattccgaacaccaataatttctcacatgcttaaatttaaaaactaaataaatggtttaaggttgttattgaatgttcatactaaatatttgttggtgctatctatactacttataaaataacaagttttatacttgattttcatacattttaattctttttttgcgaggtcatattttatttatgtcacactggagtgtcttttttttgctttgattgtcactagttaaagccctttaatgagtacatatcattatttgctttgattgtcaaatactctgtttcatgttgttattgtactctacgtatgatgctcgctgcagttaatcacatactaaattcgttgctgatacgctttttttttctccagagagaatcacatgcagtgctttttcagtaatttgagatatcacagcattttttttatctcgtactgcaaagcaactattgagtggcaagcaaaaattgttcataacttgttttgagggcagtacatattcgaagctgtcatgcagatatcttccgtgcttgtttactaacttcaggagatcataaaagcagtctctgaacttgacgttttgtgggtggatttagcgtgtgcagctaacgagtaagaactgagatcagtgttttttttttctgtgtacaacatgccaaaacattgcatggatgacggaaagaacagtattattttgagattcgaagttctggatgaactttgcgccggcctgacagagctttgccggacaactttggtcttggcttcgtcgttcaaaaaaaaactttggtcttggcttcgctttttgtttcaacttaaattttaagctaaattacagtaagaaggtgtgcgtgtgcgcagtatgctactacatcgttttgtccgtttggaaattacagagaatgcacttccaagctccaggaatcgattcggcatttcggccggcacatgtctttcctgaatgtttttgttttgccaaaactttttttttacagaaaattcgctccctgcaatttaggcaatttggtaaatcttgtactaagacaagcaagtcaggatgcttaattttagagttaattttgatgtttaatttactttttttattggtttttaataagtcgcta

SEQ ID NO: 44400 - DNA, 404 bp, Oryza sativa
tgaaaccttgagctactagcattgctttatatctcatgccacgccctaaaaatcgcctaaattaataatccatattttaaatcatttttagaaattacttttaaagcctacaagttaaactctaataatctaagaaaaatttcaacataaaattgagctagataaaatttcattaaatactttgcttgtttatctattttctagatttttctgggaattatttgagcaagggaagtatttttaataaatgaaacatcatttcacgaattattttaattggaaaagttttaaaaatcctcctctaagccgttgggccgtatttggcccaacatccctctctcctcgcgcgcgccgagcggcccaagccggcccagccgacccgcttgcccctcctttcccctagc

SEQ ID NO: 44401 - DNA, 152 bp, Oryza sativa
cttcatgtggctctacacatgtcacctcctctgaatgatcaaaacccctggatctgaactctgagggcccctttgaatcatatgaatgaaaaaacggaggaatataaaaaacatagaattctgacaggaatgtaagtgtaaaatagagaatt

SEQ ID NO: 44402 - DNA, 479 bp, Oryza sativa
cgcttttggaccacataatctccttgtaatcttaatcgatcgctcctgtttctcatcagaagtagcgagagggcaagatccggagaagtaatcaaggactacggaagtgatggacgccgtggaaacgatcatctcaaccgggatcaacatctatgaagcgacccagctgagcgatgaactgtcccgcctgcaggccaccttgcccaaggctcgcttcctcatcaatcgcggcgagtggggcaggttcaagaacaaggacatggcgatccttctgtcgcagctcaaggacaccacctacgacgccgaggatcttctccgcgagttcgatgaccaggcgctgcggcaaaagatggaggacgctgaccggagctgggcaggtcaactcttatcttcctctctaaatcatgcaaaaactttgatccgtggtagcaaaacaaggataaagtaggcccaggagaagctcgacaaggctggggctg

SEQ ID NO: 44403 - DNA, 1501 bp, Oryza sativa
gtaccctccctaggaaattaacttaggattatatataggcgcggaggaatacccgtactgagctgtcaccatcagcggcccacctctcatccgcaatatataaccccaaataatgatatcccgtaatctagacaccacgtctaaactaccagatacaactctaatatcatcgtcatgacatagaataattgcataagcaaacattatacccgcaccaaagcttcacccagataagctagccgtatattcagtataacaagaacataatgtaaagtaggtactcatatactcggagagtatttcaataccataaatgcatgtagaagagtattctaataaaagtacaaagcttacaaaagaggaaagaaaagctgctagagccatacccgaactcttccgaaggcttccggactcctgactcctattctaattctattccaccagctagatactactaaactaaacttgagagaaatgagagagctattgtttgaggtgtgtgagtgaagtgagaatggcaactccttttatagcctcccaatgacggttgtggcggttggaatggtcgaaaatgccctccaaccgtcattgggggctaatccacaccgtctaggcaaagccctggatcagatggcgctaaggagggttcggccgaacctggggccggcccgatccaatccaatttcggctggcggcctcctctgttgcttctctttgcagacttgtgaattttggcccagtttgtcgtgtcaattctgagttcttggcccattcatgcataagcctggttctcgacatctcttattgatttatcgttggtgttgatgtcgattctcctccactttatgatcattctctgcaaaaggttagtaaacctaacactagtggaatattattattctaacaaatatatgcattgaaagcatcactagttctctcctgttttagtaatattgacggtcgaaactgatcgataacgaccgtcaataatgattatattctgataaaagaaaaacatatgtttcaaacaatacaaatttattgtttcatacgcgatagcaatatgtttcaccatgtgttctcattgtgtttcacaaaatttctaaatgtttcagaggctaatatttctgtttcaccatgtataacttaatgttgcaccaacggtcaactgaaacatttgaccgtccgatgtttttacaccatcggacgtccgatctatatctctccttgtaacgcatgagcctataactacttcctccgttttataattttataatgtaaatcattttaacatttcacacattcatattaatattaatgaatctatatatatatgtatatatgtatatatatatatatatatatatatatatatgtatatatatatatatatgtatatatatatagagagaatgtaagtcattctagcatgacttacattatgaaatggagggagtagtatattaaaaaacaaaggtagttcttttcttatctccagcac

SEQ ID NO: 44404 - DNA, 1501 bp, Oryza sativa
cccgggaggggtgacgcgaacgtcagcgcggccgcctccgtatcgtacacggccgtcgggccgccaccctggccgtcgaccgcgacgatgttcttcccggccatggcgaggaagtgcatttggccaccaccggccgctggcgccgccgcgaaccgagtcgccggccggtcgacgtcgggcgcgtggataatgcccgcgtcgtcgtcgacgtcgagcttgtggatggtgtaagtagtagtagcctcgtcgccgtcgtcgagcaccaggtagaggtgcttcatcttcgtctgcgccggccgccgccgcgccgtcttgctggcgcggccatcggcctcgccgccgtcgttcctccgccgccgtgacatcccgggtgatcgatccatccactgtttgagttcgatcacgtgcacgtaaatagtcagggcaagactgctgctccgactcggaaacggtacaaaaatcctcttcattttaagggagaaggaattaaaaaaactctgaattaaaatttgatgggtataaaactctctcctttctaagggaaaaagattttttttaaaaaaaactcggtgttaaaggcctggtttagttcccaaaacttttttttactaaaaatatcacattgaatttttggacatatggatgaagcattaaatatagattaaaaaactaattacacagttagaggaaatcgcgagacgaatcatttgagcctaattagtctatgattagttataaatgctacagtaacccgcatgtgctaatgacaaattagttaggctcaaaagattcgtctcgcgattttctagcgagttatgaaattagttttttcattcgtgtcaaaaactctttccgacatatagtgtaacacccaaaaattttcttttttaatcaggccaaaatttgaaaaactgtgaaaaataaaagaagaacaaaatgcaccagccgggaatcgaaaccgggtccgtaccgtggcagggtactattctaccactagaccactggtgcctcgttgtcaagtaatttacaaagctcttaagtcactaattaccagtaatataatcgtcacaaccacgagattagatatagttgatgactactagatgtcagatatgggaatcgtatcagagtgagaagcacatggcaaataggcaatcgtatcgtatcatacacgttcgtgtaatgcaactagaaaacgaagcccagcaaggactccactctgcaagtccaactaaaatcaaattattattgtggcccagccactaaaaacaaatttaatgactacgaaattccgctaatcaaattgtttgatcgagctacacgcttcagtcactgtagagtacacattctgtatgctgtactagttcagtagtacgtactcacagagaaaagaaaacatttcggaaatttgtatatatttcagactaatagaatgcgcacgttttctgaacttttaaataacgtagttttccaaaaaaaaaactatatatatatatatata

SEQ ID NO: 44405 - DNA, 753 bp, Oryza sativa
catgttctaacctatagatcaattttcatgtgggtgcttggttagaacttgaaataatcccaaggttttgtagcctgttctttatataggggtttttttttttcatgctctcgtgatgcaagtatggggtgtggtttgttctctgggagacatgagacgctaataagatgattattgtacttttttaaaaaaatggctgtggaccatatgtcatatatttgttttttgggattatagttgcaatgtacctttacatgttggagatttatgtttatgttccattcttttttttcaatttgccacttctttgataagccaatcgactatttgccacttttcatctcatatgaccatgagaccatcccacactttcttctcacccctatagtatgacaaacaaatatttcttcctcctccgatacttatttacccctaaagtggactcggccctttatttgcccctaattctatatacctatacaatcaatccccactatatgtagtcaataggattttgcaaccttctcatgcttccgcatcatcctaattgttcttcgatctccatcctatgacaggcaagctgtctaggcaatactaggaatggcgagaagctcccacgtcttcatctaataggccaaatcaaagactagcccaactcatccgacctactgcctaatggatttggattggatggccagatccggccttcctcatctctgactacggcctcccctgccagctgttccctagtca

SEQ ID NO: 44406 - DNA, 892 bp, Oryza sativa
cctgtacataccgttatgtaagccctttggcactatgtaagcctttcggcaagaaaaaaaaagaaagagagaaaaaagagaaaaaaaactggatgtagggctattatccaccatggaggcccgaaccagtataaaatctctgtgtcctccgccttctttttatttttcgtgtgattgataatttgtggaaaaaccccaaggcaaacgcctgatcagcgaaaaaggccaggggggcgaaacgaatcggccgaagcatcgctcgccgaacgttgaaaccgcaacagcttgtctcagaaaataactagccgaacgatgttacgctcgatcaacataaaagcaaaagcgtttctttcaacacagaacgctacagatcgaaaacgaacgatgaaaagctgaaaagtcagtacacctatttcgctaatatacgcaaaggggccggcatgttccgacctaacaaaagcacaaaatgtgacgatgcgaaaaatagcgaaaaggaaataaaacacatttttattaacttcgaaagaatagaaggttcacacgatacaattcaccttacaagtaaaaatacatcttcgcccccataatcactatccctccctaaggaagggtcaggcgaactaggttcgtcatcactactaatatcatacacaaccttaagaggagtagggggcgaaacacagactaaactataacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccaatcggcaaccttgaaaaccttatagctgcgaccgtttatctccatttcgcgataagtaggacgaaa

SEQ ID NO: 44407 - DNA, 1501 bp, Oryza sativa
gagaatgttgtgccggtaagtaaacagtaacaagttgtgaattttcattatctgctagctagagtgtcagctctgaagaatatatcagcatatgtagaaacatgatgaacattagtttcagctgatttgttttcttgttactgtcatacatctctggtaataatagaaatgggataggttttccactctgtctgaaaaaaataattcagctgatattccaatctcactcacctcacctgctgaattcccatagccaaataaattgattccataccacctattataggggatagaaaggggagaggttttcctctctgtctggccaaaaaatatttcagctgatattccaatctaactcacctgctgaattcctatagccaaagaaattgatttattagacatactccctccgtttcgaaatgtttgacaccattgactttttatcacatgtttgaccgtttgtcttattcaaaaaatttaagtaattattaattcttttcctatcatttgattcattgttaaatatattttatgtaggcatataattttacatatctcataaaagtttttgaataagacgaacggtcaaacatgtgctaaaaagtcaacggtgtcaaacatttcgaaacggagggagtaccaattattgtatcttcagattagtgagctgcatcagaaagtagtatgcatgatggaatcagagaaacaggagtagcagctgcagcatctctcttccaaacctttaaatactaatccaacaatgttacttttgcttaccagataagttaacaccacaatgaattatcaaatcccaaatggtactgaatcaacacaatataatatggcatataagttgacacaaatgcaaacgaccaccacaaagtgataatttagtccaaagagaacataaaaaaggaagatgagaggaattcagaagaagagttttgagtcagtcagtatcaaggtcatgtgattgatgattcagcatcccttgaggctcagtggcctaatgagctgccacttgtcctaatgactccacattttcctgtcaatttccacactaactctgaaacaaagctcaaaacacagagcaaaaatcaaagaccaaaacttccatctttctctctagaccaaccaagaacactgcatttccagtaccaaaataaaacaagaaaaacaaagaaaactacttcctccgtttcagattataagatgttctgactttggtcaaagtcaaactgcttcaagtttaatcaagtctatagaaaaaaatagtaatattttcaatccaagctaattttattataaaaatatatttaattattaatttaataaaaaaactaatttgataatgtaaatattactatatttgtctataaactaagtcaaacttaaagcagcttgactttgatcaaagccaaaacatcttataacctgaaacgaagaaagtacaagacaactacaagttcccagctttctcttcccatttcgattgcggcca

SEQ ID NO: 44408 - DNA, 328 bp, Oryza sativa
attataataagctgatataaaataagctgtgagttgtttgtttgtctggattattggagggatggattattgggtttgaaaggctaaagtctataatgccctcagctatctattcggttgatggcatagatgggtaatttttctcaaatatgtaagggtagtgggtctttagccactcaataatctaaaaaaagctcctttaaagcagcttattagattataataatctggcttatagattataataatctgctataataatctatttgtttgtttcagtttactcctataagctagattataataatcctaagctgaatcaaacagg

SEQ ID NO: 44409 - DNA, 1501 bp, Oryza sativa
atggtgcttaaatttaaattttccttcaacattacatcattgccctctgatccagatcctatgctcctcacccctgctccccttctcagacgaccaggggggccacgacccgatgctgccgctcctggcagagatcgctcccaagttcccacgggaggcagagaacgagacgaagaggacgggtggggaaaaagcgatactgggagaggataaggtggcatcggcagctgagttggccagaagaagatgggccatctcggcccagatgcgcagcaggcccccaagatggacctcctcactcagtccactcaagatgacgaggcccaagcttccataggagaccagcccaccctggtgcagcaggccgactgcgaggagcaacaccaggccatggtccagactcagcccatccacggaggagaaggtgaatgtgaaaaggtcatcttatctcctctgttctcgcagctgcaaccaccgatcatcctgcaggcgccgctcgagctagcgccgcccggcgtggccaagacgaaggggtgcggacgcaaggtgatgcagatgccgtcgcggtggagcggccataaggcgcgcttctcatcggtgccggtgtccaagcgcgcagaagtgcgcctcatggaggagatggggctgctcaccccgggtgaaccggtcggggatgcggcggtaggggcttatgcaaagtcctttgacacaccgcctccgtcgcatgtcatcgccggtctgcgggcgctcacacgcatggatggagtgcacgacatgccggtgccaggagaggaaggaaccaccgcaacgatggtggtctgaggcgcgcgctgtcgcggcctgagagaagtcatcagctgtcatgattgtccgcatcagtgttagagctgcaggaatggtcttccatcatcatctgcatgtatcctttacatttctctgcggccttaagccgctgctcgctgtatggtcgatgcgactagcgctcccatgctgcaacggccttaagccggagctccttagtcgattgatgcgaatagcgctcccggtaggcaccagccttcagccggttagtagcagagtagacaggctagaagataatgaaattgcttctacatggccatgtttggattgtagttgtaggtcatggaagaaaatatgtagccctctatctgcttatgaactaattcatttggaaaacattatggggtcgatccttttggaaaaaattgtgtgttatacttcgcccaaatgttacaacatctgagaattctcaattggaatgttcgcggactaaataacccagcacgaagagaggcagtcctcgaagcagccgagctggccagagcaggcatcctgtgcttgcaagaaacaaaattaagttgtatagaccaatggatcggcaaagagatcgggggaagcaagctgtcgaacttcaatttccttcctgccaatggaacttgtggaggaattgccatcttctaggatgacacaattgttaaca

SEQ ID NO: 44410 - DNA, 277 bp, Oryza sativa
ccagccagccaataaccttgattctgctactgtttcatttaaccattgcactccaaccttgttgattcttgttgcagtggtcattatgcctcgtgagaagagacagaagctttctcaagatgttcctgctgactcgagccccccggttcgtggtcctagggggagattgggacaaaaaaaaagttggagttttttacagtgggagtcagattccgatccattccaggagggctggtagcattgtcattcgtgatgcaccccgctcttcctttcaagg

SEQ ID NO: 44411 - DNA, 281 bp, Oryza sativa
agttatatggacgttgtatcgacttataaggattacatacgaattggatttagccgattgcaacaaaggtttaattgattaactaatcatttggattttacgacattggacctccagccgatgtattctttaaccttcggattagcgcttattctatcatatcattgatagccgattggtttccactgaattatattagttatgttacattatcatcagtcaactgtctttatatcattatctacattggacatataatcgattattcaaaaccctgtcca

SEQ ID NO: 44412 - DNA, 233 bp, Oryza sativa
agggcggatatggcggcagagagggcggtggagatggcggcggagagggcggcggagaggttgaggcggtgacggtggagatggtggtggagaggacggcagcggtcgagagagtgagtgaggaggcggtggtgaagagggaggcggcgatggcggtgaagagggcgaagatggcggcagatagggcggcagagatggcggaggagagggtggcggagaggttgaggcggcga

SEQ ID NO: 44413 - DNA, 196 bp, Oryza sativa
catatgcgcgggcttcctttctagttataaaaattagagatgattatgtactcacaccctcttcttccatcctcttcgtccatcattcaagtcaccattggatcgggcgatacaaaataaactgagtgatttattggtacatcatctgactcccctgcttgccctcgtcgttagctttcgcttttgcaccgttagg

SEQ ID NO: 44414 - DNA, 1501 bp, Oryza sativa
gatgaactgtatttgcagacttgcattccttcaatagggatgcaaagtgactaggataaacatctacaccaatgcatgctgcccttgcacctgaaaggaaccattctccaattggttttaccgccttaggcaagttcaaaagcatagctgcagtagaataccattatgcataatgaatcctcaaagaaacagccattgcatcactgtatgaccaaaaataactgaattagcaaaagccatcatacatattacatcaatctcatgcaaaccaatgtaatgtaaaggaagaataagtcaaagatcacaaaggggaataggcatgctatccatcagggttgcagaatcaaaggtagtttgtagtatcctaccatcctgtaaaatccttcttatctggattattggggttttaacaacctaacatcatgcaagatcaattgtcaactcccagtgacaatattcatgcccaaagcttgttctatgtagcactaaagcattgcgatgcttacaaattatccacctgagcatgtgactgtgaatgtccatttcatcatttcacttcaaatgtcaatctcaggacaacagcggaaatactagccctagtaggaaaattttgactatttatgtgtgataagggggtataacatgaaaatagtttgagctgcaacagatgcacacatagacatgactataggtttaccaaattgtcagaacgcacgagagaatgagaaaggaagaataataacaaaggagcaactgtttgtaccttttgtattcacaaacactgcagttcaaatcaaccatgagaagcaacagtggaatgatttcaaatcaaccaggaatgcaaactaaattgttctttatatcatatcaacgcctcctaaatctatgaggagtatgtggaaaaaattcgaagttcaatactacaactaataagacaaatcgaagccattgaagggtgtcaacttttctcactataccatgtcccatccattttgattcaattctttgaaaaccttacaacaaccagaacacaatggaaaaaaaaagaagataaaaacatgaatggttccacttcttacgatctaaatcttgaagtcctggtacaagtccccttgtttcaatttagaacaactgaaatccactttttaaggaaacctttgataattggatttgcttgtactactctctatctgtggtctgtactattgattaaccataagcatttattttgagcaataaaatctaaatctggcataataattcatagtaacagtttttcaaaattaattgacaacataaataatgatttcatttttttgttgggcttaagcggtatatggcgtaactatcaacactggaagcagtgggagtcggcaatgtataattgccaaagaagaaaacatgaataaaggaaagtaaccatgaaacttcatcatccttcaatttctatcagacacgattaattgccgatgctgaacccgtcccactacaatgtatagag

SEQ ID NO: 44415 - DNA, 1501 bp, Oryza sativa
atgcccttccatctatctcaagataaggggcagaagcgtaataaataatcgcatggtagaacacgtacttggggaatacgcttcatccatgggtttacgaacagataataatacgctagcactctcctctcctctcctcttcttcccccgggagactccgccgccgtttatcgcctcggcggcgcggaatcctctctcttggttcgcaaatggcagccgcacggggtagcttatagggatcttcttgggagttaccctggttgactggtccgctcattcatcgaatcaacgcatcctgcgccgtcgcctcgcctgttcttcaatttgccgccggcgccggcttcggcttggccatggtgctccggcctcacgggagttcttgctgaatgtttatcatggtatattaattgtttcttttgtgtgacaatgtgggaatctagtattctagtcgagtcctactgccgttctttgcaaccttctccagtttgtggcaatgcgttgcggcgctgtcagcgctatgcatgtttgtggtgatttgtggttcttctccgtttcacattataagttgttttatttaggtttgatcaaatttatagaaaaatttagcaacatctacaatactaaattagtttcattaaatatattttgataatacgtttgttttctattcaaaatgttgctgtattttttagaaattaggtcaaaattaaaaaaaaagattgattaggaaaaaaagtcaaaatgacttataatataaaacaaggtcgtaatggactgttaaaattgctggtttccatagcactttgcacgtcatatgtaccagtaattgttattcattcagccattgttccttctcatttgctccgcaacacatagtctgtcaagatagaaaaataatactataaatctacttattcagataagcttgattttttttttttgaggattggaacaaaataattggttgattccgtattgtactgtcttttttacttctattgtgttcttttatttctgccacgtcacacatttagtttctaaacacccattgctcttccattccggctatcagcttaaggactgttttatgttgtaaaacagtaaaagtactgttcctttggtagattagccctaaaggaagctgtttgttcagataccaattgagaaccttttcttctgtaatatctgcctaaaaggttgacttgtcatgaaatcttcttatattccgtaatatttctgtatttttttctcatgtctgaggttgcctgatactttgcaggcaatgtagagctgttcagcaacatttttttttttctggacaaaaatcaaaaccccaaaagggcattccaaccatttagctaagcatgatatatcctatggtatcgtgtactaaatcccatgttctctatcaaggatagagttaaacggctaattcctgctgcccaatgctactacttgaaaggaaaaatgctcagcatttttgcaacagtgttccctcatg

SEQ ID NO: 44416 - DNA, 766 bp, Oryza sativa
atattgaccgtcaacaatatattattttaaaattattttgtcaatattgtatggcaatatatttttatcagtagtgatagtgttgcttggcacgagtttcaccatgttgcggaggtatgctgaataaggtctgttcgaaaccatgcaaaaatcaattgtattcattttatggcataaaatgcccaacccataccattgctaatcaataactaaccaagctaggtttaatgtttaacggtttattcaaatttcactcttaagtatacataacagtttaatcgtagatggcgccccggatgatgtatacactcctgtatgtgcagatgcaagcacgccccatcctggtcctccaatgggaaccaccccatgtgccacctcaatggcaatgcaaccttctctttccatgttttgtttacttatcctttgataaatttacctcatccattatttttttctaatataatgtgctgtttgatttggcatagttttgtttgatttaaaaagatgcatatgtaaatataatattttgatctttcaaaatgtctgtggtgccttttctacaatataatcttacatacattttataaatctgtaaaaaatgtcttgagccttatagttaaatgggggaaagtaataactagtggtaccatgtagacattgataggtttactccacttataatgaaatcaacccatccacctataaaatctcattgagcactgtgcatgatcaatcagtagctagacactaccatgtatcgcgcaca

SEQ ID NO: 44417 - DNA, 1501 bp, Oryza sativa
ggatactcctttcggtagtaagcctagtaaccacatgattaaaaaaaagggagaagttttaacaagattaaagttttgtttaatttttttaaaacatggctgatatacagagcaatttaattaccctaccaaggggtaggccctgttaccatgatagctatagcatcaaacatgccatagaggggctaaatagagatttaaaaactaaaggctgagattacactcaattgtgataaacaaaagctactacatgcgtagggttcaaaactagcatggcacaagcttttttaacttatttgaagtcctactcaattctagtaatgtaattgcaagcagtagagagattgagatatgaagatcaagcacggagacacggagactttttagcaaggtatcatagactcagtaatctattagtcctcattggagcactctacattatagtctcacttctttttatggtcacaaagtccatagccgctcttttgtatagctattcttcactatggaagccaaactccaactctccaagcctttcccaagatcatcgggtcttccacaaaatccttaagagatgccatgaataacaagatgaaaacttcacttgaagctactcagcactactcttttgtgagtgcgtacaaagccactacctcgctcaagtaatcactctgaaagcttaagtcctccacgagttatctcaagttgcaatgttatccaagagataggaacaggtacatagcatagagtatttagtctcgactagcactgtatatttatacctcaactacacaaactagccatttttaaacattgcctttgaagtgcataggacatagtctaaccctttaaacttttgcgatggtcactgaaacaactagcagttgcgctataaaagggcagatagttcgatcttcaccggactgtctagctggtgattgtttggctaatccaacccatagaaagtacattgcctagacttgttcggtccattggtgatcaacttcatccggatagtccagcttgcctagtcatttcagcctattgaagttgagctggacaaattcattgtcctacgcgtcaaatttgtatataacaaattgaccagccatttgaaaaacaaactattcagacaagtctagaccaggttggaaaaacaatagctctgacctatttggttgcacccaagctatctggcccactgagccattagggcaacttaaaagaaatgcatcaacgattcatcgagctcacttcaacttcaaccataaagacttagcatttgatttgagaggctagcagaccctagtatgcaccgcttttcttgtatctaaaaaaacatctagatttattctcgccgtctcaaaataaactaacttttatcaacaaatctagacataaacaacttctgattatgaatctagatattaactatgtccagattaatagcgacaagttgggccatgggtaactaaaaatgcccataccgcctttgcgttaa

SEQ ID NO: 44418 - DNA, 1178 bp, Oryza sativa
aaaagataagtcatgcataaagtattaatcatgtattgatcatcaaacaacaatgaaaaaactaaattataaaaaaattttatataagacggagagtcaaacgttggcacgagaactcagggtttgcctttttgaggggggggggggggacggagggagtatacagctttgccttttctctgctgacatttagggaaaggcaagcaaaactatgaactgaaaaagagtgagcttttaacttgcaagaacacgcatggcggcatgggtgagtttcttcagacaagtacaggattgagcttctcggccaccatgatttatgatttacagagctttaattgtcagtaaaattgcaagcatgaatatggcagaagagggccaaccatgtgcaaccaaaaaaggctccaacatgataaaagaacagcagaaaggtagcctggactagaccttcctttcctttgctttaacttttgagtggacaggaagactacaagcacagctgcatcattgttcgtcatctccagccatggaaattgtctcagtgtgcaagagtagagcctgcagagagatttctgaattgaagacaactttgtggtctgaaaaaatctgaaatctgcagggcattgattcatgcagtctatctgatctactgttgagcagaatttgctaccaggaaaacaatcagttatgattttgttgcatttgctaagattttgttgtcataagatcagatattaggtggactataacagttattaatcaagatatttaccatgtagcttgcaattttcaggtgattggcctgaattttagcacactaacaggaaacatgaaccctaaatctatctggggctcatggcatgtccaaggagatacgatttgcggttttgcaccccaccaacaaaaccacacaatgagaagctctcattccacttcagaaaagaatgacaaatactactataatgagaattatgaacatatggagaagaggccaaaaggggcatggctgaagtatgtgcaaagatcatagatggtgcaggatataatctaagaggcttgctctcattccatcttgcagacacattcagcaagtatcacagaacatagtctaagaggctgctctgaattctgatttccatcttgcaaacatattcagcgagtatcacagaacaagcatgctg

SEQ ID NO: 44419 - DNA, 1501 bp, Oryza sativa
acagcatttaataaacatttcagaatttaataaaacagttaagtaataattaaacaatattaatccaacgctatacaacataccctgttgcttaggcccaaccattctgaacaatcatcccggctgcacattctgaacaatcatctcggctgcacagttctatctccaaaccaggaattaaccattccaaaccaggagctaatcaaattattaccagttatagcatcttttattatgatgagaagtgtgagactaatcacgaaagacattgttagacccgcccataaccgtgggcacggctattcgaatagttgtgctctggccagaggtgtaccactgtacccacaagacacagcctcatgacatgtcaccatgcgcctcaataccaccacagtacctcggaaaggagctgtgacagtacccctcgcacaacacaatccaccacagctcaccgttcctggatcataatcacccccttataaacaaggcatggactccccagcgacccccgtgggcttatctccgccacttctcagtctggtgctccggaatgaaccatgttatacaaaaggtaaagccgttgcccacgctggcttgtggttggcacggttaatgtttcacaaccgaaaatcgtgaaccggtcctttattgtcatgagcacgaccaacaaaaccatgtgttcacaacccaccattatcaagttttagttggcaatttaattaattaaccaatcacgattgaccatcgtgaactatcattaagccatcattaaataatagtgaatcataagttatcccaatagtgtgctaatgtttctaagcatggctaagcaatcatatctgatatctagctgaaccaatatataaagctcaactagtcaagttataataacccaaggtatcaaggaataaagtaatcaagaacaaaagggctataacaaacaataggttaattccaccccatgacattagaaaataaatgtaatagttgaatagaaacaatagctttaaacgggatcaacatgctcaaagggttgtttggatctgtgtgacttgccttgctggccttggaactcttcaaattcttctcctgcgaaaacggactctccggaaacgtcggaatctaaacagaaaagagcaaaatcactaaaacagcacataaacaagcatgaacattacatgtggatatttttaatatgtagatctcatttttagaaaaatttagagacttgaacaaactaaatccgagctaagatgaattagttatgaatttttaaagattaaatcggattaaaacacttatatgagttttaattgaattatgacgcaataatgaattatttttgaaaaggaaaagggaattattgcgtcagcggctagggctcgcggtggaccgggtgcacggcggcgactcacggaaacgaacggccgagatcgattctatccacaaaggacggccaagatctaacggtctacgaccggcctacgacggacggcaacga

SEQ ID NO: 44420 - DNA, 1501 bp, Oryza sativa; identical to SEQ ID NO: 18827

SEQ ID NO: 44421 - DNA, 757 bp, Oryza sativa
tttccaaaagcaaacggaattaaaaaccgactcatacacggatgacgtaccaaaataccggcaaaaacatttttaatttttataatagtagatatatgagtattaaagttattgagttttatgtgttagaggtaacttaaggttacccttaatttatagggggtgacaagaataaagttagagatggtagccgtctcaaatactctctccgtttctaaatatttgacgtcgttgatttttttaaacatatttagctatttgtcttattcaaaaacttttgtgaatattatttaaaaattttagtagtagtatatttaacaatgaatcaaatggtagaaaaataattaataattaattaaattttttaaataagacgaacggtcaaacaagtttaaaaaagtccagcgtagggacggagggagtataagggtctgtttggggagctttagattataagaagcagttgtttgatagccagcttctgagaatctgaaaaagctctgaaacccagcttctctagcttctggcttcttagttaaagctgtggattgtttgggacagcttctagcagaagcagcttttgagaaaaactgcagctggaataacatcccccaaactttctcaccactgcggctctaaacctctcctatctatatatccgtgctcgatctgagaactccagtagtcgatccactgctaacccctaccgagttaacacttaacacctagtcatatcgcagatcgagcttagctagaa

SEQ ID NO: 44422 - DNA, 1501 bp, Oryza sativa
ttcttctaatgactcagcttttgtgtgtggtggcttctctcttgccgctttacactcagtcactgaggagcaattagagaagatccctgaagatgatcttgctctttttgctagaaaattctcaagagcttacaagaatgtgagagagagagaaaggagaaaaaccaatgaaccatttgtgtgttttgagtgtggagagcctaaccacataagagtgaattgtcccaagttgaagaagaagagtgacaagacgaccaagaagcccgagggacaagggcgaaaggggagaaaggatttgatgaagaaggcgatccacaaggtcttggcgactcttgaggaggtgcagcttagcgacatcgactccgatgacgatgatcaagaaaagggggacaaggacttctccaggatgtgctatctcgccaacaacgaggacttcatcaacctgtgtctcatggcacttgaggataaggatgactcatcggagcatcttgaggtatgtcttgatgatatcccttccttggatggttctccttgtgatgattcttgctcagataatgactctgttgatgatgaactaagcaaagaaagaatggcacacttgatgattgaaattagtgacaagtataggtcttctaagtataaaattgagaaactaaaatctgaaaatgatggaatggcgctagaaattgctaggcttcgatccatgattcctgaggaggatacatgttctacttgtgcttcatatctttctgaaattaatctcctcaagaataagttgaaatcatgtgctttaggagctgggaatccttctagtgctagtgctgcttgctctacttgctataaaatgaaagttgatatgggtttgcttgagatggaattgaaagaattaaaagaaaaatttgttcatgataggattggtaggtgtgaaaattgtcccattttcactagtgacaatgatgaattaagacaacaagttgccatgcttaggaccaataatgatttgttagaatcttttgctactaaggaacctgttcattcttcatgtgctaattgtgctatcctggatactgaactaaaagatgctaaaactgtcatttattctatcaaatctattgattcttgttcatcatgcatttctctgaaagttgatcttgagtctgctaagagagagaactcatacctacaacaatctttagagaggtttgctcaaggaaagaaaaagttgaacatgatcctagaccaatccaaagtgtccataaacaatcaaggtataggctataattttgctgagtctttgaggataagtacccatgaaattttaggtgtcacagatgggatgatataactagctcaaaaacctataaccttcaagtctgcaggtttcattggaaacactagttctagttcacccaaaacctcagaaccaaagatggtacctatgactagcaagtctaagcctatagagttacctagacccaaaaatccaaaacaagttgagcac

SEQ ID NO: 44423 - DNA, 1501 bp, Oryza sativa
taatcaattcctcaacggtgatcattgccggtcggcgctcatagttttttctataaatgttttccgcgtaaaatttgtgtctccgttatacatctattttcataataagtgatatccattgaaaatctgatctactattccggttaccggcgtgtttctccgttcgaagaaatccatctcatcggctgcagcggcgttacgcgtagttctcgtcgcaggccgaaccggagtcatctgttgactcatcacgcgtttctcaaaaaaaaaaaaaaagaatgatcacgcgtagcaggagaaaaagcagagcagcaaggaaaaccatccagcagcatgcgcatcgagaaagagaaaaggcagggctgaattaattttcacggttagaaattgctacgcacacacagcctgcttaacatgaggattccagatctacagtacgtgcacatgacaagtgcaccagaggttcacgttttgctaggtttacattaatttcttagtagcaaattcaggatcaattcccatggcgagtttgaaatatgatctaccgctcctggaccgaaacacaagattctcactatggcaagtgaagatgcgaaccgttcttgcacagcaagacctcgatgatgtgttatctggatttaacaagaggactcaggattagtccgacaataagaagaaaatggacataaggctatgtcacatattcatcttcatctatctaacaatattttgttggaggtgctcaaggagaagacaaccgttgggttgtggttgaagctagaagatatgcatgacaaacgatttgaccaataagatgcacctaaagcaaaagtttttttttttgcacaagttgcaatatgatgaatatgtgatggattatctctccacttaattgttgttgaccttgactccatggaggtaaagtatgatgaagaggatttaggtcttattctgttgtgttcgttgcttagctcatatgcaaattttagagatactattctttatagtcgttatactctaactttgaaagaagtttatgaagctttgaattcaaaagaaaggaagatgttaccctctgaaagttcaagttcacaagcagaaggtttggttgttcggggcaggcaataggagaagaacataaagaaccaatcaagagatgaaagttcaagtagctatcgtgggagatcaaagtctaaatgcatgtataagtcatgcaaatactacaagagatatggacataatatctctgagtgttggaagctacagaacaaggacaaaagaaccggaaagtacataccaaaaagtaataaagaagtggaaggtaaagccgcggttgttattaatgagaagtctaatgcagaattgcttattgcttatgctggttgtgcataaagtagtgaccaatggatttttgatactgcttgcacctatcacatgtgctcgaatagggattggtttgccaactatgaagttgtgcaaggtggtactattttgatgggtgata

SEQ ID NO: 44424 - DNA, 1501 bp, Oryza sativa
tcttctttggcaattatacattgccgactcccactgcttccagtgttgatagttacgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaagtggatttcagttgttctaaattgaaacaaggggacttgtaccaggacttcaagatttagatcgtaagaagtggaaccattcatgtttttatcttctttttttttccattgtgttctggttgttgtaaggttttcaaagaattgaatcaaaatggatgggacatggtatagtgagaaaagttgacacccttcaatggcttcgatttgtcttattagttgtagtattgaacttcgaattttttccacatactcctcatagatttaggaggcgttgatatgatataaagaacaatttagtttgcattcctggttgatttgaaatcattccactgttgcttctcatggttgatttgaactgcagtgtttgtgaatacaaaaggtacaaacagttgctcctttgttattattcttcctttctcattctctcgtgcgttctgacaatttggtaaacctatagtcatgtctatgtgtgcatctgttgcagctcaaactattttcatgttatacccccttatcacacataaatagtcaaaattttcctactagggctagtatttccgctgttgtcctgagattgacatttgaagtgaaatgatgaaatggacattcacagtcacatgctcaggtggataatttgtaagcatcgcaatgctttagtgctacatagaacaagctttgggcatgaatattgtcactgggagttgacaattgatcttgcatgatgttaggttgttaaaaccccaataatccagataagaaggattttacaggatggtaggatactacaaactacctttgattctgcaaccctgatggatagcatgcctattcccctttgtgatctttgacttattcttcctttacattacattggtttgcatgagattgatgtaatatgtatgatggcttttgctaattcagttatttttggtcatacagtgatgcaatggctgtttctttgaggattcattatgcataatggtattctactgcagctatgcttttgaacttgcctaaggcggtaaaaccaattggagaatggttcctttcaggtgcaagggcagcatgcattggtgtagatgtttatcctagtcactttgcatccctattgaaggaatgcaagtctgcaaatacagttcatcaaattcaccaacagataattgcttctggtcttctttctttgcccacaccattattgtcagtctcactaccagcattgccatccgaaccatttatatctccaaga

SEQ ID NO: 44425 - DNA, 1501 bp, Oryza sativa
tatttgtttaccatatcctctaaaggtttcttcctccatttacatggatacgccatatgatcaacaagtctgcagaccacaaccatgacttttcaaaaaaaaatcattcgaacagaaattgcttaacgaaaagcaatttacaagtaccgagatttgctccggtccaacaaaaagtacctcgaggtaccggtacctcacggtatcaaatcatttccgatctttggatctagctgggcaggatgtgcattgctagatccaacgatcagaaatgatttggtaccgtgaggtactggtactactagaaaaacgatttttcatggcgttggcctattattttcgctggcggaaaaatgtgaaaaccaccgcaaagtcgtaacgagtggatgaggggcaccgaccgccagagaaaatgaattttcactggcggcctgtctaacgcggccgccagcgaaaatatgtctatttttactggcggtcacttaggtgcgctgccagcaaaaatagataatcttcgttagcggtcgaatttttcctggcggctaataaacaaaaccgccagagaaaacccagctcagtgatccaaaaatatctggtcacattaaaaccacccacctacctcatcctcttctccttctctccatatcccctcctcttctctccatatccagtcacattatccactcctcttctctcctcctcactctcctcctccctcccggccttcccaccggcgacggtggcggcggctctggcggcggtgaccggcggctccctgcactgcccctgccgtcccatcccctctcccaaatctgtccgaggggaggaggccgccgccggcggcgcaacaaaggcggcggtggggaggacggatctgcctcagcggcggcgcggggagcacgcggcgcgggcgacagcggagctgacgacgacgaccgcgaccgcggcaacaacgacgatgacaacgacgctgcctgccgggctcagtgaccttgaccacgcgcgacccttctggaggaggcctgcagcggtggcaccactgccctcccctcccctccccccctcccctcccctcttccagatctggctggaggggaggcagccaacagatggcagcggcggcggctcgtccccgatggcttcagcggctagggttctcttgtgtgttttggtttgtaaggatgttaggttaatctgtgtgttgttaatctgttttgttgataatgccaatgtgttgtgtttgaattgatgccaatattatgtatttgtgatgctctggatttggattgatgcttgaatgatgtttatgtccattttcagatatggactgttttgaatttggccgggcagagaattttgaatttgggcttggggatttttggtggggtaggttgattttcactagcagttctctttaggcaaccaccagtgaaaatgggttttcgctagtggacctcaactgccagcaaaaatcgtttgtccgctggcgaaaatagattttcgc

SEQ ID NO: 44426 - DNA, 242 bp, Oryza sativa
gtttcgctacttgggtttgtagcatatccacagtggactgaaggacatccaccttcttctccaccgcagggatccacgattctaccgcctccttgaagaccctcatctccaaactctgcttcttctcaccctcctctcgcttgcgctctgtctcctccattttcttcaacagaaggtcaagcttagcctcattctccatgattttggccgtctgcttcgtcacaaatcgtggtttctccagg

SEQ ID NO: 44427 - DNA, 277 bp, Oryza sativa
cttttgtgaccaagcttataagaaaatatagcaacatttccacaaaataaatatactacaaaaatatttaaaggggaatataaagaaactaatttggtgctttaaatgttagtacacttacctataaacttggtcaaacttgaagaggtttgacttgacaaaaccgaagtgacatataatatgaaaccgagggagtatttaggatttatgcgtttttcatatgggcatttatcttaattgctcctttcagtttctgaattctttgattccctccagg

SEQ ID NO: 44428 - DNA, 1501 bp, Oryza sativa
gcataatatagggctcatttgcaaaagcagcatttagcaaacatttgagaattataaaacagttaagtaataattaaacaatattaatccaacactatacaacataccctgttgcataggcccaaccattctgaacaaccatcccggctgcacaattctatctccaaacaaggaatataccattccaaaccaggagctaaacaaattaataccagttataacatcttctattatgatgagaagtgtgaaactaatcacgaaagacattgtttgacccgcccataactgcgggcacggctattcgaatagttttactctgatcagaggtgtaccactgtacccacaagacacagccccacatcatgtcaccatgtgcctcaataccaccacggtaccttggaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacgattaacgtttcacaaccgaaactcgtgaactggtccttaattgtcatgagcacgactctcaaaaccatgtgctcacaacccaccattatcaagttttagttggcaattaattaattaaccaatcacgattgaccatcgcgaactatcattaagccatcattaaataatagtgagtcataagttatcccaatagtgtgctaatgtttctaagcatgactaagcaatcacatctaatatctagctgaaccaatatatataaagctcaactagtcaagttataataacccaaggtatcaaggaataaagtaatcaagaacaaaagggctataacaaataataggttaattccacccaatgacattcgaaaataaatgcaatagttgaatagaaacaatagctttaaacgggatcaacatgctcaaagggttgtttggaatctgtgtgacttgccttgctggccttggaactcttcaaattcttctcctgcgaaaacggactctccggaaacgtcggaatctaagcagaaagaagcaaaatcaccaaaacagcacataaacaagcatgaacagtatatgtggatatttttaaaatgtagatctcaattttagaaaaatttagagacttgaaccaactaaatccgagctaagatgaattagttatgaattttagaagattaaatcggattaaaacacttatatggattttaattgaattatgacgcaataatgaattattttagaaaaggaaaagggatttattgcgtcagcggctagggtttgcggtggaccgggcgcacggcagcggttcacgggaacggacggccgagatcaatccatccaaaacggacggccgagatcgatcgggtctacggcggctcacggaaaaacgacgacga

SEQ ID NO: 44429 - DNA, 1501 bp, Oryza sativa
cagaggatagagaagcggtcatgggcaattatgtgtttgccatttagcttatataactgctgtgtgtgcagtattgggtatttatcctttttatgtcttttgtgctgcagaatgagagcagctcagcaagcgattgttagagaagaataggatcgagccccgcaccaagtagaggtgtttgtaaaaagtggctagcagaataggaaaagaagattacaaagctgcttgacttgaatagccttgacttgtgaaaatttttcatgcttgatacataggaggcggcaaaagcgagtgcaaaaggaacctcgacaatacgggtgaaatggtgggctgcagctcttcaatttgttcatccaattaatatacataagcctgttctgtagcttcgatgaaattcgacggatccatatgtttcaatgtttcctcccctctgaattgattccgagaggtaattttcttaattcgccgatgtggtgcttttcaaaatacattatactcatacatatgaaaaattaaattggtctgcccatttaaatatgaatacaaataaatccttaaatacactaactatcgaatgcacgccataaaaaggattgtgaaaaaaactatttaattactgcatggaaaaaaagttctcacgtgacatgaatcacattgtagtgctttaaaataggggaattcgattaatgagaaacaaaatatattttttgtctgtcaaatatgtaaaaggaaaacgtgaaaatccatcttttaatataggcattggcgatagttattaaagataaatagagttacaccgtagcgtttagcacacgtaaaatagcaaggatacaaaaaatttaagtaattattaattcttttcgtatcatttgatttattgttaaatatacttttatgtatacatatagttttatatatttcacaaaagtttttgaataagatgaacggtcaaacatgtttaaaaaagttatcggcatcaaatatttagagatggatggagtataaaaatcctgtgacactaatatactccatggagtgacaacggtcctctttattacagaaccatcccacaccgttcatatcatgccaagttgacgacaaacgagagctggcactatcattcatcaattttgtaatagggcccgtgcacatctatctgacaaccattcaatattttgggctgttcaaatggtagacaaaataaaccaaattttgacaatttgataatattgttaaaattttagtaggatttcgtatgtactaaagtttggcaaaaactctaccaaaaagtgatatgatttgaaataacatcaatataaacaagcctttcaacgtattttttctcataaaaaactaatctaaaataaaatatgctatttttttaatatacttaaatttattgtactagtaaacgtcatatttcatcatagatcgttcttttatgggacggagggaataggagccgcctaaccaccaaccgacgtcccaccacatgttggaa

SEQ ID NO: 44430 - DNA, 1501 bp, Oryza sativa
ttgtccttgttctgtagcttccaacactcagagatattatgtccatatctcttgtagtatttgcatgacttatacatgcatttagactttgatctcccacgatagctacttgaactttcatctcttgattggttctttatgttcttctcctattgcctgccccgaacaaccaaaccttctgcttgtgaacttgaactttcagagggtaacatcttcctttcttttgaattcaaagcttcataaacttctttcaaagttagagtataacgactataaagaatagtatctctaaaatttgcatatgagctaagcaacgaacacaacagaataagacctaaatcctcttcatcatactttacctccatggagtcaaggtcaacaacaattaagtggagagataatccatcacatattcatcatattgcaacttgtgcaaaaaaaaaaacttttgctttaggtgcatcttattggtcaaatcgtttgtcatgcatatcttctagcttcaaccacaacccaacggttgtcttctccttgagcacctccaacaaaatattgttagatagatgaagatgaatatgtgacatagccttatgtccattttcttcttattgtcggactaatcctgagtcctcttgttaaatccagataacacatcatcgaggtcttgctgtgcaagaacggttcgcatcttcacttgccatagtgagaatcttgtgtttcggtccaggagcggtagatcatatttcaaactcgccatgggaattgatcctgaatttgctactaagaaattaatgtaaacctagcaaaacgtgaacctctggtgcacttgtcatgtgcacgtactgtagatctggaatcctcatgttaagcaggctgtgtgtgcgtagcaatttctaaccgtgaaaattaattcagccctgccttttctctttctcgatgcgcatgctgctggatggttttccttgctgctctgctttttctcctgctacgcgtgatcattctttttttttttttttgagaaacgcgtgatgagtcaacagatgactccggttcggcctgcgacgagaactacgcgtaacgccgctgcagccgatgagatggatttcttcgaacggagaaacacgccggtaaccggaatagtagatcagattttcaatggatatcacttattatgaaaatagatgtataacggagacacaaattttacgcggaaaacatttatagaaaaaactatgagcgccgaccggcaatgatcaccgttgaggaattgattataaacgtagaggaataacaatggaacgtcatccctctctgttcggcttacaagagtatatgtaaaaaaaaaagacatctagtagaaaaagatatgaagtcctatttaaaaaactaatacaaatatattgtaggcctaaaattcagatcacatatttaagtgtgaaaataatcattttaaaataagtttttaggatctatttgtagaataattattttaaaaggatca

SEQ ID NO: 44431 - DNA, 204 bp, Oryza sativa
ttttagaaaggttaatggacttttagtatataatagaagataggtaaagaaaagataaagattaggaaaggagatgaaaattatattgaatacaaaaatttagggacggaatattcagtttttgttagcaataaataaataaataaattcctcaataagaagggggtttctcttttctttgccgcgtgcgttcctctcctcagg

SEQ ID NO: 44432 - DNA, 1501 bp, Oryza sativa
cccttgcgacttcagacaaaaaggttggtgtgaccctaaccactaggatacacagtgctacgtcctgcattgcaatgaaaatttcttaattaaacgtgtcaagggtgaggcatttgaaatgagatgaggcataaaaaatcagctacctctatgctgtccaccatagccagtagttggaccggaagatgatgcaactctatggacacacaactactccttcgttgtgattttcccacgtcaacgtgtggatgaggagatggtgtgtcgcttgttcatgccctcgagttatgttcatatcgccgaggacctttgccaccctttattccaccctagcgtccatgtcctgcttcagctcttgaatgacctccttgaacggctccttcatgcaagcatccatctcttctattgagattttccttttctgacaatgcgcaacatattggggcaagccatgcctccatggcacgtcgcagcctattccccgagttcgtctaggatgttctggatttccgagcgccctcgtgaaaacgtcatcttcggcctcctcgatgcagactcaacctcgcattgtgaagtttcttcagcaatcaaccccatctatatattataagggtcaatcgttaatgacatgtaggaagtatgaaaggagcttgcgagtacagcattacttaagttaaaagggaactcactagttgctgatagacagtggcatcattttgttttggaaatgtaatggtgtcgtcctggttgaccttaccactgggtctagcccagtttcgagctagtacttcagagatgtcagtgaaagggatagggacatttgctgcagcagtagcatcatcctcttgagcccatatttcctccttctcgatgtaccccgttgtgccgggtcggtgtgggtgctcattcccgaactcttgaatgcttttgagcccgaagaactcctcccacaccttctctattatttgtaggtaatcgttgaaggggtccgattactgggcgggatgaaatattcggagaaaagcttccacttaaaattcttccatgctttgcccatcttctgtagtgccgtctagtttctgcttcagcaggatagttgaaccatgtgactaatgttgtcaaagctcgctctttctcgaccagctgcaccttgttaatacctttatgaaggataccaaaatgatcaagtgctacacgcctgcaactgttcgaccatttggagatgacactcctcgacgctgtaggcttaccactttcatccacaacggtgataacttgccgggtggtcggtaggtggttttgcgtccgagggttctgcccagatgtagctccacttgtaccgcccgatatggacatatcatgttgcttagacatttctgcagcgaagaaactactgaaatttcctacgcattttctaacatgtcccatatcatttcctatggcatgtcctaaaatttcctatagcatttcctaaacattttccaaaacaatcctacgcatc

SEQ ID NO: 44433 - DNA, 1501 bp, Oryza sativa
ccgaatctactaagaatgcgactattggcgacttgataattctcatcggccaattccaagatgctgaagccaatagtgattctaaaccgatgatgactttggggcttaccaaaatttgatgttaacaactaggtccaggttgaggccatcccatttttaaagttatttggtttcaagactaagcaggttgggttggttttaaaagcgaatattccactcgtatttgggttgaccagatcattgaaaaataactggacagatcgaatgcactttgctcctcctcgcgcacgtgaggtgcacgcccctcccaggagtgagaaatttgcatatctgccacccataaaaactagcttagttagaatgccaccgtcaaaatgggatttgatcaaacgccactctcaagctgcgcgcattcgctgcaatgccactttcgtggttttttacatttcgaaattaattttcctcaattacaatttttgttgtacgtttatgcccatgggtcaactggttgaatcggacttggtttcttcttggtctctctcatttggttgaatcgagcacgcaagcgtgagcgcgagcggagaaaaggtggagacaccggcgccgcccaccaccattgttctgttgctgttccgctgcgctagccgagggagaggagagaagaccaaagggaggggcagccacgcctgcggcaccaccttccccaaccgaggcacacccgcgctgcctccctcgccatccgcgcggccgtcttccccaacagcgccggcaccgctcacctcgttctccgccgccttccctaaccgcgctggctgcgccctcggagaaatcttgtggcggcgcaccctcctagcccaccgacgcgctcatctcccggttgacgggggcgaggatgccgtacactgccgtccttgcggcggtggcgccaaggacgagaaaggcgcgcggctcgactggccacaagaggcagcgcgacacaacgaggagtggagaggcagctcggtgggagaggcggtgcggccaagttggtgaaggcggcagcgcctctcttactccaccggcgaggtcccaagtcgccacccctcctctccggttcaacctactgagccaggggcatagaagtccaagaaaaaaataaattgaggaaaaaacaatttagaaatccaaataaaaaagtaaaatggtattgcagtgaatagccaaataaaaaagtaaaatggtattgcagtgaatagtcgagggcttgagagtggcatttaattgaatcctattatgatggtggcattctaccgaaacggcgacgaatatacaaatttcaccccagaagtggtaaccctatctccctactgttcgcgtttttccccatcgaaagaaggcagcggcggcgaccgtgcgagcgcgaggcgagcctgagtcggcggctcgcgaccccctcctcgctgaaactcggttggacaacgtcgtcattctctcgccattggctgctgcggcaaaacaaatc

SEQ ID NO: 44434 - DNA, 1501 bp, Oryza sativa
gagccaaggaagtatttttaataaatggaattgtatttcatgaataatttaaattggaaaaggtttttaaagttcccttttggctttgtccctctctctcctctccggcccaatcggcccagtcagcctgcagccgcccgcgcgcgcgcgctcggccgctgacaggtgggtcccacctgtcggactcgtcgtcctccttgcgctgaaaccctagccgcgcctcgccgccgccgcctttccaattcggccgcatctttcccgatccggtgaaatagtttgaggggaaatgctccccgggatcttctctacctttttccttttggaatcgatcgccaattcggtttggaaatccgtggactcatgttcgattcggatcgatctctctcctccgaaccctaaaccttccatcgcgtcgccggtcgccgtgggccttcgccgccgcctccttgcccctataaaaggacccccggtgtctccgctatccgtcgccaccctcgcctttgcccgccgccgtctgtagcgccatagcaccgtgcagccgtgcgccgccgtcgccgccgcagctccagccgtgcgccgccgtcgctccggtcgtcgtcgctgctcggggaggtcaccgttgtggtcaccaagccgtcgccgatctcgtccacccctccgtcgtcgccgtaggtcaccggagcatcgccgtcgtcgtaaagccgaaggtcgccgccgcttattccacgacgtcgtcgccgtccgttgatcttctgccactgttttggtcaccggtgagttcgccacgtcgccctctacgtgttggtgtcctccattcgcgtcgtcgcgccgtcgttcgccggcgagcttgcgtgcccgagccgccgctggtgatgacgtcatcgccgacgtcatcgttgccgtccgtcgtaggccggtcgtagaccgttagatcttggccgtcctttgtggatagaatcgatctcggccgttcgtttccgtgagtcgccgccgtgcacccggtccaccgcgagccctagccgctgacgcaataattcccttttccttttcaaaaataattcattattgcgtcataattcaattaaaactcatataagtgttttaatccgatttaatctttaaaaattcataactaattcatcttagctcggatttagtttgttcaagtctctaaatttttctaaaaatgagatctacatattaaaaatatccacatgtaatgttcatgcttgtttatgtgctgttttagtgattttgctcttttctgtttagattccgacgtttccggagagtccgttttcgcaggagaagaatttgaagagttccaaggccagcaaggcaagtcacacagatccaaacaaccctttgagcatgttgatcccgtttaaagctattgtttctattcaactattacatttattttctaatgtcatggggtggaattaacctattgtttgttatagcccttttgttcttgattactttattccttgataccttg

SEQ ID NO: 44435 - DNA, 1501 bp, Oryza sativa; identical to SEQ ID NO: 18831

SEQ ID NO: 44436 - DNA, 1501 bp, Oryza sativa
tactcaagtatcaaaatatacgggatatatagccgacagttcaagactctattgacatcagttggtatcggcatcggctggaactactccatcggcttgtcagccgatcagctctttggtgatcaacatatttgtctattttgtcaattgcaagatcaaactgataggcacgccagcatctcatcaatattttggatatgcactggagctaagcggatctcctaggccattgtgttcgtcgacttagttcgcgctaacacagatctggcaccatcgggcgagcgtggatttttcgtcaatactagcaaaaccctccaaccaacaagtttaggctctctttgtttaggcttataagttactccttccatttcatattataagtcgttttaattttttttttcagtcaagcttcttcaggtttgagcaagtttataagaaaatttagaaacatctaccacatctgattagttttattaaatataatattgaatatattttgataatttaacactctttaaaatgtgttttgattatttgacatcctggcctactttcattcactcagatggtcccacgtatcatcctcacaagtgtcaattagagcaattgggcaataaaaaaaatgttaaattatcaaatatatttcataagagagatgaaagagagggaggggagacagaggataagaaaagagtggaggaagttaaaacgtggaggtggaggagtttggattatattctatgggtggatttttagtccactaacaatagtaggaggctagacatcttttaaaccgagactaaaaataatttttacaccaaccgggactaaaaattataaaatagcgttggacttttcaactgggcctggcgttggacttttagtctcgattcccattcaaaccaagactaacatggtttttgcaccatccatcaaaagatcacttctccgattaatggtcatggattgacgtggatgaaagagagggccaacaatggtgaaagcgtagactccaacgctgcatcagcatcacggaggaaggcagcagcgcggcgcaattagcgcgtgatcgcatgattagtgcgtgccgtaccgtgtaaaaatactcgaagcattcgtcactactgatcagcggcgaatcctttagcagattcttttcttgtagcctgccttttgttttgttatttccttcctgttttgctcagtctcaagctgcatataatgctctcatgcatagtgatataatcagaagcactcctttcactcacccgagccaaccatggcgaggcaaaccaacggcggcggcagcaacaagaaaccttctactgctgccggcggcgatgcctcaccggacaagcaaaatgcgccgcctcccgaggacaagaagccgccgccggacggcactgcaccgtcgcccaccacccctgccaccggcaataataatccataaggatcctccgccgccgccgccgccgcgacagccggcggcggcgaagggcac

SEQ ID NO: 44437 - DNA, 457 bp, Oryza sativa
actgttgccttgaatcacccgaagaaattatcaccatagcgttcgctcttctccttcagtgacgtagatttcatatatccccatcatgcaatccccgcagattctggatatatcctgtactgccaaacagcccgttgacgccctcaacgattttcacccactgttgcccgggaatttctcacactctgctagacatgtcgagccacccttgtgctgctatcctaccgagccaatacttgacttaacacgcctccacgtgcaaacaagccaagcacaaaccgcctcagtttctttagcatgcaccactgtgacttgtaataatagtcctcagctttgctcctggtgaacagtaccctaacaacacgtgagcagtattggctcctacaaaatactatcaagcttcaccaaccggcccaaaaaaaaaatcccttttttccttcttaattgccgattaagc

SEQ ID NO: 44438 - DNA, 1501 bp, Oryza sativa
gtgttttggttaagagtgagcccttctcatatgagtgattcttactctcccgtcccaaaaaaaactcaacctaggaggggatgtgagacaacgaatctggataaatggtagtccagattcattgtactaggaggggtcacatcccctcctaagttgagtttttttttatggaggaagtatactactccctccgtttcaggttataagactttctaccattgcctacattcatatatatatatatatatatatatatatatatgggttagaaagtcttataatataaaacgaaggtagtactgtacatatgattgggtatgggtgtttcttataattgtgactttcagataataaaataatatcccatgttttttttaaactaaataatatccgatgtttttattccattatcataaggaaaaaaaatcccatgaatgatatcattgccggcggttgcctgtggcatgcaagcagttggcagattcttctcgtctcacagcatattgtcccttggcccttgggcattccaaatttctaccaataatttcattctaagaactaaagtcgacgtcgccatcccggtgcacgcacgccggccatgctagcttgcagatagaattggaatagttagccaagccaactccaaccaaagaccctacacatcaccatcctatccgttctacacgatgaaatattcactccatttctaatatacgttgtcatcgatttgtagtgcgtgaacagtgattttattaaaaaaatgtaaatataaaagaatatatgtaagtcatacttaaagcagctttaatggtaaaaataaataacaacaaaaaatattattattattacatattttttcagtaaggttaaagataaaacatgtgtacagaagttaatggtgtcatacgctaagggggaaggggatagtgctaatctattcggtcgcatagagaaatactgtcatttttttaagaaacacagtacaaacacagacgcccacaacgagtaatgccattttatttggcaaggtggcatatatatatatatatatatatatatatatatatatatatatatatatatatatatatatatacacacacacacacatattataccataatcattatgattatttgttttggataatgggtgcgtttaaccatatatgtgaaaattgatgtggtcaaattcatttgtgtaacatagtattatactacttttgtaattttatatttacgtaaagaattagttagagaaaaaacattaatcctctgcaaaattctgtcccttcccataaagagtatcttgcactctttcccataatatttgttttgtggggactaaggaaaaatattcttgtataatggagtagtacagttggcaataagtcttggaaccaattaattagttgaccagtcccagttaaaaaagtcaaagtctttatacaaatccaaatatcccatctacgtacactttgcgtgggaaatcaacattcacc

SEQ ID NO: 44439 - DNA, 395 bp, Oryza sativa
  unsure (1)..(395): unsure at all n locations
attatcgcgactgttgtcatgatttatgggaatttgtttttcaaaataaaaaatgttttaaaggtcattcctcctattgggttttttttttcccatttttttttttttaaaaatttaaaaccccccttttaaaccccaanaagggggggncccataatgcaagggtatatcattgatgaaccttatcatgcatatgactgcttgacattatattgagctttgtcaaatgtgtgtgactcgtgatagacatctttcatattctcatgatcaaggggtcatttccactttcatttccacatatttaatcaagctaagcttctacaccggaagttagcttcccacaaaaattccattcaataaaactcctactttagactatgttttcttctcctaga

SEQ ID NO: 44440 - DNA, 1501 bp, Oryza sativa
agggtcagagaatgactcggatttcttctcgagctggtccaggaaggtgatgatcatttgctcaatcaggctttgtactatctcccaacaattctggctactttcactcctgtaacaacataggatggactccagcactctacggtatccccagaacaaacttgcatagtccacgattaaccgagtagccctgtggattccttcagtctgtgtgaatttttcccaggaatccatggcgctcaagacaggagtaacagcttcagcatccttggccgtcttccgtatggcttcacccaagctgtcctgtgtgttcgccatggcttcaccgatcttgttgactaggctttgcatttgttctgaatcaggtagccggagatcgagagcctcctgtttcaaggcgggcatgaggatctctgacacgtcggagatgcaggtgtgcacctccatgagcccaaagaagctatccgcggttggagttgggcaagtcccggccttaccggcggcggcgagggcggcggcgaaggcgatcatcttggagatggtcgtgtcagtgaaccgcacgaggcagaggtcatcgccgccgccgacgacgccgcgtagcagcagttcatgatcggaggaagaagctaccgcgggcgccgtgtgatgtggcggctgggagattgcgaattccacacctccaacgacggcgacggcggcggcggcggcggcggcggctgacctctcgtcgtggaggtggccctgcgtggcgctcagcgcatgggccatcacggtgagcgctcgcgtccaccgccataccagccgctcggcctcctcctcctcctcctcctcctgctgctgctgatcagttggccggagcacccagccgacgtcgagctcggagaaccacctctccagcacgggtcccggcgcgcggccgaacgctccgatcagggcaagcacgaagccgtcacggaccatttggctggcgatatcgcgagggcctgggacttggaaccctaccactctcaggaaggagccgccggaggcagcgccggttttgcagcgacgacggtgagagccggcgccggactcggtgctggagacggtgctgctgtagttactggatcttgccgagcgagacgacgacgacgacgacgatgacccgacgacggacatgctccggatcttctccaggtagctgtagctccatctccacgacggcagggagaggctggcctcggtggcatccaactccgacagcgccgccattaattctagctctactgttttgtagtgcactgtatgtaggtgtagagaatttcggatcgggcgattgagaggtcgacttcagaagttcagaattcagattggagttcagtatagcttagcttaatttgctggctttcgatttcctgacacgcaactaaccgccttaagcgatagagacgaatataaatgacgtcgttgttgattggcaaccgcaacaataaaattacgaaacagacaaatgcatgcgtgc

SEQ ID NO: 44441 - DNA, 1501 bp, Oryza sativa
ttaagtggagagataatccatcacatattcatcatattgcaacttgtgcaaaaaaaaaaacttttgctttaggtgcatcttattggtcaaatcgtttgtcatgcatatcttctagcttcaaccacaacccaacggttgtcttctccttgagcacctccaacaaaatattgttagatagatgaagatgaatatgtgacatagccttatgtccattttcttcttattgtcggactaatcctgagtcctcttgttaaatccagataacacatcatcgaggtcttgctgtgcaagaacggttcgcatcttcacttgccatagtgagaatcttgtgtttcggtccaggagcggtagatcatatttcaaactcgccatgggaattgatcctgaatttgctactaagaaattaatgtaaacctagcaaaacgtgaacctctggtgcacttgtcatgtgcacgtactgtagatctggaatcctcatgttaagcaggctgtgtgtgcgtagcaatttctaaccgtgaaaattaattcagccctgccttttctctttctcgatgcgcatgctgctggatggttttccttgctgctctgctttttctcctgctacgcgtgatcattctttttttttttttttgagaaacgcgtgatgagtcaacagatgactccggttcggcctgcgacgagaactacgcgtaacgccgctgcagccgatgagatggatttcttcgaacggagaaacacgccggtaaccggaatagtagatcagattttcaatggatatcacttattatgaaaatagatgtataacggagacacaaattttacgcggaaaacatttatagaaaaaactatgagcgccgaccggcaatgatcaccgttgaggaattgattataaacgtagaggaataacaatggaacgtcatccctctctgttcggcttacaagagtatatgtaaaaaaaaaagacatctagtagaaaaagatatgaagtcctatttaaaaaactaatacaaatatattgtaggcctaaaattcagatcacatatttaagtgtgaaaataatcattttaaaataagtttttaggatctatttgtagaataattattttaaaaggatcaaaatataaaaatccagctttgacctcccctcattagtcagttctcaccaaatctggtaaagaacagcatcactcagatcggatccactgcctagagctagcttagcacctactgcagatatcgcgcaagcgagcatggagacacagctgccgaccgtgatggagctggatagctccgagccggccaatttcacgcagccgtcacggagatacagctacctggagaagatccgtagcctgtccgtcgtctcgggcgaggtcgccgggtggtcgtcgtcggcgtcggcgtcgtcgtctcggtcggcgagatccagttactacagcagcagcatgtcaagcaacgcgtcgggtggccctcataatcatcggtacgccccttactcaaa

SEQ ID NO: 44442 - DNA, 1501 bp, Oryza sativa
gatgggagtggtgagaaagacgtgtgccaactgccaaagcgtagcttcgatcaagtttgtttagatgaagtcatggaatgtgattataagcaaatttggagaattttgtctttatgcattcgtagcagttctgttccgttgcaacttacgggcgcttggctagtttggtataagttatttgtgctttcaaaagttagtgctgttttttccttgagaaaatttataggcacacaagtctgtgcgctcacaaagccactgttttgatttggtcttaaaataactccatattattttggtataatattttttttcgcttacaccgtagacacacatgcaaacgagtctcctaatatacgctcaaagagacgaaaatcagaggcttttcccggacctcactaaaaacttgttaaaagtccagttacatgtttgtaatattcgtaagtactaggatttaaatcctggtatgtaaagttgtgcacatcccatgactacatcatcgtattacaggtgtttcctctggaataatatacttattagcaaaatgcaacaccgtatcattgcaaatgtgcctattcagataaatgtcattacaattattagtctatttgtagccgtgcaattggagttttacaatttgtctattctctttcacaccaggatcctgcaatgccttctactcccccaaggcgggtagctgctattgcctaagctttcgtcaccccatcatcgccgacgaataggagccatgccacatacggatctatgtaagggtcattgtcttcctgcagcttccactcgtgccgatatctgcaagttcttgctggggagctgcataggaaggacgccccctcccaccccacggccgtcatcgacccctgccggccccatcccctctgcatcgccattagctctgccatcgaccaggagatggacctcctcttcaccgcttctccgccgtccttttgccagggccaccgacactagggagatgactccctatgtccatcttccccggtgctgcctcccctccaccaccgttaaccgccacgccggtcctctatctccgctgttgactgctgaggacctacgtgggagagagacgggagggagagagagagagaggggacacgagatacgcggaatgagtggttggaaagagcacgatattttcttattcattgggggcttaataggtaacgttttcgaaggatagagacaagttgtgtctttgcaatggtaaattcctttcaacttttttgaatgaaaaaaatgattttaaaagatgtccaaattaaaataccccgtcaagtttcaaggatccaattaacccaaagcctaagacaacctaatgggcctccaggcctcataattttctcgtggaggcccattaaagatctcctcttcttcttcttcctctttcgtctccctccacccaaaaccctagccgctcggctcgcgcgtccaaaccctagctagctatcgaggaggaggaggaggagca

SEQ ID NO: 44443 - DNA, 164 bp, Oryza sativa
ccccaaattttcaaacacgcgctgcccattcaacacgccagctcgcacgaccgcgacgagcccacgactcgcaagtggcaccctccccgaccccgatcggcgcgaagccacccacttccagccctcgccgtcgccgcgccgccgccgccgccgccatggccccg

SEQ ID NO: 44444 - DNA, 195 bp, Oryza sativa
gaaggaatttaagcacgcatctacagactgcagagtagagatgctaaattatcgaagcgctacagctcttacttctatagcgcatcagtgagcaggattcttggcacaatctctctaaaacccaacctaattcaaacatccaaaaatatatatataacgcacgaagcctcaatgcaaagatatttgccgcccgca

SEQ ID NO: 44445 - DNA, 155 bp, Oryza sativa
catcggcgtcagcctccttgttcttcttcttcctcctcgggctcctccttcgcgtcaggcgcaatgagggcgcggtggagagcgatgggcggccagtgacgatggtgggcgctggcgcggcgttttttcgcggtagggagaggcgcgcggcacga

SEQ ID NO: 44446 - DNA, 1501 bp, Oryza sativa
aaacttaatttgttttctgttgcaactcatgggcactaggctagttaaaacaaagcacgtgatagtgtgtcgtttcgtattggtagattagtaaaaaagattataagtctacagtcttgaaaaaccataccaaagaaaatgaaaaaaaaacagccacatcatacgtctatgaccaaatcccgcatttcaagattaagtcatgtttgtttcagcttaatattattgtaatctagattattaaatcagattactctaagctggattataataagctgacataaaataagctatgagttgtttatttctctggattattagaggcatccaaatgtagtgggtctttagccactcaataatctggaaaaagctcctctagaggagattattggattatagtaatctggcttatagattataataatctatttgtttgtttcagcttactcctaataatccagattataataatcctaagctgaatcaaacagcgcctaaattagatcgcatccctaagggatgagagtgtctctgcacacccgccctaacgtgctaggatgtaattttcatctaaagatacctatcggagagaacaaaaaagttcacgcaacaatgccctaagaggaaagtaggggtcgtaggcatcgccgttgccaaccgcccaacccaaagggctaggctttcacctataatctttttgccatcccgtatcaaggtcacctactagaaacagtggccaccaccgacagtataccttcaatgcgctttcaccactccagtgtctcgccgtcgaccggcccaagcaagagctcaacatttggtgcgctccaaattcatccacacagttgggttgcagaggaagagaatgagagagaaggatagaacctctcgcttgcactagcccacaaacttggctatcttgtgccggcaaggtgccgctgcaagaggactaatgactagatcggaggccgccgcaggcaaccgatgctgcttctgtatgttttctttagctgcaaaagtacgtattctatcaaaggaagcgtaaagtgcaagctgaaactaatgcacacttccgaagcccataaacggattatcacaaaataaaataatccattcagctgaaaagaagtaggcgattgaatcgacgtcacaaaaagacaaattaaactataacaaaaaaataatcttgctggaataagtgaatgttcctactaactgaaatccatgttatagcagaacaaccataactgatactaaccattaacagggccaatctttacttcgtctcactcttaccatgcgttgccagtgtagaatttcctgagtacaaaaccacaaatgaacgaaaatttgaacttgtgttgtcagtgtagaatttcctgaatacaaaaccacaaataagcgaaaatatggagtttgcttaacaaatacaactggttctttacattacaggtaatttggtgacatgtttacaaaaaaaaaaaattgtgcaattacagtgcaa

SEQ ID NO: 44447 - DNA, 1501 bp, Oryza sativa
taaaatgatatgattggtgaaatggtctatttcctatgacatttctcaataatactaatctacaatttggctgccattccatgaaagattggaagtgagaaagcacctggaaagagaaaaaccaaatcatgcgaactcttagttccaaaaatgcatggttgtacctttctgatagtgtttttattttctggcagggctcttaataggatttgaacaattgaaaatggccatgcgtgtgcaacaggaaatgtaaattcagtatgaaccccacaatagatacaaaggaagaatctgtacagcaacacttctgaacatttttgaagatacaaacaaaaatataaattcagtacgaacccaataatagatcataggttagctcttgcaaagtacaagtacaaagaaaatcaaaggaacaaagatccctcttggaattcagaagatctactccaatattcagaatgaccaataataattcaaacagtagatctcagaatcagcttttgtacaatacataatatcattaggtttcaataataaattatcagaagaacattttttttcaaactaaacagtagaccaccatatttttatcctaactgaacagtagaccacaatatttccatttcatctttccccgggacagcacatgctttctctgatacggcatgaaaagaagaggactaatggtaaaatctaaaatttgcactggaaaatagaagtgaatttgacaattggcatcacacggaaacactttattcaatcatccagatccatttcaccccaaatccaatcattttacttttctatcaaccaacaaaacggtcgcagtgcacggcttcatatggcacaactacattatctagaaacatcataactcaaggaaacgtctatcaccttgagaagaggttgacggtgctgcataaatcaaaatatacatgtcacatttcagttaaaaaaagtgttctttcagtccaagttgcataaacacaaagtcaggaattgtaggattttgtaggtacagtttaatgtttcttaaagatgaacttacattcatctactcaaatcgtaggtaaaatctgaccccgacgcaagcacaattcacatgctatcttgcgtgcaaaatggaaaccttggcatggtagtgctcacatgctgttgacatcaataggaggaatagagagcaggagatagagtaggtagtgttttacctgtttagtaaatagtcttagggaggtgagtgcgccatggacgaggttgccggtggtgtagtctgtgccacgtgaaggattatcccgtgccagggcaaggcacagagtatcttggcaacagatgcagtttcagagtcttgacggcaaatgcagttacaaatcgcggatcaacagatgcagtttatatagtcaccttgatatgccttaggagatctttcttcaaagcctaaatcccagtgacgctgacctatttttaacatttacctcatgaggaaaacaggaatccacaaatc

SEQ ID NO: 44448 - DNA, 468 bp, Oryza sativa
atatataaaagtaaatttaatagagtctaaaagtaatttacatatattataaaagtaacataaaacaaaacggaagtaattttgtcacgataatagaagtaaattcgttgtacggataaaaatatgactttatctaaaaattaaatttaatcagcacggatcaacacacataagtttaacaatttttaaaagtaacttcaatgttaattggtagtaacttttgcatggttcaaaagtaactctctataaatctgtttaatcatcgattgtttttttccctttcatttttgttttcatgtagaatgagaaaagaagatactgttgtattttttaagttgaaaggagatactagatggagtacaaagtagctaccactagctgtgtagtcacatccaattaaaaagacattctgtcagggttacgcataaggtatgccctctatccttggatatacgatgcgtaccgata

SEQ ID NO: 44449 - DNA, 1501 bp, Oryza sativa
caagtgttggtgctccgacgatggaacaagagcgattgagtgtgtcctacgactcggctcatccaaaggtggaggtttccagcgaggaagatagcataagcacggcagtcaagggctcggttcggtggagagagaagagatgccaacaagctcagatatggatctcggccttccaagggtgtcatcacgcgtcccctgtgacaaggaactcgctttctatgttggagatgttgaggaggtgtgggtgaggctagtggctgtggagtggatctagagtagaggagcagccatgggctcatggcgacattaatgacgatgaaagacaacagaagattgtgagggaatcctcaccaaagtagcgcaaagccggtgtcacagtgggatggcatgagacggctcgtaacggtagatcaagatggtaggcttagcggtggtttgcatgaggaattgaggagatgggcctactttgattgcttcgggtagaagataggaggattagggaggaggggggagggggagagtcgcaacagaggaccacctctgcctcacaattcgattgtgaattgctccacggctttactggcgaccccaccaccgcccagccctaggccgtagaccacgcgagggcatggagctccacaccggacaacgccacgaagtacaagcactatggagcgcgggatgggaccaccgcctattgcaggcagcggcttgcgcggaggggacggtgttgtgaaggaggcgtcccaattgccggagaggaacgcgcggacgacctcggcgaggaggaagcgactttttcttctggcttttttcccttagcacttacatgtgggtcccactgttctttttaattttttttatgattggatagccacgtcagctaataccaacttcaatattatcctaggagtcattttgtaatggtgttaacagttggagaagttattataaccggttttgtgtttaagggatacaaatcagatccgaggtataatgagggtgtcaaagtggattttttcccaaagaagttgactagataattgggccttagttttgtggcagctgagctgaactggcccatagccgttcatcgacgttccatagccgttcatccatttatttacgggcccggcaggatgtctggatccagcaaatcaagcccaacatgtaatttccggtgtgtcgaaccgtctgtatgggccaggccggatccaaacaccgagatggaaaaccaacatgaaatttccgcgcgccacgcgcgccccttccatgtccggaacgacgcccaaaggccacgtgttaacacgacgcttcccctacacctcaccgcccgatcggaacaacggacggctcagatcacgccgctgacgcgtacgccccgccgcagagcctcccattggacgctacacgcacgcgcggcgccgcgccggcgcggccacacccaaagctatatattgagccgccccccccgcgtctcgtctctcacacacagccatgg

SEQ ID NO: 44450 - DNA, 1410 bp, Oryza sativa
attaaaaaaaaatagttcggttaaatgtaacattgaatatgttttttttaaatgttgctatattcttttattatttgatcaaacttaaaactagaaaaaaaatcaagcaactaaagtcttttttatatgaggggaaaagagagaattgagaagatacgcaaaacaaggtgagcattagcgaataattaattgagtattaattattttaaattttaaaaaatagattaatatgatattttaaagcaatttttctatagattttttttataaaataaacatcatttagtagttcagaaaatatgcgcgtaaaatacgagggagtttttctgtttctacctaatcaatttctctcaatcagttttatgatatgaaacggagggagtagatcgctaattactggtcaggcttgggtgactggtactttttgcaaatactggtttcctaggttttatcctaacaaataatctggagatcttttacggtgtttgcattttaaaaagggtaaaagtctatcgctgcacaatgaaaggtaccacttaaatggttgatatagttacttactacctccgtcccacgaaaaatccaatcatagcatcccaagatagaattagtggaggatagaaatgactaaaatgcccttaatcattgaaaaaagtagtaagagtattaataggtaggtaaaaggtattaaagggagttttatctgtaaagagtaggtaggatggtaggatggtataggatggtagaagttggtttttttatgggacaaaattcaaactctagaagttgagtttttcttttgacggagggagtaggtggtaaaagtaaaatgataattttcgtaggagatagagaatggcataattgttttcgatattagttctaggtacataggtgcatacaatacctcactaactgtgtgcccggtaatttacatgatatgttttttagatttacattttttcctgcaaatatggtcacgcagtaatcctctgttacattatttacgtgtttgttttagatttatatttacgtgatattttctagattttcattttgttctaggagcacgattggttaaaatatgaccgaatgtttgccaggttattttgatatttacattttatcacaaagaacatctaaccttggtaaaaagatcagtggttagtaggttcatgtgtaattcatcctcaatacgatatatttatgttgtttccacgtgtttgcgtcatctccccgatgaaatttaactaaaatgtcttaagcaattaaatagcttatttccttacagttattttgtaatgtatcgggtaaaatggaaatcacatgcatgcttggatagcatgtattgttcggaagtgctaatgggcgatcgatcgcccggcgacaagggttgccatcgatccccct

SEQ ID NO: 44451 - DNA, 162 bp, Oryza sativa
ctcttcttaccgagctcccgccccatccggatcgaccgagcaacgcctcgtccatcattgtcatcattactagccagcgtaggtgagtccctatattccctttacttttttttcagcgatggtggtagtggcagggcttcaaagggtagagccatgggggaa

SEQ ID NO: 44452 - DNA, 287 bp, Oryza sativa
tcatagttcgcattaaaaatttaggacaatacagatgcattcacaacttacgtatcaacattgttttattctttttctcacttcgcgtaggatgaaagcgcataagcccgatttaaacaccaaaaatttaaagttaaagcaaacaaccatgaaaacaaatttcaacttcgataatggtgctatctatgtctaagaaatttcagctttaaatacaacttatataaatagtaacaaaaaagacaaatgtcaataagtagtaaagtgatccatttcaatggtttaatagt

SEQ ID NO: 44453 - DNA, 1501 bp, Oryza sativa
  unsure (1)..(1501): unsure at all n locations
gccacagtccgtagaagcgcggggaggctgcgactgggtagccaggcgcgtggagcggtggaggcaagcggcggccggtgggggaggcggctgcgtgcgctcggtgtctgcgtcgcatcgagcattcgagctggtggaaggagcctatcgaggagctgagcaagcgagctgtggttctcgattactgatttcctggtggctgaaaatcagcgacggaaggtatctcaaagaggtaggttaggttaggtaggacattgggcagtatgtttccgattaatcctatttatttggtacaaaaccgattgaatgactgagattcatcgcttgtttgtcagatttgaatagctattttaaccgtgggtgatgtgccaccaaccccaactacttgtggtaatggaattgttgcggtggaagaggctggtgaacaggtagaagaggtggaagtacaattgggttcatttcatattgcttgacgagctgaacaggtaatctaagcatgtttgcatgcggattaattttagttgttggtctatttagtgtcatataaacgatgtagtcgcatttgtgtttaggcgaagttgttttcggttttattgttgatcttctctgcggcacccgggcacacctcagattcttaccatcctccaccaccacggacagatatcaatgtttcaacgggctcggccctctaattatttagattntgtttaaacaaactatgtaatataggaatgacngtaatatatatatttgccggttgccgtcagtcttgattagcatcgttgggactagggagcccacaagatcaaagagttatatagaactcatactccagttccttgaaccttattccctcacatcttggatcgatttgcggataactgaattagctgaacaccctccacacgctggcactgagaactacaccagcgtggaagcggcgacttcaggggctatgggaataggataggagattgtgaaatcacatcactgcgtactagttaagctgctagtaagtttcaaagctggggccaaaagtcttgtttgcaacatgatggtgcacatatcctctatacttgtagttctgacttcttatggattaattcactcaattaagaagaaacaaaaaattaaactcctctaactccagattttacaagatcatacgcgggtggttctcaatatgagaggggagcccaggcagttcggtgccttacagcatttatatacaaggaattgataaactttgtcacaagaaagaaacatgcataggcacattagtaaatctctcaactcaaggctggagagagtgcacttcagctaagaataactacaataaactctgacctaatgtggtgaaaagaaacagattctacttatgaacagaaatgcatcatcttgcattgtcatctcccaattgaaagattactaatcgtgcctaaactcttcaacgacgagtcaaacccttggttctgcatgagtgctgacaggctgaaagtaa

SEQ ID NO: 44454 - DNA, 1501 bp, Oryza sativa
ggcgtactcgttgtcaatgaaccatagtctttgagcaggtgcaagactgatggttcgtggggatcgatgtcgactaccctaacaaatcgatctgaaatcggcgtcgctccttgttccttgtcctcatccctaagggcgacgcgtgactgctggaccttaggaggtggcgtcttcatggcgctgagaaagaccttgcagctcgagaggtcatgattctttgacttgtgaataggacaatagacatcacgagttggagaagtacgctgaattccgcgctttttgccggcacgaatttcagcgtggacgttgagaaaaacccaataggcttgcaaggcatgttttctggttttgtggataggacaccaggaccttgtcacctcagaagtcatcctcgtcggctcgtgattcttgtcagaaggacaaggcttggccgcactaggttccttctcgagctcggatatcgtcgacgttccgatctccgcttcggcgggaggatccttcgacatagagtcgtcctgggttgtagccactgcgttctcatttccggccatcggcgggccagctgagatcggcactgtggtgtaaaccgggaagacgatttcgccgacttgagtccacaccagcgttgttgaagtaggaactacttggttgaagttggtgttgatgctgttgtcgacgaagcaggatgtcataatagtagaaccttgagcaccaagtccccctacctggcgcgccactatcgacgggagatacacgtagaccggatatagagggtattggggtacgctggtacgaggatctacgtagtacgacatcaagcaggcagaaaaacaaagattatattggttcaagccccttggtaggtaatagccctaatccagttgatatgggattatatgatggaaaccacagattcgactagatatcccggcgacttggctcctggaggctccggcttcgtaagctgtagtggatgtgttggtggtaagattcgatgccttaggtcctctcgggggtcccttttataccgcaggtcaactggtttccaagtaggactcggagacatcggattcggtacgatacaatgacgacccagttctatctaagtaggactctttccatctgtggactccataatggacttccttaacttatgccgaaaacgtccgtatacgcgcaagcataccatatcgatatgtagcgtatatcgaagggtagagggtataccttactcgtaaccctaacaagtatggtttatgataatttaaatttaaatagtatatagaatgatgattcaaatataaaagtaaattgatgtgaaaaggagggagatagtttggatcatagattaatcatgtaaggtctagtaagagaagaaaaggagtgagatgatttggaccatagataatcatttaaggacaaaacaattgatgtgatatgacttaatgagagaagagagagagagagcgcattaactaagttacgagttaggatgaactat

SEQ ID NO: 44455 - DNA, 617 bp, Oryza sativa
attcctgcagccctttcagtagacaaaatgatggcccggatgtatcagaactaggctagggcccagcccagagggcagtgttgaccagctttgaccaccggataaagtctacttgaggtcccttaagtacgccgaatctaattcgtatctcttaactagaaaactagataaaaccagtgcaatttgactcctttagcggttttggagggtagttttgctgacatggcactgatgtggcggcattgacctggtctttgttccacgtggcgcttaggtggcattagaattaaaaaaacatatgtgagacccacttgtcaataaaaaaaattatgggacccactgacatgtgggacccacatgtcagtgcgtcccaatatttttttaatgacaagtgggtgggtcctacatataatttttagttctaccaccatgtcaataaaaccaccctcgaaaatcgacgagagagttaaattgcactgatttcaatagttcgggaatcgtctagttctctggttaaagggtacgaatcaattcagcgtactttaaggagtcaaagtgtactttttccttgaccaccttatccaactccttgtgcgattgagcccaaccccagcagc

SEQ ID NO: 44456 - DNA, 1501 bp, Oryza sativa
aaaaacaaagattatactggttcaggccccttggtaggtaatagccctaatccagttgatatgggattatatgatggaaaccacatattacaaagggaatagcggaacttgacgataccgatgagatcgtagtcgagttgattcgactagatctcccggcgacttggctcctggaggctccggcttcgtaggctgtggtggatgtgttggtggtaagattcgatgccttaggtactctcgggggggccccttttataccgcaggttaactggtctccaagtaggactcggagacatcggactcggtacgatacaatgacgacccagttctatccgagtaggactctttccatctgtggactccataatggacttccttaacttatgtcggaaacgtccgtatacgcgcaagcataccatatcgatatgtagcgtatatcgaagggtagagggtataccttacccgtaaccctgacagtagcccccgacttatgcttaaatgaactcgtgagaccgatcgcgacttctgatgtcgaagttgtcgtcgttctcgatgtgagggccgagagacaaggagtgatcgacaacgtcgagtgaagctcaacggtcgtgagtgaatttaaattgaagtccgaaaaactgccgcgcgtaacggacccagaaatttccggcggccatctctctcctttccttggaattcgcaccatcgggagtgcgtctatttacgggggttttggggatccaatttgaagcccgcctgttgaaaaagctctccagcttccaagcgtccctcgtcttcttcgctcccgcaaaaaccctagctagctcatctcggtccattcttcggcgatccccggcggcaatggatctcgacaagtctacctccaccagcgcgtcgctgaagaaactgcaggaagaaggcgccctccccggtcgcgagaccgcggagagagaagtaggaggtactgaaccccagcctgtcctgggtcacatggttgtgatcgaggactttattctctgcggttttcttcctccgccttctgaatttctcctcttggtcttgaatttctatggtctttccttgctccatttgaaccccaattccatcgccttcctgagtgtcttttcgcatctttgtgaagcctacattggggtagagctgtttctcgacctcttccgcttttactatgagttacattggatggaacccacaaaggtgtccgggtgtgttggcttccgacttcgggatggcctgaagtcacgatacattcccttccagtgcccctcctcggggtattttccttttttagttaaattgactcccttttgtgcgtgttcttcccgacttatctgactctggtctcaatctacaggcttggacagcgcacctgtggagcgccgcgtcggccaactgatgatcagtggcccgacaacgtcgagcgatgtccccgttcccctttgcgagaaaggggcagccgagcgcgacgctgccatcaatgtaa

SEQ ID NO: 44457 - DNA, 1501 bp, Oryza sativa
gtaacgacgctcctagaggtggcggcaatggcgctcctggaggcaacgtcactggagaaggcgagaacgtcaacatcaacggaggcaacaacaccatcaatgcattatccagtaccgaagcgttatccgggtatgttacatttttaactattgtgtgttaaacatgtgtttctctatgatgcttttctagtcattagcatgttcatgtttagcactttttctagatcaattcctgctacacatgtcatgtttattgtcttaatttttaggattaaaatatgactatattttccacgtgctccaccttctctgtttcactgtcatcgctgccctcatgtcgatgttgagctggagccggaatgccggatccaccacgtccccggtgtgggaggacacatcgagaagtgggggctggtgagtggtaactaggagataggttcattaatttttttttcaaagtggcctcctcttttccaggtggttggttaggttagggcaagtactatgggcatccaagcacaaacctcaagatgccacataggactatatagtgaggtggaggagagaagaaagatgagagagaaatagtcacatctcatgcaaggggcaacccctacacaaactttaataaacatgtgagagtgttagagatattggggattgtgtggtagaggcaacctattatacatgtcacctcttaatttaattatgtatatcatgtataaaattggatgtgatggtcacctctactataaaacttgcccttaggaggtccactcgtaaaatagaattatttttctggctgtggcctcctaaaccgacaatctgtaaaaattaattctcatacagttgtgaccacatactcccagtatgcttttgtctgtgtttagttcttgaaaaaagttgaaagtttggggaaagttggtagtttggaaaaaaagttgagagtttatatgtgtaggaaaattttagatgtgatgtgatgtgatggaaagttagaaattgggggtgaactaaacacggcctttgttaagtccatcgttgagaataaaatggagtgtcatgaaaaatgtatttttttatagtagtgtgtgagatgtaggcattgactgcttggagccatcataaagacaagaggtagttgggacttgggaaagacaagaggtagttgggacttgggactagtgtgagagatgtgaccaatttttgtattttgagttttaagtgacagtggattcaaactatatatctcagagagatatagataagtactaatctacaacaatctattattacaaacaattatagccacaatgaaaaaaattatttatatacatgataagagatatatttttcgacgtgatagttaagtggctgcaagtagctagggcgaatcaatatacaaggggagtatgctttattttataattttctgccccttgtaatatctttatcaatttaagttgaacagttagtgatttttctagatatctactccctc

SEQ ID NO: 44458 - DNA, 1501 bp, Oryza sativa
ttacttccttgtgacggcccgcaaattccattcttgttatgggccgttacagatggaaggatctgtactagtgtgagcggcagagtggcctccggctgcgggttgcagccggcaccggccgcaggcgacgacggcgcgacgcgagcggtgcgcacgacgcggaagctgccgccgtgagctggtggcgacgccattgcagtacgtcgggcgcggcgcgcgtgtcggctgatcgaggtctctggattctggatggctagcgacgtcatgtgcgcgcgtgggcgataacaaaaactatcataaaagtcacttcaaatttgacatttcaccccacaaattattttgttgcaaatcatcatctctactcggttttgttttgaaaaaccaccccagtgcacatgtgtttatccaaatcaatatgtctttataaattgcaagccatcaatatggttcttatcaaaatttacctttaggagtatagactttaacactttttgtgagatttgataaatagaattattgatgagagtttaaacgttgtttctctatatgcagaaaaagatttcagtgacacataaaaaataaatctaatgcaaacatcagaaattttttttgaagcggctagcttaacctacggtggctctatatcagcgataacggggtgattcggttaagcatttacgctgggtgttaaatatttacagtaaaataacttatgaaatcgaatatcaaactcaagtgatttttagaatgatttctattatttcccataatttatactaaggagctttagttcaattgtgacaggacctccgctttttcttattatcctccagggctcatatatgcttgcgcagacgaaacttgtcttgtgttagatggttgaaagtaatatattcaggagagccaaccagactagagacaacacatcaagcaacacaactaaaaaattagcgcgcctctaacgtgttcactacttaaatcctgcgtatcagcttatggccttttttatatacaggttggtgaatgattaattgttttaaaaaatataatgaaaaaaattcagcatgtaacaaactgatcaaatcacccccagatcatgcaatcaactactcctccgtcacaaaatataaaacctatgacctaattggacatttcctactatgattttttgtggccgtcgtgctttgttcttttaacacatgggctgtgaagcccacagcattcctgggctgtagtcatgtatgcatggcatgggcccatgcctcgcttcacatgatgggcactgagagaacgggagatcgagagcattagtttcttcagtaaaaacgtattctgaataaaccgaacagattttgttcggtattttttccttgatttttattttactagcaaaatgcccttgcattgccactggtgaggataaagaatcaatcacaagaaacaagatagtgatatggtgaatttgactatttggcagagacaacatatttagagtcagaga

SEQ ID NO: 44459 - DNA, 397 bp, Oryza sativa
tcctgcagccctagggggtgtttggatgggctaaaatttgttagtcctgtgtagatactaatttgcagtaataattttataaatgagactaatccgcgagtcaaattttttaagcctaaatttaatctataattaacaaatgtttactgtaacatcacataggttaatcatatattaattaggctcaattgattcgtctcacaaattagtccaaggttatggaatgtgttttttaattaatttatgtttaatactctaaattagtgtccaaacatccgatgtgacaaggactaaattttagtccctgtgaaccaaacagggcctaagcaagctgtaggccatcgctctctcacgcaaacagctcgcatgtgccagtcgaggggtctgtttattcaga

SEQ ID NO: 44460 - DNA, 1501 bp, Oryza sativa
aaagctcggcgtcgaccaggggaagaggccggcaccggagaagccgcggcagcactggccgcacgtcgaccagcttgctcctctcgctgatggctcccgatcgactcccgagtcccgagtggccgatcctgtcccgatcacggagacttcgccgcggcattctcggcgtgcgtcgttgtcgttgaagtggacaactccgtggtgacggtgggacacgtcgccgacagccgcctccggcgacggcgaccactgacaccactagctagcttgtcgacgacctcgcgaccatcggcgctaacatcgctgctatatgtcctccatcgcggcggtgcagatgaaaatctccaccttatagcagtgtcagtcagcggtgctcgaccccagcagcctcctccgtcttctcctcctgatgatgttttcgtctagcccaactccctcgccgcctaacatgcatagccgacggagctcgtcgatcaactcgccctcgcctgcgaagccggaagctgagattaggattaagaattcggaattaggcagggcccgacggccaaacagtcacgggtatagatgggccaaaaggttcgggggccgatcgatggcccagcccacggcatgaccttttggcccggcccaggcatggcacggctagagtgctgaatggtctatgccggcctggcccgatagttgtgcctggggacggtgggctggcccgttacggcacgaaacaccagagatgttatagacttattcaccatatatatatatatatatatgacacgacccaaagaggatggaggcatgatagacttattctaggcatatactccctctgtttcaaaatgtttgacaccgttgactttttagcatatgttggaccgttcatcttattcaaaaaaaaattgtgaaatatgtaaaactatatatgtacatgaaagtatatttaataatgaatcaaatgatatgaaaaaaataaataattacttaaattttttgaataagacgaatggtcaaacacgtactaaaaagtcaacggtgtcaaacattttgaaacggggggagtataagacacaacccaaagggcagggaggctaatagacttattccagccataggtaagacaggacccaaaaaggagagatacaaaatagacttatttcaaagataagcacgatagatgtgccttcgggccggcccagcacggtcagactctaactaggctgtgcttgggccataggtggaggccgtgggcgggcatggccgtttggcgggccgtgccgggtcgtgcctggccgagcggcccacttggccatctatagttatgggtagctttggacttgtgtgctaattaaagccacaaaacgagcgatggaaaaaacaatgtgaactgcatgagtgtagaaaaagaataaaaacaaaggtgagagaaaataagggtgtagattctaaactctctcgagtagtcgagtgaagattctctggttatttgcatgtcatctaaata

SEQ ID NO: 44461 - DNA, 1501 bp, Oryza sativa
tgatatacttgcatatggccttggtaggtataaaatgaagtcaataggaggaatgagcctttaaaacattttttattttgaaaaacaaattcccataaatcatgacaacagtcgcgataattcctttcatctttaatcatctcacatgtagcaatcacttagatgtataaggttccctaaacatggatggttattcataagtacaagtttagctgagaataatgaatatacaagagtaatcataggaagaatttcattagttggaaattttatttttttcaattatgcttgaaccaattgtttctagaattttcagctctagtactataccatgatggagatatacagataatagacgtgcttacctgctcacctgtaaaaaatgagagggattggggccagcactgcaattttatgcagagttcagtgctttccaggtgttcagaaattcagtaattttcagagtatgtgcacgtcagaagatgggatatctcccccacacttattcgaaacctgaactttcttaaacatgaaacaaaaacaaacttggcatacattggggttaacaccaatgagccacattatttatagcaagtacttgcatgattggaaaataaatgaccaagcaaccactactactttattcatgggagaggagacatccaattagcataatactttttctccttccccatctctatgaatgcacgcttaatcttagtgcacaaaccacgactaagggtatcaaaattgtttctaagctcagtaagctctacccctagttccgcgttgcgatccctaagctctatgttctccttgcggagtttcttcacttgaacggcgagtttatggaccgagggctccggcgattttacttcatcttcttgaaactggccgggtgcccttacaattggagggggcgtcaaatgatgcttcaccttcataggtggagggctaagggactccgctgccccctccttctccgatgtcgtcaaaggccggagcaatccttttccatacccactgccgggagttcgcactcctcgaatgcaaaattgctcctccttggtagtggacggagtggcggtaggtgtggtgtatttgtggagcacctcatcccctgccttggtgaatagggtgcccacataccgctcagtgggaggcggagcggccttctcatcgtgttggaaaatacgtcgcatcttcaagagaccgagctcacccattgtcagccgttgcgtaggtgagtccccccggatttttatcttagtaacatggcgaggggagagggatcgcgctgccgaacggggccgagaagggttcggcctaaccagcgagctcgccggccggctccaaatttgctggggagccgggcaccgtcacaaggggttgtgcccacagtgcgtttacccctttcattgtatagttctccaccgggatcaattgatttgccggtgtcggctctctgtctaggttgtaggtggaattggaggatgaggca

SEQ ID NO: 44462 - DNA, 1501 bp, Oryza sativa
ttgagagagtgagagaggatagagaggtgagagagtgtgagagagagtatagaaaagataaggattgggatgggtggatgagatgaaattttgaagtgttgacaaaggaaagagaggatggatggactttttgtaggcatgtttttaagaggttcgtacgtgaaaattggttttcgcgtaagaggcccacacgtaaaaatcgacttatttttacgtgcagacccttaagagacccgcatatgaaaatcgattttcgcatacggacgtgaaaacggtccgtatataaactaaatagcttctcgtctaggaaaatcgtttctctactagtgtgcaatctcctgcgaaaatagatgatttttgtaggcgggcctgcggccatttttgcaagcgacatctccatcttcgtaggcagtgattcatccgcctacaaaaacacattcagtgaataaaaaacaaagccgcacacgggcgccgccgtaggcctccccttccagccaacggctctcctccaacggctctcctccgtccgccgctgctcccacaggcgtcgtcctcgttgcgtcggcgccatcgtctcccacaggcgttgttgtcgtcgtcgtcgtgtgtctcctcctctacccataagcagcaccgtcatcgtcgtcgttgtcgcgcgtcaccgtgaaagggaggagccgagctgagtcacacctcgccgggagaaggcgggcgagccggcggcagatccacaagcgtcggcgccgtttgtcgtggccagcggcagaggtggcgaggagctgagccggtggtggatttgctgctgctggtgaacaaatgagagagagagaggagtgggaggaaaatgagtggtggggaaaggatagggataaaactttgatattttttgttggcatgattttttacatgttctacctgcaaaaatcatattttccagatggaccacttaagaggtccgcatacaaaaataaaggtttttttaggcggatctcttaagtggtctgcttgaaaatattgattttcgcagacgaaaagagagctccatcccgatttacattttcatggccatttagctccgcaggtcatatccgtttggaagaaaatctctgaacatctgtgaaaatgctttttctagcagtcgtattatcctcggatcgaccaagctgctccgcatctgtatgacgatgagctccgcgcggccgcaaaattccgaaagcagcagcaaaagtccagttggtttctcctcaaacagtgcatgcaaggccatcgtcaccagtgacgctacaaccaatcaatctcgagctctccgccaatacaaacttgacaactagtgaaacacactaatggctttctagaaccttgcatgcggccgcattgcgatttgcaagcatggggcatgcagcatttataccgtgagacagaaaaaatggactatatagtaggagtacgtcactacgtcctgtataggactccatctactcacatcagccacgcgcgcgga

SEQ ID NO: 44463 - DNA, 1501 bp, Oryza sativa
actcgaagggcagctatacgagtaactgggaagaaggcaaggcagaatctgactcgtaacttttcccaactaccatttacacatccaatggtagaggtgtaccattgcttcgctctctcttgaagggagaacagaaacaatttccaccatatagtttcttgtctcataccacaaatcttaaggcatgaacagacttgctcaaagtctcacagatgatggtagggattttctagatcaaagctagaaaaaagattttctctaatcatactgatgagttcggggcgaatttcatagccagttgtataaattggctccgatgaaggagatggctcataaaattcgcccctagagcggatagctccaagagaggttgctccatagtcgagaagagtttgacaggaatacttctctgggtagcaggggtaaaggtagaataaaaagtgaaaaagagatacgaggatgaactgggttcggaaatgatcaattaccgttccccggcaacatacatcatgaccatgttgagaccaaaagatctagtaatatgcatggctttctctggtttgatcaatacaactctatattgaggtttgtggacaacagttgtgtagggagttagtactgccgatttattatcttcaacacggtgcgaattttctaggccatagaagttccttctttagttaaagaaccaaagtatttgcttttatactgtaaaaaaagtgtcaaagtttaaagatatcaatgtaaaaaaagttctgcacaagtagaaacaatgtacacaaggtaattccaataataatcatattgatcatcacctccaagaccaaggggaagaataatgcgttttacctggaagagatgtggacaagagttatacgccatcaactgaggaaagtagttaacaatttcacattagttaaacagaatgttgcaaagatcaacaatatatcacatgatagacatattgttcagttctattggagtttggagataattaagtctgatttgatctagttgcactctgtagaatatgtgtagacaaaaaaggatggaggcaaaaaaaaaacatagcatttcaagtcttaaagcttgtgaccctagtacaaaccaccttgataaagcacattaatatgataatacttattcctcatggataaaagaattgaactcttggaaaaggactttacataaccagaaagtactaactatttttagcctcatgtttgtcaaatgcaagccatgattaattaataccatcatcaatatttgcatgtataacaccgttttctttgaggatataatgcaacatttgggggaaaaataaagataaaccttatgatgctcaagcatgtcttctcaatcaaatatttcaaaataccttctgactccattgatttcactcatgtctctggtatgctgatgcagaggtgcacatctcagtattagtgcttatacacaacttcaaaaagaaaatctaggacaaagataagtgatgtgacca

SEQ ID NO: 44464 - DNA, 1501 bp, Oryza sativa
gtttaaaaaaatcaaattaatctattttttaaaaaaataatacttaattaatcacacgctaatacctctgtttaccatgcataccatgcagactgttccacgctggcaacttagcgaacacaccctgtcggtacaatgctacggtattttccaagaaaaaaaataagggtacggggaaccagcccatcgaatcccacggaagcccagcgagtggaagccaagcgacacgtgcctgcctgcctgcctgcctgccgccgccgcctacgccggggagtggcccggagctgatcgatccatgtcacgtgtcactggacgagacggcgacgatagccacgcgacggcatcagcgaagcacctccggaacctctccatccgctccggcggcaaaccgacgcccacctcaatgccgccgcggcggccctccgccaccgagatcgccccggtcttcgccacggacacgacgtccaccttcgccggcctcccgaacccgaagtccacgtcgtacacgcggaacctcggcgacccggccaccgctaacggcggaccgtcgctcgcgctcatccctccaacgtgttccatgcacctcttccagtagtccggatcgtatctcgttccttcgtccacggcggcggcgatcgcggcgcaggtcgtgtagaggccgtcctccgcgtcggcggcggcgatctcctccttgggcgccgaggcgaagcatggcccgacgcagttgccgaggtacttgtcggggacgcggggttccatccgcgcccggtgatcggtggggaagatgaagtgggcacggccatggtgcttattatctgcttcgacgtcgcctagtgcggctcggatgtggcattgccatacgatggcgaacgtcgcaacgacggacgtgcaccgaggaggcggcgacttgccgcgccgcgccgccacgccggcgactctgtccttgatgctctgaaggatctctcctgacagcgtgaaagtggcgaggagcttgctgtcggcgacgtcgggcgacctgaacttgtcagactcctccgttcgactgaccatgtagtcatagaggtcttcacgttcgcggatgaacgtgcggtcgatgacgggcggcttcggcagcaccgcggcgccggcgcaggcggcggcccaggtgtggaggaagtgcgtggagctcgagccgtcgcaggcggcgtggtgcacggtgacgccgagggcgaggccgcggcgcgcggggggcagcacggtagcctgcacggccagcaccgcgccgccatccgggagctccggcacgagcggggcgatcttggcgacctccctcgggtcgtccgcggccagctcgtcgacaccgacgccgtcgtcgtgctcggcgaaggtgaaggcgacggcgtcgcctggctggtagaagagctcgtaccggttggtcttgcccggcgtgaggcggaggcggccggcgagcgggtagacgacgtggagcgcccgggacagcgagtcagccagccgggacagg

SEQ ID NO: 44465 - DNA, 1501 bp, Oryza sativa
cagtataaactatcaccttagctcccaccaagtaagatctaaacttatcgatagcaaaaacaaccgcgagcattttttttagtagttgcataattcaactgagctccggttagagttttgctagtgtagcagattgcatgatactttttgtccttgatttggcccaggaccacaccaacatcgaaatcgcttgcatcacacataatctcgaagggcagagtccaatcgggaggttgaatgattggagcagagacgagtgcctttttgagaatttcaaaggattttaggcacgcgtcatcaaactcaaagggagcatccttagctaagaggttggtcagaggtcgggtgattgtagagaagtccttgatgaaccttctataaaagccggcatgtcccaagaaactgcggatccccttaatgttcataggaggaggaagctaatctattacatcgattttggcacgatcaactttgattcatcgttcggacactcgatgaccaagaactatcccttcatagaccatgaaatggcacttttcccaattaagtacaagatccttctcttggtatcgttgtaagactttgtttaaattctgcagacaatgaccgaaggtatttccgtagacagagaaatcatccatgaagacttccataatgtcctcgatcatgtccaagaaaatagacatcatacacctttgaagggatgcaggagcgttgcacagtgcgaaggacatcctacgatacgcataggtactgtacggacatgtgaatgtagccttactttggtcctccggatggatagaaatttgatgataccaggaatacccatcaaggaaacagaaaaaggaatgatttgccagtcgttccaacatttcatcaatgaagggtgtaacagccctaaaatttgacaactttttaaaaccgaattagtttgctttggttctctaaaaatataaccgtcgagttagacatttatttaaaatattattttccaagtttgtttccggtgtttcttttctcgtttaatttttgtcgcaaagtgcatatcatccctcaaataattcctttgaatccgatttaaatctatcccaaatatcgcaccatctaaatatgacatcaattcaaattctatctattttaagtttccccaaattttccttttctctattatttttcttttctttttccctttttctctgtttttctctttcttcttcctttctctgtttttccttttctttcttcctctattcggctaggccgagccagctcgtgctgcctcgcgccaatcccgtgccacattgcgccgcgcttgcgcgcgctcgcgcccagctcgtgccagcccgcgcatcccacacgctcgcacgcacacacacgaggccgatcgacggacgaatccccggataacacctccagcttcccgccttcgtatttccttcgtctctcaactagaaggctcaagaccagaggcaaaagaagtgcaatttcaacctctttcacc

SEQ ID NO: 44466 - DNA, 1501 bp, Oryza sativa
gattaatttggacggtttgttgagaagcacttgtgttttttcgtgtacggtgtttttctgaacgggcaaaagaattgcacgttagtataagtttttatgtgtgctaggatcagggtgtatgattctattaaggttctaatattaagatattatgtgcgcatatttttcataggattttaacggggtgatgctaaattgaatggtttctgttgcttctaaaattttattagaagaaacaaaagtggagtaactcaaaattcagagcgcaaattgtgcacgcgtacatcttccatataatccttaaaaaaatgtgagtgcgcgcgtaatagagtgtgtatatcagcgtcttcacttaatcaaaaagaaaagaaactgaacagaacttgtattaattgattctaaaattgttttagtaggaacataagtacttcctctgtttcacaatgtaagtcattctagcatttcccacatttatattgatgttaatgaatctagacatatatatctatctagattcattaacatcaatataaatatggaaaatgctagaatgacttacattgtggaacggaggaggtaactaagaattacgaagtaaatccaaagataagcaactagaattatgtactccctctgtttcatattataaatcatttgacttttttcttaatcaaacttacttaaggttgaccaaatttgttagaaaatatactaacattttcaatacaaaacaagcatattgtctaaatatatttaatgttaagtttaataaaactaattggtggtgtagatgttgatatttttctataaacttggtcaaatctaaagaattttgattaaaaaagtcaaacaactaatataagaaagtagcggttcttaaaatctagtttcatgcgaagatccacttacaatcattaatagaaatttgaaaaatagtttctttttctaaccaaaccacatgcaaacgtaattatcacatcttacccagaaaaatattcctccatcaaatcaacatcgatatgatttggtggctcactctataggaatattcctctttcttttgaccgtctgatgcgttgtagtcctccaaaaataatggagcatgtacgactgccaacactactgcttattactataaaaaatatcgacatattctcttgaaaaaaaaatctaaccagtaaggtgagcgtagcttatctggttagctagattctttgtggtgaaactaacccatagagattcaaatcctatttttgatacgagtgttcttatttacttctaactattatttcaatagtagacaatgtacgcacccgttgataagagtgtgcttctttagtagtaggtaatgtatgtacccgtcaatagcagtgtgcgcacgttatagacgtcaccctctttttttttcaaaaataaaaataaaaaaaagggaaaatagcccagctgcaaatggcgatactgttgtccttttgtctcgggccccacaacccagtcaccaaac

SEQ ID NO: 44467 - DNA, 279 bp, Oryza sativa
cacacccgcacctgcgttgcagagagagagagagagaacgagaacggaggcaggcgcccacgtcagtcagtcagcatcgagaagaagagaacagaagagagaagagccacgcgcgaagcccggcgagcgagggcattctactaccgcggtcccagaggcggggcgcgaagcggggcaggcgctggttgaggacgaggagcgcgtaggcggcgccgtcggcgtcggcgcccgccgccgccgcggacggcgagggcagcaggaaggcggaggagtgggaca

SEQ ID NO: 44468 - DNA, 488 bp, Oryza sativa
gttttgtcttgatttgcaccggcattttcttaggctggtttataaattcaattttaggcttaggaggagaacttagggtgtgacacctggtatggccggtctgaccggttctaggcagagcgctggagggcacgtttcaatcaattttaaggccgaattaattgtgaattcggacatttgtgcccaagaaacagaagaagattggaggattcctttgattcgatatttgaaagatcccacgcttaaggttgatcggaaaattcgacggcaagcattcaagtacacattgcttgatgaagatttatatcgccgaaatatagatggtgtcttgttgaagtgcttagatgaagatcaatctaaagtggctatgggagaggtacatgaaggaatttgtgggactcatgaatcggcccacaagatgaattggttgcttaggagagcggtgttctattggccgaggatgattgatgattgcttcaaatattata

SEQ ID NO: 44469 - DNA, 1501 bp, Oryza sativa
actcaatcgctcttgttccatcgtcggagcaccaacacttgagccccatctcctctaacctcccaaggctcctccactgagagaatcgtgatactgagagtgtgaataggaggcggaagagggaggaggaagaagacatgtgggcctgtgtctatttttttttatttttgtgatgattgggatgtcacatgttagcgaaaactgcctttaaaacagccgagcgagtctatttacacggttttaatggttgaaggagtcataataactggttttaaggttgagggatatgaatcaaatccgacctatattatgaaggagttaaagtggactttacctatattataaaggagttaaaagtggactttttcacttcttttctgatgattaattcattggatcggttacttgaggacttttggagtcaatttccttgcaagctactctttacgtcgttaaaaataacttctagagaaaaatttgaacttgtactcgtcgaagttgatttttttttttgatgagaatggtgtatacttgtttgaaaactgcatgtttcatcgaacggagtagctcgatcaccgtaggtcgattttgcttaaggttttgaatatttggacaacctgcgcgtggatttttgtgaagctatttctgcgtgtttttacatgcatggaccacctgaataaaacttaaggttttacgacccaagttaacttgaattttggagtccatagaacacctacatttgtgtacacagtaacacagatgctccaatcgaaagctgaaagattatggaacccaccacctaggttagtgcaagcatcagatgcccagcccgaccacttaaccgcaacgtcatctaccagaatctttcaactcgaaagaaattcgacctgatcctaaactcactcagtgaaatttcagatgtcaccgctgctgatcaattcatcctggacatcctttgacatattagaggaaaaaagcaacacgatatatttacaaatataaaatagtttataaataaaacttttatatacgtgctcttaacgatataaaatcaaagactaaaaataaactatgctgaaaaaaaattccaaatcaactccaaatataagattattgaaaattcaaatgtttttcatcgttgccgttttcgaagagtgacataggcggggtgggtgcgttcgtgcagacagctcgatcgatcgagcggtgatcggatccaaacaacgccgctccatcgatcccctcgacgcgcgcaaactccacgcaccgccaccgcccgtgcggcgcgcacacgtcactctacctagcttacacctacccacatcaaccttacacacagctcgatccacactgacacacagagcgcgccgcgcgcgacagcaaggcgagagcatggccgagcaccacctcccgccggagccagccgacgagccccaccaccacaaccatggcgggaaggcggccgtccacgccgacgacctcaagcccggaggccgccgcc

SEQ ID NO: 44470 - DNA, 1501 bp, Oryza sativa
ccttgcctcccaacggcgccaacgaaccaagtcgcggtcgtactgtgcgtgtagtggagacagtacagcggcggtggtgacaccagccacgctgacgtcacgcgggtgacgtcaccgagagaagagatcttttgggccttttctctctttctctctcttcgaatccgtctccgtcgccgcctgcggatgctgcggagcgtcgctggaaagaaacaaagagaggaggtgatcgagggtagtacccgacgttgtcgctgacgtcagctggtttcgtcagaagaagaacagagtacagaaaaaaaaatttgaaagggacgaccacccatgcatcggtgtgcctccaccgattccaccctgttgcagcgggtggtagtcttttttatttttgcttcttctttattttactgtgtgcagccttttcactttctcttctttttatctttccctcactttcctttggacaggtttatcgagctactctcttcgtacgaatatgtagaagtagcaagttttagttctttgacagagatattataagaagaaaagtaaaaagacttggttgtgttattgggatgcatggttaagatataggtctgaataagttgaagttgggatactacgaatagtttagtggtaaaagtcatatttttttgtcaagtaccacttgttgttaagtttgaaataaattttaagttttaaaagttgttattttcagacgaaggtgtactaatttagctaagaaatcttttcctcaactatttagacaaaactttgaaattgccggtaacttatttgtttgtacaagttttgtttttgaaccacatagtaaaaacacatgtgctcatatacatatgtgcaacctaccacttttaagaaacggggtcaacatgctcctctatcatatcttgatagtatcgtgccgtaataagaatttaactgtgacatcagattgtttgtttctaaacttttgccagaaatgtttaaattaaaaatatattatggcatatcgatctctggttgaatttgtttttggaggaccaggttatttaagtcatggttaatttatgatacatgtttgaaagccactcccaaaatcaattgtaggacaaccctaaacgccgttcttatagtgttgactcagcgtttcttttgagacctaacaaaacccgtttattcaatgatccaagtcaaacagaaaattgtactatatatatacattttcaacgatgaacaatgccactgtataccacatagaaattttttgtcaaaaaagaaaaaaaagtctacacacacatcagtatcagagaatctcattatttgaaccagctagcgcaactggaggagtacgcacgtagtttctaacgcattttccaacagatgccgtgaataaacccaagttaaaaacatatgctaattactccatccattttatattatatatcattttgagttaatcaaatttctttaaatttggtcaagcttataaaaaatattttaatac

SEQ ID NO: 44471 - DNA, 985 bp, Oryza sativa
  unsure (1)..(985): unsure at all n locations
gtgtcgtgtcgcagctgtgtgccgtttaaacctagccaccgctttagctcgttgctcggtagtcgagttgtctagccgtaggtacatccctaggttcctaccggcctatcgtttgccgtaccggggctttaccgtgaatcgtttctagtccaccggtttagccacagccgttgttgagttgttcgctcgttcgttcgaacgaggtgttccccgtgtttcgttcattcatccgtgtggagtcgtcctttagtttagagccgtcagagctgccggctccgttcgccggtttcggctaatcatttaggcgatcccgtgtcatgtagaattgactcgttgagtcggtatctcgtgaggctcgcttgccagatcaatccaagccatctgatcttggtcaactctcggtcaagattaatctcagtcgtccaaaatcgatataaatcctctcctcttttcaatggcatattattcctttttaatatatgtcatctaccaaatatgatctaatcttttctggaggttgctttaatcttttgtctcagttataaatcatttgtaaatggtttaattaatttggaatagtcttttctttaataggtttaattggaattaaatcttgtaaaatttgtaattaattcatatgaaatcggaatgagaccgttcaagtctctaaatttatgtaaaatcatgatctacatgtttgtttacttttatgtactgtttatttggtttttattagtctttctcctcgtttnttttnntntggcgtgttagcttgtcgtttccgtcgtttcgaaggttcgaaagtgcgtcggaagtgttccagaagacttattgaagaccgaatattgcaaggcaagtcacacagatcccaaacacaattcctttgagcatgttaatcctatatttaaattctctatttatttcaactgtgcatttatgttcgaatgtcaccgggtggtgagcctttcccatttaattatggccg

SEQ ID NO: 44472 - DNA, 1501 bp, Oryza sativa
ccattatttttggaggactacaacgcatcagacggtcaaaagaaagaggaatattcctatagagtgagccaccaaatcatatcgatgttgatttgatggaggaatatttttctgggtaagatgtgataattacgtttgcatgtggtttggttagaaaaagaaactatttttcaaatttctattaatgattgtaagtggatcttcgcatgaaactagattttaagaaccgctactttcttatattagttgtttgacttttttaatcaaaattctttagatttgaccaagtttatagaaaaatatcaacatctacaccaccaattagttttattaaacttaacattaaatatatttagacaatatgcttgttttgtattgaaaatgttagtatattttctaacaaatttggtcaaccttaagtaagtttgattaagaaaaaagtcaaatgatttataatatgaaacagagggagtacataattctagttgcttatctttggatttacttcgtaattcttagttacctcctccgttccacaatgtaagtcattctagcattttccatatttatattgatgttaatgaatctagatagatatatatgtctagattcattaacatcaatataaatgtgggaaatgctagaatgacttacattgtgaaacagaggaagtacttatgttcctactaaaacaattttagaatcaattaatacaagttctgttcagtttcttttctttttgattaagtgaagacgctgatatacacactctattacgcgcgcactcacatttttttaaggattatatggaagatgtacgcgtgcacaatttgcgctctgaattttgagttactccacttttgtttcttctaataaaattttagaagcaacagaaaccattcaatttagcatcaccccgttaaaatcctatgaaaaatatgcgcacataatatcttaatattagaaccttaatagaatcatacaccctgatcctagcacacataaaaacttatactaacgtgcaattcttttgcccgttcagaaaaacaccgtacacgaaaaaacacaagtgcttctcaacaaaccgtccaaattaatcctacatgaatggaaatatatatggaattgttcattcggcctcagatttttgacattgctctacttttgactctctaccatggccgttcaaagttcaaacctttgtatatctcttgctcctgatttgacttatttgagcacggtaataatgcttctccgtttatacgcatctgattccgatcgaattaagacgtgtctaacttcgatcgatcagatgctggcaacctggcaacgaaggcggcgcttttggatttacgtattctagagaggacgcctaattaacgtttaattatttaatcgtaaatggtccggtctaatccaacgatcgagatgtgtgctgtgtatagtgtgtcgctgcttcacaaattcaattttaacttcgctttcgttttcgcaagctgtt

SEQ ID NO: 44473 - DNA, 975 bp, Oryza sativa
cccattaccattttcaggattgaaagctccatcgacattgattttagcccagccattcacaggcataagccagcaaacacgttgctttggaaaggcccgagttggacctgactccttcccctgttcagggcgacacaaagccttcccttttctgttagctcttggttgccctcgtctgatcgtcggcacggtttataagatgtagcagccagtcaggtcctgactgagagaactcttgttcccctggtagccaccaattctgccgcatctctgccctcagcgcagctgctttcgtgcatgcaaccgtagcatgaaacgcatcttccacttctgccccacatatctcacagtttggcttttgtacaatctgtcgtcgatgtttattatgttgtgtggctagacaatctcttgatactctccaggcaaaaatccttattttctgtggcacttgcacattccaaatgttcttccacaacttcctatcaccatcgccatttgagcattgtgcaacctcttcgtcagctctgatttgggcctgtagggctaatttgtaagcagaacgaacagtgaacatacccaccttatcatagtgccaagcaatgaagtcctcttcagggctatgtggcaattggattctcaaaatttcctcagcatccaggggatagaagattcgatgaactagctcttcattccaaatttgttgatgtggaaccataagatccgagacccatttgattctcgatctaacagcctttcccaaaacccttagggtatgctctctcggtatctagttatccctccagattctgactttgcttcctgatccaatccgccaaattagaccttgtttcagcagctctaacccgtggaccatccccttccaagtttctgaagagtcaatagggaaagcagtatcacacaagtccccattggggtaatattttgcctttaaaatttgagcacacaaactgttgg

SEQ ID NO: 44474 - DNA, 489 bp, Oryza sativa
catcgccatttgagcattgtgcaacctcttcgtcagctctgatttgggcctgtagggctaatttgtaagcagaacgaacagtgaacatacccaccttatcatagtgccaagcaatgaagtcctcttcagggctatgtggcaattggattctcaaaatttcctcagcatccaggggatagaagattcgatgaactagctcttcattccaaatttgttgatgtggaaccataagatccgagacccatttgattctcgatctaacagcctttcccaaaacccttagggtatgctctctcggtatctagttatccctccagattctgactttgcttcctgatccaatccgccaaattagaccttgtttcagcagctctaacccgtggaccatccccttccaagtttctgaagagtcaatagggaaagcagtatcacacaagtccccattggggtaatattttgcctttaaaatttgagcacacaaactgttgg

SEQ ID NO: 44475 - DNA, 193 bp, Oryza sativa
tgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacaga

SEQ ID NO: 44476 - DNA, 415 bp, Oryza sativa
caaagtgatttgtcatgtcctcactcccaagtcctttaatcttgtgacaaggatcatcatcctatcatacatctcttgtggtgtctccttgtcatccatcacaaatcttccaagcctttcttccaataattcaatcttggcctcacgaacggcgggtgatccctcatgagccaattgcaaagtatcccatatctccttggcctcctcaagcccatcaaccttgttgaactcctccggactcaaggcggagagaattggattggaagcttaagcattgcggtggatgagttgctcttgctccgaagtgagctccatgtcatcatggggtacatcaatacctatacaaacaactttccaaatacttggatgcaaaaagattagatgcaacttcatcttgtgcttccaagcggcgtaa

SEQ ID NO: 44477 - DNA, 1501 bp, Oryza sativa
atcaaaaccatgatccaagtgttggaggacttcattggaaactccacattttagtgtaacagatatcatttttcggcaaagatatgtactttgtgatgctaagctgtcgctttggccttttctcttgcatgtaaagattcctctttttgcatattttgtccatctactcaatatatactgaggaggtaaaacaataatactgttgtggttgaagatccgtagtacatgcttgcataaaatacctacatgattcagaatatgttagaggtgaaatattaatcccaactagaatggggaatatgtcaggaaaatacacttaccaagacaggtatacttcctgcaagaacatgatatattcatatcaactgaattaaaggtgactcttgtttcgtccttactgtgatccacagttactaccttctgtattgtggcccacttctcacgcaaatcatacaagttctgtatccaagaattgtcttcaaggtggtaatcagatatcaacttttgccaattgaagttaaagtgtgccactgacctttcttcatacacacatcttttaaagtcatgaagaaaattaggattattggagattacatggcttagatgctttgcagcattttggtatatatgccataggcaaagacagtgacttgagtttaggaatacaatcataatcgcctttgccattgcagcacactgatctgtgaaaattgtttcaggttgcttccccgacattgccttcaaaaagtttctaaatagccaaacaaatgaatcagcactttcatcgaataataatgcagctccaaaaataatagtttgcctatgatgatttgctccaataataggagtaaatggcatttcagacttgtttgtttgaaatgttgtgtcaatggagagaacatccccaaaacaagcataatctgcaatggcctgaccatctgtccagaagaaattacaaattcgaccatcctctttgtccaactgcacagaataaaagaaagaagggtcttctgcttgtttgttatccaagtactccaataatgtttgtgcatcttgtgtttctaaatactttttgcgctctcgaccaataaagttattgcaatccatttgtaagaatggcacattttcatctccacctaaccaccgttgaaaaaaatcaaatatctcagctagcttaactcctgcttgttgcatcatgctaattatatgctcatcggcatttgacatacgccgttgtgatctaagcatgtgtgacttgtcaggacttacaaaagggtaattgtgtgccaattcgattttctgcagcttccaaataccttcctaggaaataaagaactgaacacgagccttgcaatctgtttttgtacaagcacgttatttctttggctggtgtgttggattactgttcttgtgaccttcattactgcaaaccatgtacttggatgataaagtgccatctgctctgtagttaacgtggcactttcgtacactaaatcccact

SEQ ID NO: 44478 - DNA, 389 bp, Oryza sativa
atgcctgctccctgacgccaccatccaagagctacactttccccatctgtagcatctcgggcttgagcatgtcaccgtctctgagggctcacttcacagcatgattgccagctgccctgtcctggaatgcttgctgcttaactgcaaccttggtttccattatcttcggatcaattcccctagccttcgaagcatcggtgcacgcatcatatcctatcgtaatagcattggacaccttcaattacaagaactcatcatcgaggacgcccctcttcttgagaaattgccccatcttgaatcgcgcaatgacctgcatgtatttgataatttccgcgcctaaactgaaggctgtaggctgcctttgtgatccatggtttgtccactccagg

SEQ ID NO: 44479 - DNA, 1501 bp, Oryza sativa
aaaaaaaaagaagagaaaaattgagccttgcattcatagcgtgatgaggacgtgtgacttaacgagtgacagaattaacatgatggagatgttcgaaacggtctagtagcttgtatttaactgttcatcttggaccaggctctctcggttattatagtttgattgatatatggctttaatttgggttgttcatggtagcagtagccgacaaagctgatagggaaattcgtggagaaaatggaggcaaattgctttcaatgattcagtgccagtaaagcgaaggtcagctggctctgtgttttgccatggatgtaagcaaaaggtatatacggcgtacgtatatttctgtggacacaatggttacgatgaaatagaacctactgttgcgtcaaaaaatagaacctactgatgccaatctagaaattttgaaagaaatacgggttggtgcatgacctgatcggtatggcatttgagatttatggggatgtgactaattaggatgcatgaacccagacttggagggggcgttatagttttaaaagaaattgttttggacgaaatttttgccaaatttctcgtcataaggaatctggtaacggaaaagttcaactttttttctcttgtcttcaaactctgctcacaatctaatttttcatcctaatatgaaaaaactagttagttatagattgagcacagttctaattgaaatctcaaactgacttcaatatctggtaggagtaattcttacgcacttacacagaagatgaacatatgcttacatgagctgatgagcacacacccatgagtgcaccctcttaacacatcactaagttcctattaaaagtacataattgtgttcttatgacctgggtgaagtcatgtatccatgactccactgcaccactagtgctttcgctagattataaaaaattaaccttaaacatgtctaataaattatcatcctcttttaatttatttgcttaattttgaaattattgtatatggttgaccttcttttctgaactaataattgcttctctaaattgtcaataagttaagaagttaatcatggctctaaaacaatattaagtcaataaattttaatcatggctctaaaacaatattaagtcaataaatttaggctattcatttaatactaacgttgggttgaaatttgaaaatgacaggacactcagactccttacacaccacaaagtttcaatcattattaattattaagttgaacagatgtggtgtagtgataattattgagttgatttaccagcaatgcgactgttttgtaaacgtccattaaattttggatatacctcgttcggcagatatcattggaacaacaaaataattaattacaaatccaaaattcaaatccttcaatcaaattgactaattatatatgtttaattatttctttacttgtcgagcattgcgactattttgtttctagaacacgcaggagatctacgttgcgagtattctacct

SEQ ID NO: 44480 - DNA, 394 bp, Oryza sativa
cccgcgccggtcgcccgatataatcattctcgctattttaaacatactccctccgtttcgaaatgtttgacaccgttgacattttaggacatgtttgaccgttcgtcttattcaaaaacttttgcaaaatatgtaaaattatatgtctccataaaaatatatttaacaatgaatcaaatgataaaaaaagaattaataattacttaaattttatgtgctaaaaagtcaatcgcgtcgtatatttcgaaacggagggagtaggatttttcccatcgtcacgacacaacccgatttcattcgttgtccatcgtgggtccgtctgcttttctgatttttccatttgtcgtttgattactccgcgtcaagcccgcatcttccgtatgttccacgtagc

SEQ ID NO: 44481 - DNA, 1501 bp, Oryza sativa
ataaggaatattagaagtagagtatagagtccatataggaatttaaaactaactaaaatttggaataaacataataaaattaaaagaagagtttagagtccgtataaaaatataattttcaaataactaaaattcgaaattaagaaaaacatgggaagaaaaatttaaggtcaatatagaaatacaaatatagaaatacaatttagaagtatgtcggtgacatagggccgggggtatcgtgacaagaggcttgggtaaccgcgatcacccacgtggccacccctccctctgtctccccgaggggtcgggccgctcccgtttcggccccgagggctggggcgccccgatcccctgtggtgtgggcgccacgtgtgtgggttaggtgagcacagcggcgctcacctaaccgcatttatagcgggttagacgagcgcgccgcgccgtattcaatgcggcgcagcgcatgcttatccggtccgtgaccagtcgcggtatgtgaccggtcacagaccggtcagatcgtgggttaggtggcaacaggcggcctgtcacacgcctcgccccgtcccgtcggaatgatgagagcttcctggctctcgtccctagccggagccggcgtgctgactcctggagttggtatgtcagtcccggtcagatccatgccaggcttcagcgcaagcatggcaagaaagtcgctggccattgaatgaaggttgaaaggggtgtccaccgggagagctgacgagcggagcagaaggcgtgtgctgtgcttgtcagaggtcacttccggctgtagattagccctcattgtaaaaggaatgtttctttttttaggcagcttgaggcccatgtggtgacccctaaccagataaaaaggaggcccaggcctaggagaggagggaggctggcgaatggaggcgaaagcctgaactctctctcgctctccagctctctgtattccttcacactcagatccaccagaacacaggagtagggtattacgcttctcagcggcccgaacctgtctacgtcgcacgtgtcttgtgcgattcttctcgctgacgttccttagatcgagggcgaagaacctcacatagcgcccccggccgaaccggcaaaggggggcctgcgcggtctcccggtgaggagccccaagctccgtcatctggcgcgccaggtagggggcgcgcgtgtctttctgagccctcgtcctctttcgtgtgcgccaagcttcttccgctcagcccaatggccgaacgggcagtggcccacagcctctctccgagcgctagcggtgacgacggggagcagaacccgcgccgtcgggctcgcaccccaccgtccccctctcgccgaaatcttgggcgtggggaggcgctcggggaggtcggaggatccgtgacttcgccgcccgcgggcgacgggggaggacggcgagacggggcgcgtcgccgcctcgtctacggcaatggcggcacgccccagggcgcgctccaggctg

SEQ ID NO: 44482 - DNA, 528 bp, Oryza sativa
aaaacatcttatacggagggagcaacaaagatgcatgtgcgttacaacaggtaaagacaatttcacgattgataaaaactctaccaatttaaacgacaaaccgaaacaagacaaacaaaaccatggcaaaacaaagtcagaaatcatatataagtattgagcacactagcttcatgcatcatcatatgaaggatccttcatgtacactttccgcaaattttaaggcctcacaaattgatcgggtggctattctattatttgacacgtgtattttgctatacctcattgaccgaagattgtaattttgattattcaattagtgaaattattttactgtaaatggaaagtatttgcaaagtaataaacttgccgcatacacaccttaacaattataatttcaaaagaaaaatatttatgagaagagaaattcggaagagaaaagaaaaatgagaaaatagacgagattgaaaggatcggaagagaattaggatgattgggagaaaaaagaaaaatggaaagagaaaaaga

SEQ ID NO: 44483 - DNA, 343 bp, Oryza sativa
aggaaagccactagagccatacctaatttctactatattcctattccactagcttaagaatactaaactaacttgagagaatatgagagagctcttgcttgaggtgtgtgttgaagtgaagagagtgaactccttggggatggtcggtggcagttggaatggtcagaattgctctccaaccgtcattggggagtgatccacgccatccagaagaaaccctgcatccaacggtgctagggggttcggccgaattcggtaggtggcctcctccattacttcacttcttagacttgtgaattttggcccaattcattatgtcaattctgagttcttggcccattca

SEQ ID NO: 44484 - DNA, 572 bp, Oryza sativa
tatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtgggtagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggatatagg

SEQ ID NO: 44485 - DNA, 167 bp, Oryza sativa
aattatctctattatataacccctatacactttgctctcaattcaaaaaaaatacactttgctctcaatccacgctattctctacagtttgtatagagtagaggctacatttcactactataaaaaggataaccgttaatccttggcatccatttcatgttttaagt

SEQ ID NO: 44486 - DNA, 1501 bp, Oryza sativa
attaccttcaacacattaaatttaataaagttggagtggagaaactactaatcgaaaattagaaatgaattcatcaaccgactgatcacaacgttattccatattgtagaatggagtaaatatgtactaagtttcatcaattaagaatgcatccaaaatatgaattaaaggacataattgacaataacaagcagttatcgaggatagtgagatatataacctgctgctggttgttgtgctggtactgcatgttactagaggtgtataggcattttcacctgtataggaagaaacaatggagttaataaaaaagagtacatgctggactgttggatgttaataaaaaagaaacaatgatgttagtggtgtagtatacaactatacaaaaatatagaatagccaagttaattcaaacgaatctcaatttaaatacctgaatgttgcacattttggtcatcactctcagcaagatcacgtgcaaagaaatcacccaaaccttctgccctcatccaatcttgaaggcaaatcaatgcctctacagtactgcttgaaagtctacttctatagtcactaatgatcctttctccagttgaaaatgctgcctctgatgccactgatgttgctggaatagccaaaacatcacgtgccattcgtgaaatcacagggtactttgttttgtttaccatccaccagttcaagatatcaaaatcatacccatcttggaaatcaccttcctgaggcatatcagcaagatatcgaataagctcactctttactttgctcctgcttttgtcatgtagaaactgtctccaatcagcgaattgattacttgcatcaacattctgctcaacacttgtttcgggctgagaattgatgttgtttgagcccccatacttggcagaatattcatcaaacaatttctgcatattactcttgatttccttaaggtaaggagttacagcagctccaaatgcagacttcaaacgaaactcaatgaatttgtacttataccttggatcaaaaataatcgggaaacatatttgcaagtattgagcgtcccagtacttcttaaatttttctttcatttccttgacaatagatgcaatggtgacatcttcatttgtagcctccttgtccaaaaccatctttatcttccaaagttcatgaaaatagcaagttgaagttgggtacaacgtaccagatactgcaacagtagcttcatagaaaactttcaacaaagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcact

SEQ ID NO: 44487 - DNA, 1501 bp, Oryza sativa
tatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctgacttctgcggcactggagactggaaggttaccacctctccttttgcattggtcaacttgatggtgcggctggcgcaatcaatcactcctctgtgtcttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcacggttgttgtgactgccactatggtggttcttgttgaagctacccgggtggtagggacggtactgccggataatcatggtggaaggtccaccgtgatgtcccatcgtggaacgaggcttctgactcttcccctggggagtcctgaactgagctgccttcctcttacggtttactttgttacagtgctcctcctgacggatagccttatccaccagcttctcaaagtcctcataatctctagagatcaactggttaatcaattcatcatcaagaccagacagaaacttctcctgcctcttggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcattgcattgcaaaagattcagcttcttctcaatggcatgaagccagt

SEQ ID NO: 44488 - DNA, 1501 bp, Oryza sativa
tacacttaatggttagtgcattatacggaccataaacatgaaacatactcctatggttcgtcttcattccaaattgatgagttgactgtcaaatgaggcaatgagttgctcgtgagccaagctcaggttgagcacgtttcacactttcactcacgagtcgcgagctacagagtaagctcgaggcctcgagttcagcttgcttggactaagcctgacctggcccattgccatccctactgcttggtataggagccaagttagcttgaacttgggctgagcccaatcaaagtagatttctggcccaacctcaagaacagtcaatgaccatgatgagttgggtgcaattttcttcttccaaagaaatggtgcctgtgagctaatttatgagctggtcgcgtaccgggaaataggagccccgttcgatagggagattgtggcttggagtttttttaaaaaacttttaaattttttaaaaaaatacttctaaaacttattttccaaatccgaatcttttatgcatgctaggatgtctggcgtgacactgtcacgccacccacaacgtgacaattttgtgtccgaccacattagccacggtggcgtggtaggacaacgctgccacgcccaccagaccagcatgactaaataacgttgacatgctatttagatcagtgtggcagtattattttgccacgacagtctgatcaaaatgttcagatattaaaaataagtataagaaagtttattcttaaaactaaaaattaaagaagtttaaaaaaattatttagcttactctctccgtcctaaaataaacaaaatttatatgagatacaatattttctattactatgaatctggactccacctcttgtctaaattcattttagaccgttgtgcaacagtttcatttttttttggacaaacgatgtaagtttagaagccacccgcaaaataatcaagataattaatgtatgattaattaaaaattagctactgtaaacttgaaaaataaaattatttgattttctaaagaaatatctatattttgcaaaaaaaaatataccatgttaaatattttagaaagtttgttcacagtaagcgaacaagtagctccatttgataagaaaaaaaaaaagcattgccttaagagcaagccagatagcatagcgtttttgcccaagtgcccaactagggttctatttgaaggtgcacgaatgggaacacaattttcctctcacacgtataacaaagtggatcattagcactttactaatttagtattaactaaaaaataaaaaggattaatatgtttttttaaaagcaatctttctatagattttcttttttaaaaaaaactatttaacagtttgaaaagcgtgcacatgaaacaaggaatagagaagttagtaaagtgtagataagaacaggtctctgcatcaaatattgttctttttaatgcaaaatcatttgtcatttcattttttacacttaaatgaatgccttt

SEQ ID NO: 44489 - DNA, 1017 bp, Oryza sativa
cccccccatcccaatagttctgtcttttgcaatcaagcaaaggaaacgatcgaccacattttgttgggctgccatgagtcccgctagctttggtggctggtattgcaagcatgcacgccgttgggcagccaccattttttccgttacccgatggtgagcaagcagcaagaaagaaagtgaggccaagcaatattgttatcaccctggacatgcggaagcggaacgagcgcaacaactgcgtcttccatcagtagtcacgttcctggaccaaagtgatgcgcgtggccacttacgaggtagcgctcgtgaagcgctttctggccttggtgaatgtgttaatatggtcactcttttgatgccgtgggaaatagccttctgtacccccatccttttccttttttcctttgattctcttttttgtcttttggttttgggttagctttgtgaaattgtgaggcacattactcctgaatcttaatataaacatacacatgacgcatgataaaaaaaaagctacatagattaaacaaaacatgatgcacatgcagatatggatttgttcatgttgagaactacttcctccgtcctaaaatataagtatttttagaatagttccaaatcaaaatctttgtaactttgactattaatagcgaacaaataaaaaagatcaattgcgtaaattgatgttaatagatttatcatcaaataaactatcataatatgcaaaaaattttatttaaaacatattacttttataaatattattgatcaatgtatcatttcaaaaactgtgtcgaaatctaaaaatacatgtattttaggactgagggagtagctggtatgattaattaggagcgagtggattagctgtcagattggtttgttccttcgtagagctagtagcatcaatgtcaattaacaattacagttcataaagctaaatgccactaaagtcaggatgcttgtagattagagcaggtaaaatagcaggctataagccagctgtaaacatatttt

SEQ ID NO: 44490 - DNA, 1501 bp, Oryza sativa
caagtagaggaggagcgacagaggagtatagggaggcacgtgtgtaacttttaaaaactaaataattgtaaacttgataatataaggttcattttttaaaaatcacgtacgtgacaatgagttgaatatttaataaatatttttaaaaaatcatatgtaaaaaaaatagataattttatgacggtgttacccctgcaattgcgcgagccaacatactagttggagtttaatttgttatttttgttacaacttataaagttaaattgagtttacacttgcatgtttgagtgatgtattactccctccatcccataatataaaagattttatcttttctactagttccataatataagagattttgctatactacttgtcacatccatcatctctcattcaaatttctacctatttcaacctccaactacccgctcaccacaaccgaaatcacatttaatagggatattgtagtgttttcttttcatcagtaatctttacctaaagggaataatcccttatattatacaatggagggagtacatattaatttattatatcaatttgtcttgaaattttatcataatcatttagttgacatactcactctgtttcaggctacaagacattttgacttttgccaaagtcaaactgctttaagtttgactaactctataaaaaaaaaattttaagaaatttttttttatagagttagtcaaacttaaagtagtttgacttgactaaagttaaaacgtgtattgtaatctaaaatggagggagtaaaataaatgagtggatatttagtttcccagcttgttggctactctctcaaggtgtgatttcaggctttccgcatataaatagggtggtatgcatgtagtacattgtatttgtgcatcagctggccttttgtgacttttgtccatcaatcatacagtcacgctccttcctcggaaatttataatcttcgaatcagagatcgatgtcgcggcggccgtccgtagcaccggagccggctccgcggctggtctgcaatgcaaccacgggtgatctaccggcaggctgcaacctcggcctgctggcccgtatcgaactcctggtgctcttctgctccgccatcctcgcgctcctcgtcttcctcggctcctccaggcgccggagcagcagcgccaccgtccgcctcgtcgtgtggggcgccttcacggtgtcctacccggtggcggcctacaccatcggcctcatgcagtcgtcccctttccaccacgagctcttcgtggtctggtcctgcttcttcctcttcgtcctcgccagctccgactccatcaccgcctacaccctcgccgacatcaagagcccggccaccgtgctgctcaaccgaggcctccaggtcatctacgtctccgtgctcctccactactacgcctccgtgctctccccgaagctcaagatctacctcttcatcgtttggctcgtgagcttggggaagatcgcgttgagcgccctc

SEQ ID NO: 44491 - DNA, 1325 bp, Oryza sativa
ttagcattaactacacttagtgggggataaactttatagatatataggattggtacctatagttgctcaaatgctatatttttatcccgtggaaacaggaaacagttcatagatatcagttttaaatgaaccagtatttatgagccgttaccgatgagaggttttataggtacaccatcctagaatatactaatattttttagttacgattttttagctatgtatatggatatgattattcaagtttatagctaagaattgtaataatttttatgtatatggatatgattatctaagtttgtactaagaattgtaatattttaggatggacggagtagctgttaacttttttttttccaaggaagctgtatctctgaaatctccttgaagttctaccctgcatacgtattgtggagctaaattaagcatttggggaacgaaggcaaaggtaaagaacagttaaaataacggaatgaacacagacaattgtgcgggagattaattaattttatctctcaagggatatcctctcgttccttaggcctgtttagttggcaaaaaaaaaattttgggtgtcacatcggatatttgaccagatgtcggaaggggttttcggacacgaataaaaaaactaatttcataacacgcctggaaaccacgagacgaatcttttgaacctaattaattcgtcattagcacatgtaggttactgtagcacttatggctaatcatggactaattaggctcaaaagatccgtctcacgatttcccccctaactgtgcaattagttttttttaatctatatttaatgctccatgcatgtgtccaaagattcgatgtgatattttcggaaaaacttttggggaactaaatggggccttaatgtatctgaacgttgctattgtaggaggagcatctccagcaggggtcctaaacacagccgctaaacaatttttgagagttgagaaaaaaaatcaggtccaacaaagcccgtactaaaggccctaaaataggaaggcctctaaattatcttctcaagcccccaggcctaggaactttctcgctggcccctattccacatgcgggagagatctcccaccgccgcgcgctgatcttttttcgcacgaaaaattttgctagcaccgccgctaaagcctctcctccgcatgcgcgtcgcctggatcagcgccctcctctccggctgaccacctccttcctcgccgcactcctccatggctggcgacttcctcccctgccggccacctccctacccggtggcctcctccctagcgccctcctgccctactggccacctccctgcagg

SEQ ID NO: 44492 - DNA, 1227 bp, Oryza sativa
accgggtgttggatgtttatgccgtgcatgcaaggcacgtatgctctatgcgttttttcaaaaaaactctcaatcctctaggaaacaacgaagcagtcctcctggagattcatccttattctaatttttactaaaaaagccttacctttatatgaaatacaatgtgaagaagagaaaattcggattttagggacagcgctgtaatcccaaaaagtacgagggcattctaaaaaaacagatcctaatccaatccctcctctttctctgctgccaacccatccccaacacgcaacatctctctgcccaatcctcctcccggccaatccgccatccccatccccggccaatccatgcggcctcctcctcccggccgggggcaaggacggcgccggcgtttacaaagacgacggagcaaggggacgacaacattgccgccctccaccatgcctcctgtgctgccctcctctaccatgatggcctcctcgaccttgtggttgcgtccacggggggagggaggaggcggcacccgcccgagctgccgccggtgctcccctcctccttctccatccacttgtggtgacggcggcggcgggtggagggacgcccgctgaatccgccaccggttctccttccctccttgttctccctccacttaggccggcggcggcggtggtggcggggggagggcagatccggcgcccgacgccggcggatccgccgtcgtgccccctcccttcccttgtggcggcagtggcgagggtacctacgttggcggcagagccggctgcgcgtctgccgccgatgcccttccctcatggcggcgtcggaccggccgcctgcgcaggactgccgtacgtcttcccccgtcgccgcgttgcctctccgtcctctcctccgcagcttcccaaccgttcccctctcaactctcgacctctcctctctacgtggaacaccatgaccgtcgccgccgaggtcgacgcatcccctgacggagaggagaggaggaagcaagcttgcaatcgcacaaccatctatcgatttctcccttccttctctttcttctttctttctttcgtttccccctctcacatgtcaggttattttttctcctcatcctctccggatgatttcacttttgctcgaaatctctcaggttgttgttgtgttgaaggtggcgaagggggaaactttggtggtggtggtggccggagtggaggatggcggcag

SEQ ID NO: 44493 - DNA, 1501 bp, Oryza sativa
catacccatcttggaaatcaccttcctgaggcatatcagcaagatatcgaataagctcactctttactttgctcctgcttttgtcatgtagaaactgtctccaatcagcgaattgattacttgcatcaacattctgctcaacacttgtttcgggctgagaattgatgttgtttgagcccccatacttggcagaatattcatcaaacaatttctgcatattactcttgatttccttaaggtaaggagttacagcagctccaaatgcagacttcaaacgaaactcaatgaatttgtacttataccttggatcaaaaataatcgggaaacatatttgcaagtattgagcgtcccagtacttcttaaatttttctttcatttccttgacaatagatgcaatggtgacatcttcatttgtagcctccttgtccaaaaccatctttatcttccaaagttcatgaaaatagcaagttgaagttgggtacaacgtaccagatactgcaacagtagcttcatagaaaactttcaacaaagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcactgcgtaaaaaaaatactccatctgcgaagaagagctagcacctaacgcagataggagcatctcgcaagcgatcgagacttcgagagcatggagccacagctgccgaccgtgatatcgatggagtgggatagcaccaccgagccggccaaatcgtcgccgccgtcacagaggtacggctacctggagaggatccgtaacttgtccgtcgtctcggccgaggccggccggtggtggtggccatgctcgtcgtcgtcgacggcgagatccagctactacagcagcagcatgtcaagcagcgtgtccggtactggctctcagaatcaacggtacgtctcttactcttcgccgaggatggtaagactcgacgtccatggtcctcgagacattgcgaggcagatggtgcacgatgcatgggttcatggtgaacttgatcagagacttcgaccgggagcccgaccatgcgctggagaggtggttctccgagctcgacgtcggttgggtactccggtcggcggcggagaaggagctagccgccaagctcggcttggatgatcttgtgcagcggtggacgcgaggatatgccgtgatggtcgaagcactcgtagctacgcagcaaaatatgaaatttcaggatcataccaatatggagctagaagacgacctccgacctctccaagtcactcggttcgtggaggcgaccgtatccaaga

SEQ ID NO: 44494 - DNA, 1501 bp, Oryza sativa; identical to SEQ ID NO: 29965

SEQ ID NO: 44495 - DNA, 1501 bp, Oryza sativa
cgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactacttttgaatgctagctttatgcaaaagaacctctagcctcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatctgtatgtcaacaattatcgtttgtgtaccctggctggtcctggacaggggtttaatacacattcagcttagaaattctggttcgtgaatttctgggcgtgacaagttggtatcagagccgaccttgaccgtaggacaagccaactggaaacctaagagccctctgaacccctttttttttcatatgcatatgcccttttgcgcttggatttgtttcaggaaaatttggggttttgcctctttggcttgtgggaaaaatcttggtcgttcattcggatcggttttttttagctcagtgtagggttttagaaaaaaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcaga

SEQ ID NO: 44496 - DNA, 264 bp, Oryza sativa
ggtcggcgggtttgaagccgagccggaccgacggggcgcctcgccgctttccccccccccttgtgacgctgcccggtgggtcccgcttgccagccgccccctctccctctctcctgtgcctctgacccgcgggtcccgcgtgtcggcgccacccctccttgtgctgacgtcagccctgggatgaattattgcgcaataaattgattaagggtttttcttttatagtaataaacacatataatcttctaaaaatcataactaatt

SEQ ID NO: 44497 - DNA, 1501 bp, Oryza sativa; identical to SEQ ID NO: 23076

SEQ ID NO: 44498 - DNA, 1501 bp, Oryza sativa
tgggtgagattctaagctcctggtctgagtgtggaaggttcgcgagagtgaaacacacaagacacgggcgatgtatacaggttcgggccgctgagaagcgtaataccctactcctgtgtttaggtggatctgtgtatgaagaagctacaaaagagctggagaaccagagagctcttactttctccctctctgatctttctggatccgaaaatcccccccttctaagtgggcaaggtcctccttttatacctcaaggggataccacatgcaccatctctctcttttttgtggggacttatcctatcttttcataaacagacggagacttgtatggttgtcgtccgaatgaccttctgatgggacagcccatacctacctccacttccgccggaatcaggcgcgacgtgggaaaatggctgtctgctgacgacatgaccagtgtcagaccggtcacaaatcggtcattcttgtccaccacgcgtcagtctataaatctgcatgttcgcccttcttcattcaatatcttgcttgtaatggttaggatgaagcctggcatatatctgaccggaaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaatcgcaataaatgtggttaggtgagccccgctatgctcacctaccccatatacgcggcgcaaaacccacaaggggtcggggcgcctcggccctcggggccgagacgggagcggtccaacccctcggggagacaaagagaagggcggtcgtatcaccctcgggcccgacccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggtgtgacgccacttcctaaggcctggtgacatggtggggccggtctaaaaatcgggacaatccggttcatttttcctggagatatggtgatggcgctttggttggcgagcgtaattaacgcgcgcacgagatgttccatctcgactgccacagccgcatgtccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcactcttaaacatctcttcctccggcgtca

SEQ ID NO: 44499 - DNA, 580 bp, Oryza sativa
agttttaatataagattattttattgcaaattagacttagtatgacattattgactacggaattggtgcgactcctagcaattgactattgtagtcttaattagacttagcatatacgcccgaaacacttagcatacatgactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatgtcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 44500 - DNA, 1501 bp, Oryza sativa
aaatataatttaaaaataactgaaattcgtaattaaaaattaagcaatattggaagaagagtctatataaaaacccaatataagattaaataaaatttgaaataaaaaaataaaataaaattataaaaatcaaacatagaaatatatacgatctgacttggatcggactcctaaccaaggcagcttaatttgaataggacttattgtccgattgaggcaactcagccttttcttttcttcagagaagcacttctttttatgtaccctagcagcgcttcaaattaacgtaagtatatacatcacttatgtaaagtgattattgccgccattactaccgccaagtacgtaccgtacagattaaaaacaaatgaaacacaatgcgggattaaactaaatttaaatacgaattctaaatcaaaaaaatcataataaaaataaattaaaactagcttagatacgttcagaagttcaggactgtactactctttatacaaattataaatcgtcaaaattaggagtaaatacattaaaagaagggtccatgtaaaataatactcaaaatagctattttcatttaagaagtatttatacacagtgacgcatcgtaaatcacaagtcacgtaatttatatatgatttgatcccagtaatcatattatatttttaagagggcaagtggaggggtggcaaaggaatagggtaatggcaggttcgatttttaaaatcttaatgataataaatagtaagggcaatgggctaaccgtaaaggagtatggcggcgccagttgagggtctcctaaaaattataaaaacaaaactcaacgagaaacactaaaaaccacgtggtcaaatttttaaaggttccaagaagaataaaagtagtggtagattgagcaagcaaataaagcatgacaaagaactaagatcggaataaaaaaatatggaattttttttaaaaaagaagtccatctctaaaacaacgatgacaaataacaataaagagggaagataatatgcctgtaaataagtagagtggtggtgaactggtgattgatgggacatctaagaactataaacaaaactttaaatagaatcccaataatgattaagacgaggaacgatgagcatgccgttaagcagcatggtcacgacggttggtgggacttctagaaagtaaaaaaaataaaccctaataacaatcatgttcagataataaaatctgaaaaaaaaaattaaagaagagaggcagcagacgggtcgtagaggagtataatagcgaagccgctgacagttcgatcagacctgtaaagcagttgagttgagtgttgactgttgatgagacatctaaaaatattaacaaaaccctaaatagaatctcgatgatgattaaaatgagagacggcggacatgccattaagcaacatgttcgcggcggttggcgggacttctaaaaagtaaaaaataaacctcaatgataatcatgtctgatgttaaaatctcaa

SEQ ID NO: 44501 - DNA, 1501 bp, Oryza sativa
aatggtggccccaggctcttggaagcctaggtcatcatcgccgtcatcgatgtcctcggcgggggccttctgcttggcctcacttcgccgattgccggaaggaaccgccggggacttgccctcttggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggccttccctttcgggtggcccgcgaagcgccctcgacggcgaggacatgaccctcgtcgtcggaatgggctgacctcttcttcctcctcctgtcacgccgccctgtccgagcagcggatccggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatagtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaaaaaatttgccatgaccctgtcgtcacccccggcggcctcgatcccggtcgtgtagacctggagaaactcggcggggttgacgctcccgtcatatttttcggtgatggtgggccggaaccttgggggccaacggacgttccgaaggctcgcatgaaggctctacagccgacaccaccaaccgggggcacggagggctgatccccgcgtccgtgttgatgtgacactctggacgaggaggcgccctccgttgcgtgggcagcacgccggccattacgccggcgctcgatactgatgcgggcatccggccccccacgcagatcttcctgggtcggaggcgctgacgaaggagtggcggctgaatggcgagcaacagccgccgctcgccgcgccctccgccttgacgacacggagccggtggtagcagtgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagtgcgccctggggcgtgctgccgtcgccgtagacgaggaggcgacgctccccatctcgccgcccttccctatcacccgtggatgtcgaagtcgc

SEQ ID NO: 44502 - DNA, 1501 bp, Oryza sativa; identical to SEQ ID NO: 29960

SEQ ID NO: 44503 - DNA, 1501 bp, Oryza sativa
cccttgtgtgggcaggcggtggagctgggggggcccttgactttgaaggtgccggaagtggagcttgcgggggagtaggtgtaggagcacgaggaggagtcggtgcaggatcctgaggaggagtcgatgctggagcctgaggtggagacggtgctggcggagcatgaggaggagacggtgtaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcagaatggctaaatcttacctttattgataagttcttgaaaggaatatgcagctcacatggtgtccgctgagtgatgtcatcaacgggacaggtcgattcgtcctgtgtttgcatatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagca

SEQ ID NO: 44504 - DNA, 565 bp, Oryza sativa
tatcagctatccaaacactttgtaaatttctgtcttttctatgtctgccggatttatttgacatctcacttctacaaattttcctatttacgtatttctaaaatccaccccctatgtttcaaatgagccattgggcagccgacgtttggctcatatttagatgttgccgttgactaatgatgaagccgaactagtgtactttgactaatgataggtgcattccagaatgaagtccactgctccactgtgctacataaatttagctacagtttggccgttaattttctacaatttggcacttaattggattaggcgtactcaattggcaagctgcagtcctgctttcaattcagacgtggccataccaagctggtggcgctgttttttgtttaacgaactggtgtatgcttacgtgggggatttggatagatgagtgcgtaacgtgacaggtgaattattaaaccatacgctaaaagggaaaaaaaaactaagttaagctaacttttgcgtgacatatagcaattccgaaaatactattcagtttcttgcatttgcccctgttttg

SEQ ID NO: 44505 - DNA, 168 bp, Oryza sativa
accccaccgccttcaggtcccaccactgtcaccgcctccccctcccagcggccgtgccgccgcgcaggagggtccatgtctcctgcgacgcgcggaggacgggcggcggtgtcggtggcggtggggtgaagcgctaggccatacctgctggaaccggcaaggccaaga

SEQ ID NO: 44506 - DNA, 1299 bp, Oryza sativa
ccgccccaccaccgccgcccgttcgtcgtcgtcggggagaaggcagggcgagctgcacaggatcttccagcacttcgacagggacaacgacggcaagatctccggcgccgagctgagcgcgttcttcgcgtccatgggcgacgagatgccggcgccgtcgccgggcggcggcggcgccgccgccggctacatgctcgacttcgccggattcgttgccctgatggagagaggtgacagccaagaagaggacctgaggagcgccttcgaggtgttcaacgccgtcgagtccgccggccggatcacggcgaggggcctgcagagggtgctcgcgcagctcggtgacgagcggtcggtcgccgactgcgaggccatgatcagggcctacgacgtcgacggcgacggcggcctcgacttccatgagttccagaggatgatgagctaagtccatggaatgcctcagcttgaagctgctacagcgagtgagtgactcagcgaggtgtttttcagtttcagagtcctgagaaaattatactgctactataggttgttgataagtctgctgcatccagatgacacattgcagattgtttacagggcagaagagttcttcagagctcttttgcttgcctggagcaaatttgttgttgtcatcttgagttgtttggtgtgccacacacttaatccagtgtatcagtaaagttacagttgatttccttctttcaaaagaaaagaaacagttacagttgatttcttggcttcacctgtatttgttcaggaataaatcgtcgagatcgtgcacccttttcttattatccaaaaacactgaaatattctaaaatatagccggatagatccaatatattcttaaaatagacaatttgcacacactcctcccccccccccccccaaaaaaaaaaaacaccaaaaaaattcaatatgccaaccaccacagttaaatttattagatttgttacaaaaatattggtattaactcctagaggatagccagtgagctaaaaagaaaacaaaagaacagacaaacaacaaatagataggacagacaaataacaatttttttttcaatcactcactccgctcacccttttgagttttgattggttatgcaataccatttgaaatacaatgagaccatggtttcatcatctggaaatgacagataacaatatgccgacataacaaggaaatgtaccaactttattttcacatagtataattcgattgggtaactgtaaattaagtaaaattcaaatatgaaggttgtttttctttcaaatttta

SEQ ID NO: 44507 - DNA, 583 bp, Oryza sativa
gaggattgtgctcagtgcctcttcagtcagaggtatgttattgttagctcctttggtcattttcctgtttgcacttcagtgttcttgcctttgttagtttattaagaaaagttaggactgtttgcttgtgagttgtgaattatgttgaatttggccgctctataaggtgtgattttcattggtcgccgttccaattcgctgaagatagagcgtcctgttttcaggctctgcaaattttggtatttgtggtcgttcatgttaggttccaagcttatgaatttcctaatatttggatttaacttagaaactgcagtatctgagatgcaggttaggaaaaggtggcttaactgaaaattatgtatgttctatatggtttgcttcctgctcatacagtagatactctaaattgtcagctcttcttgtttaattacatacattcactatcatgaccattttagctagttgcttaaaacttgagttcactaattttgctcttatggattgctgctcaggtatatgaacaagtgctagttctacagttaatatcagacaagtcattggccgtaagcttcctaaggcaaca

SEQ ID NO: 44508 - DNA, 159 bp, Oryza sativa
ccacttggccatgttggccattttgtgcatttcaattgcattttggttggaatgtagcttgatgggaccaaattgcccttgctcgccggctaaaagaggatcgatccagttcatgggaggaagacaacgagcgcggcgaggtggtctacgtggctgaaa

SEQ ID NO: 44509 - DNA, 411 bp, Oryza sativa
cacatcatttctttctcccccacagttgaaaaaggagagagagagagagagagagagagagagagagagagagagagagagagagagagagagagagagagagagagagagagagagagagagagacgaaggcaaggcaaagaaaagaggcagcaaggggaaagcaatggaaggaaaagggcacaaagcagcttcctttgagctttaccagacgagtggtgtcctccctttaaccatccaagctaccacaccggccatcatggcgagcttctcctctctgaaatctctcttctcttagcttttctttcttcttctccagctctctcctctagcttctttgcttcttctccccctttatccctcttggctctgggtgctctctctctgtctctctgttcctgtttgtacagg

SEQ ID NO: 44510 - DNA, 1501 bp, Oryza sativa
tggttaggatgaagcctggcatatatctgaccggaacctgcttgccatctccagtatctaacacacttgctcctggtcgggcccactgcttgacaggctctcattctgacgggatggggctaggtgtgcgtcagaccgcctgtcgccacctaacccacgatctgatcggtctgtgactggtcactgaccggataaacgagcgcgttgcactgcgttacatgcggcgtgacgcgctcgaccaaaccgcaataaatgtggttaggtgagccccgctatgctcacctaccccatatacgcggcgcaaaacccacaaggggtcggggcgcctcggccctcggggccgagacgggagcggtccaacccctcggggagataaagagaagggcggtcgtatcaccctcgggcccgacccccccccccgagggggttaggccacgtgggtgatcgtgtctgcctcaagtctctaagtcatgatactcccggtcccatgtcaccgacaaacaggcggataaaacctttttgaccggggtgatgggtggttctgtgtgaacctggttaggtggtaatgtatctgtgtgatcgttgccgggtacggtctctgtgtgagcctactgttgagctgtgtgctattgtagtttggcaagttgtcttggtcaattaaggacttcacttcataagtcatggatctgagcctaacgtgcaaccacatgttctcatgggaagaacctggcccagtaggattccgagtcttggcactgtcggcccaggtggctagatgataggagtttaggttcgccatggggactttcttgtctgtgtgagggaaaggtgtctcatgggggaaggcagtgttgggacgaagtttctaaaaagccttgttacagactccttggccacacacaacctgaagtgtgacacttgcgcatggccgttaaaaggacgatgtatcttgtgggtcaagctgcacaacctttgcagagtgttaattaatctattcgaatagtcgcgtccgcggtcatggacatgctcggtgatatctcatgaggggtagtttgtgaaaactgggaatgaactgtgtgcaggttaatgaatatagctatgtggtcctgtgtggacgaatcctgtgtgaatggatagttggtaatactgttatttacaactattgttttaaacctgtttataaattgtttataactgcaaattgttgtgttatgcaaaatagccattttctttgttgtcagcttgcatatgcatatttctgtgtgcttgctgagtattccatgtactcaccttgcaatttcccccaattccagaagaaaggttcccgctgtttcctgaggagtttgttgctgaagacgaggaataggtcgtgagtcctagttgactgcctgtggcaagttgaatggagctactacgcatttatcttatttccgctgctactttaatattttccttaggcccttcgtggcagaataaatgtaaactttagccataaggttta

SEQ ID NO: 44511 - DNA, 1501 bp, Oryza sativa
aaactaaatctcacatctgctcttctgacaatgataagcctggaactttggtaccaaagagttctgatctaaactccatctctgttaagaatttgactagagaaagtgcacctgcagaggaaaatgctgcagaatcatccagttttcagatattgggtaagagaaagctctatgttacctctgacagcagccatggtatgaactccaatattaagaggcaaaggaagtatatttgtccatccgattctgattcgagtaatgagcagatatgtaatgatgatgttgctgttcctgataatcaatctactggacagaatgttcccatcgaagtggacagtgaagaggaaggaaatgcaagacatggaggcaaccaacaaacttgtcagaaaaatgttaatgatactgctgctcagaagtatctcaattcagtgattgcctacccttatccagactttgattttggcaaatccagagatactgaagaaactgatgaatccataaaacagtatggctgggctggtgacatggaaggtaaaggcctggtgacaagaagtgacagagttcaattttcagaaattagccaagctaaatctcatgtgcctcctgctgacaatgatatgcccggaactttggtaccaaggagtcctgatccaaactccatcgctgtgcagaatttgactggagaaagtgtatcagcagggacaaatgctccaggatcatccagtcttcagatattgggtcggagaaagctctgtgatagctctgacagcagccgtgctatgaactctaatattgagaggaaaaggaagtataattctccatctgatgctgattggagtaatgagcaaatatgtaatgatgatgttgctgttactgagaatcaatttgccaaacaacatgtccccatcgaagtggacagtgaagaggaaggaaatgaaaaacatggagacaatcaacaaagtcataggaaagatgatactgatacttcttctcagaattctgccaatccttttttttttgggaatacgcttctagcgtatttttgcatttagaggagtaaaacagccatttacaaccaaaggcaaaagcagcaggggacaggggaaccggacaagagaaaacacacccggccacgtgcctacacaccaccacaccgagaggaacacacggccacctccaaaacgatgccttcaagaaggtcacgacattcaaaacgccgccatcgcccatcccgaaaggatgaggttttcacctagaggatccttgaagagggggagggaggcacctcaacaacgccctcaagagggttgcaacgcccaaagacgtcgccgttgctgcccaagaattgggccggctttcgcctagcacctaccaatgcccctcttgccactacctcactgactcccaagcaatgccaacacgtggcctctacagcaacgacgcccctccgtcggctggactccaagcgacctgattctgccaatcctgtgattgcctactc

SEQ ID NO: 44512 - DNA, 1501 bp, Oryza sativa
cctgaaaaccgcaagacgaatcttttgagctaattaagtcgatcgttattagcacatgtgggttactgtagcacttatagctaatcatggattaattaggctcaaaagattcgtctcgcgatttccatgcaaactatacaattagtttttctttttatctatatttaatgctctatacatgtgtccaaaaattcgatgtgttgtttttacgaaaagtttctgggaactaaacagggtcttaactttgagtcttgaggaggtatattcagttattcgctcttgaattcttcaggcatcggcaaccgacggaaaacgaggaaaacactggccctacccttcaccttgctttgcccacgccaccaacactagcccaccacctgctgctgacctcgccgcttcggcaccgccactactgcccaccgcctccctaggccatccctttaactgtgatcctccacttcccctccctactcccgaaaccctaaccctacctcggtgcttgtcgtgacgtggtcaggaccgcgcgcaagtttgtttgctagcacgtatacacgaattagcattcatgctttttcttcggcctgcttttgcatggttgtgtggctgtgcttgtggtgaagtggaccttttcttgatatgggctttgtttatgtctttcgaaccttgacttttaaatttactagaaaaaatgctcgtgcgttgcaacgggtaaagatgattgtcaatgatatattaagagctgagtaataaaatgaaatattgaaatcactatacattataattaaaaaaagttaatgaaaattataatgttgggatcactatagattataattaaaaaagttaatgaaaatctttcctgtgtattaggccgaaagccttccttccttttcagccctaggccagtccgctacctctctccgtttggcttgcttccttcgacctatcaaatccacccaaaattggttgagggtttttgatccactcgattttctctttccgtttttcctaaaatcaaactcggggtaaaaacgattaaggaagttcgtcggcaactattagattaaatccagcaaaataaagccaggaaaatcgtggagaaaataatgaggaaggagtgggaatcgatttttttcaatcaaattggaatagaaaacgcacgatcgatatggagcgtcatcatcggcaactattagattaaatctgacgaaataaagctaggaaaatcatggagaaatgatgagagaggagtgggaatcgatttttttcaatcaaattgtagtagaaaacacacaatcaatatggcaccgaggttcaactcgggagaagtgcggcgaacaaatcggattaaaaaaccggatgagaaaaaccaaaactgcaagggagaaaaaaccggtgaaaaaaattgacaaaaaaaaccaaaagcatctaggaggggcgcggtgaacggatttaaaaaaatggacgaaaaaaaaccaatgcgcacaaaaaaaactcgtttgcg

SEQ ID NO: 44513 - DNA, 1501 bp, Oryza sativa
  unsure (1)..(1501): unsure at all n locations
cttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtccccccgtgtcagactgatagatttgacgggccccacgccatagcaaggcatgccagagacttccaaggcaagcaacaagacatgcatttaatgtgattatcctccctgaataggttcggtgggcccatgtggtaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgatgaagcttatcccccatcgtctcactggccgaccttggcccctgttatttttgggtcatatctaattcgttatactcaaaatacacctttggtacaaaa

SEQ ID NO: 44514 - DNA, 1501 bp, Oryza sativa
gcacattggggcgttcggccgtcatcgacgagctgctcctcgcgcacggcgtcggccggcgaggtcccccgcacgcagctcgctggccgacgaggtccagccgccgccggtcgcttctccaatggcctcaacatcccggacatcaccagcgagcatgcacacattacttcatgtcgttcatcggttcacggggtattcttgtttgtgagtatgctgttcttgctcgtgtccatgggcagaggttgtacgacatggggacgaggagggtgctggtgacagggacagggccgttgggtgcacgctgcgtggccggaacggcgagtgcgtgtcgcaggagatgaacgctcgcgtcggcagtgcgggaactccaactccttccgcgtccactagcttcgactgcagccggcgacgcgtgcaggaaggacctcatcggctggcggctcgcgcagggaggacagacgagctgctccccgcccaatggacgaacgacggcacgggcacggacagattgacggatgtggcgttggatggatggagtggcacggaatgaaacaattcacgtcctcgatgacatattctaaaagtgtgacgaattgaggggcaaaatctgaaagtgcgacgaattgaatggcatatattgaaaaattatccttgatctcgaggacttcacttcctagcatgacacgtgtccaattcgaccacagtagactactcactctgtcactcacctcacctctgcctctgctcttcctctaagaacctaacgacacccactgcccaccccggtggctcgccggcgccggccgctgcggatcacgctctagccccagatctgctcggaggtagcatctgttcagcatttgcgtcccattgccccgagttctcctctttattgggtaggttggtttatgccaggttgtgcgtgcgtgttaggtttttttggatcggaggtttggttttgcgttctgggggttagtgtgttcttcgcgaggatatggccagcgatttgatcgtgcagacctcttaatttaggtgctttaggaggctagggtagtagacatcgagtaggatcgaaatatttcccctctttctttttcggcaatttttttaaagatttttatgaatgtatatatgccacttcaaaatatggttgtttggaaagatgccatccagtttttttttcaaaacatttcaaaatggatcccttttgttttgaaggaactgtatgtcatttttccaaattgccattttctgaagtgaataagactacacgagtatatccaaatgtgctttcttttttttcccagagtattcataattttgccatatatattttttctgttaataaaaatgctcttttgtatgcatgcagggcctgatgcactgaaagttcttctcacattttatagatcttgataacatgataggtagagcatgttaatgccattctggaacaagtatatgtgaagggtttcttggtcaaatttctggaatactttga

SEQ ID NO: 44515 - DNA, 853 bp, Oryza sativa
cctcccttctgccattctcctccatttcaccgaagccaatgtggggtacattttataaagaaactactcccttcatgctttaatgtataacgttgttgactttttgaccaacgtttagccattcatcttattcaaattttttgtgcaaatataaacgtatttatgtcatgcttaaacaacatttgatgataaatcaagtcacaataaaataaattataattacataaatattttaaataatatgaatggtcaaacgttgattaaaaagtaaacgacgtcataaattaaaatttaatacggagggagtatttttaaaaaaaatgggaggaaaaaaagataagttaaccgactgttaagtattaatagtcactgaagtaaagctaaagaagggtgaaaaaatagagaaagaaaagagggggaaaagacgaagatggcaactgtctcctaccactccagtttccgtttcatcactccactgtccaagtctcaaatcttcttctcccttgctccaatcctcccttctgccgttctcctccatttcagcggagccagtgtggggtacattttataaagaaactactcccttcatgttttaatatatgacgttgttgatttttttaccaacatttaaccattcatcttattcaatatttttgtgcaaatataaaagtatttatgtcatgcttaaagaacatttgatgataaatcaagtcataataaaaaaaatcataattacataaatattttaaataataggaatgatcaaacgttgataaaaaagtaaacggcgacatacattaaaatttaatatggtgggagtattttttaaaaaaatggagaaaaaaagataata

SEQ ID NO: 44516 - DNA, 1205 bp, Oryza sativa
gacacatttgttttctcttgtttggagaatacaagtcagagaatttgagtgatccgaaggtgctcacggttcaaatttctcgtgaaaagtttaggggtatatgcattgttctgatacttgatcagttaattttgtgtgagaatggtcttcaggtgatctggaagttttttgcttctgattgtagcaagtaattagtagataaaatcttcaggaatttagtagatgagattttttttgagaactcattttctagtcttttatggaaatgataagtttagccgcaatccatgtacaatacgaacataattgagattcccgatatgcttaaatatgaacttaattgaaaaatccttattattcttatcattttctcatcaatctttaaatatgcttcataacttggatttgcctaagattaattcccagagtttagtgattcttttgtgcttatctctctagatcgtttttgccttcttccagtgcagttcaattgctcaagattaaattttgttgttgtgctaagtgcaaaattgtaaataatttgtgtgctatctatagtactgcttgtctgaattgatagataagtggactaaactgacttttgctattactaaatattcagtccatttacaatcatctggatccaatggtggccattatttaaaatgtcagtgtctaccagggttcacaattttggatctgaaatttcgataattatctgtctatcggcccccaccccccaatacgatataattttggccgaaatttttaatttttttcatttttttcgtgaatttgttaatatgttgttcaaattttattcaaaaatttataaaattttggaccgaaatttcggtatttcggccaccctcgatacaaatcagcaaaccgaaacattaaaccctggtgtctaccatgtcagaaaatggtatattggttcagtctgtagatcttgttactccatagagatgattaattattggggcttggagaaattttttgtgtttcagaactgtttaagtgaagctggtatctagtgcttcagaatgctgaaagaactactgcattgcacccagcatgtgtgatatccaactatgttagtttcatgtccacatttagttctgatgcagctagtctgaatgcttaggtcacttaattaaagcatgggttttccttgctcaagcacaatcctttcttcctataga

SEQ ID NO: 44517 - DNA, 763 bp, Oryza sativa
atttgggatgggtgaccgaccgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgagggcagtcttatgacctatgaaagctatcagatgtaagcgggcccggcaatttgggatgggtgaccgactgggaaattcttcccgagtgtacacgagtgaggacaaagtgtgcagaaaagacatgtgttggtctgtgagggcagtcttatgacctatgaaagctatcagatgtaagcgggcccggcctgggggaaggcgggacattacaatctccctctgtattatctttttttctccatttttttaaaaaatactcccaccatattaaattttaatgtatgtcgccgtttacttttttatcaacgtttgatcattcctattatttaaaatatttatgtaattatgattttttttattatgacttgatttatcatcaaatgttctttaagcatgacataaatacttttatatttgcacaaaaatattgaataagatgaatggttaaatgttggtaaaaaaatcaacaacgtcatatattaaaacatgaagggagtagtttctttataaaatgtaccccacactggctccgctgaaa

SEQ ID NO: 44518 - DNA, 1501 bp, Oryza sativa
ctcactaatcccttcctctcctgaatcaattttgtcgaagcaagatttcggcaataataaaaggggtggctatcaagataggaaagtggatgggtttggagacgaggaattttatacaggttcaggccttcttattcaaaaagtaataccctactcctgtccggggatgattccgccgagtgtattattgatcgtattatctaggaaaaaatcgtgccccgagaggcacacggacccctccttatataggggaaagggtccgctttacaaaatacagtccatatcccaacggaatatgggattatagataaaatacaatcgtaaccaactaggatcccgggtatttccttgacatacaagtttagaatctaacccgagtcctcataaagatattctatctatattcggtaccctgtacccagctgaaatataactgccatgtagatatggggtatccataatctccacactagcccccgagacctttgcagtcgccgaaatagccatctcagaacaaaaaacaataatccgagtgcttcacctcttcctgctttagcctgccgagtactagaatcaaagactgtgaagggcaaaaataaaacatggtgcatcgagtagatgcacctaattaggtatagcccccgactatatagttagttgaaaaactaaacaggtagtcaagaaccgagcggttttacaaccaaacatcaaacgacaagagcacacgtagtattcagtataatacccagccgactgcttttggacttgaatatatcaagaataaaaatatgaaaagggcccgagcgagaaacacttaaaaggtccacaaaaagacacatttgacaagaatccgagtaggaaactcttaaaatgatccaccaaatatgataaagatcatggtaattaagaagtttaatagcctaggctataaccctttccataatcaaaataagcatataacatgctaagagaatgactactaataaaccagtcatctcaaattaacccaaacagcttttgtagcctaaaaaagcttacaaaaatagtataacacttttctgttgggtaccttttatttgcatcgtagtaattctaaagaattatctaatcgcattaaaaaggattttagcagcatcgggtcacatcattgtgagcacaaattgctaaagcaaaaagtgcctaagttcctaaggatcacaatgggccacgctggtaataatattgggctgaagtactgtacaggcctaggcctgttagcactcccgataccctaacaaagtaccaaagtccaagcggcgcttcgttttccccgccgagactctcgccatttccccactccttgctacagtatcaaaccgcaccgtcaaagctagggttcatcaatccgccccaatccattctcaaaaaatcccacgaaacctctccgcatgtccaccgcattgattcctcattcccctccacctatatcttggaccaaatcaatccattcaacttgcatcca

SEQ ID NO: 44519 - DNA, 207 bp, Oryza sativa
tttagcgttgaacagtgatgatttaatattgcttaattacatatattgttttacttattcaaaatatgatttataaatgctgcttttattggaaatatccaatgagccattcctttgtgaatatcttacatcatgcatttccgttggtatgacttgttgagtatggtggttggtgctcagtcttgctttatttttctccaccccaga

SEQ ID NO: 44520 - DNA, 1501 bp, Oryza sativa
agagtacagagtccatataggaatacaatttagaagtaactgaaattcgaattaaaaaaaatattgaaagatgagtttagagtccatatagaaatacagttagaaataataaaattcagaactaaaaaaataatcaatattagaagaagagttacatatagaaatataatttataaagaacggaactttgaaattgaaaaataagaaatactggagaggagtctagagttcatataggagtataatttagaaataactgaaattttgaatttaaaataagaaatataggaataaagtttataaataatataaatttataattataaaaataaagaatgttggaagagaagtctggagtccatataaaaatacaatttaaaaataattaataactatcacatatatacaatacattacgaatattacacattggttagtttgatcaagttagtacaaaatttaaaattatgttgccattttaatatattttaataataaaatgtgataatatatatgctactatatctctactattataaaaattgaagatgttcccgcggtccgttatccgtgtttgagtcggttataaaaattgaagatgtttccgcggttcgtcatccatgtttgagtcggttttaattttatgttttggttttaatctatatctcttctctatctctactattataaaaattgaagatgtttttgcggatattttgatacgccatccatgtaagagtcagtttttgagttcgtttgcttttagaaatacatatccgtatttgaattgatttttaatattattcacttttggtaatacaaaaggaatcatacaagaaactgttaaaaaaaccccgcatgactcctaactgcagctcatgattttctaaaaatatatatatccaactgaactcccacagtaaatttcatctaaaataaaccatataacaataataagattaaaataaactttatccgttgcaatgtaccagatattttatctagtgagagaaaaatataaagatgctagttgcgtaatttgcgcaggccaccataatgggacgctacatttaaccatggaacacagcctcctacctgaagttctgcccactatccacgccctcactcatcacagtgccacggggacccgccccaatccacctcgccgccggtgggtcccagggctccggtcactgctcccgccaacgacgaccttgttagccccctagcacaggtgactgttggctctagatccctctctctttctctctcccgttattcctttttattgggaatattggggtcgattctgtgcagctcatgttgttgctgtttgatttcctggggttctgggatggcagttggaggttgcgcggtaattggaaattttgtgcaacacttcttttaaatagggattggtggaaaatctagaaaacgatggcatgcattgcaaggtcgcaaggaggaacggatagggagaaaaaccctcttttttttttgg

SEQ ID NO: 44521 - DNA, 1501 bp, Oryza sativa
ggtctggttagtgaattagcaaaatcatactagtttatagcatgtaccgtggttcttctaggttgtatccatctgtgtatggatgcaacgtgtttgcaatgcttttctgatgaaccagtgcaattcggtccacaagctacacgcatgctcttgatggttgggttattgatcgatgagtgaaattcttggtttgcggcgtaatcttgttgtttgtaggtgacacatctgaggatgtaagtgttacatgcagattgtggacagtttgaagaattgtaattactaccctagtctccattttttgttgatacttgtagcagcatagcatatctatgtcttattctttgttgtgatgtgagaagtttataagctacaatatccacaggaatatcacgatggccgtgttgatgtgatattgcgacctagcgatataatatttgttcagtcatggcttttagtttattgtgaatgcttatcagatcacatggactgttattctatttctgtcccagacattcttttatttagccattttctgcagtctaagtgaacccaacacaaaatgtatactacaatattgcaaaaaacaccacgaaaacatgcataattgatgtgacaaaattctgatcctttttccatgaatggacgcatacctctccatgtgccggagcatgatttctattgcaattcattgttcgtcttctactcgagatcagaagttagaaccttagggatgtgaataaggagccgtgacatgaaaagttttgtttcatctcctggtttggcttttcagagttaaattgttctgtgaaactaaatgctgtggaaagaacagcatgtggtgcattgagtcacctaagtgaaactactggtgatgaatgagcgagacgagttattttatttctctttctttcttcaccattaatgtagtcaaattgaattaaccacatgtattaccagtacatttatgctgaaaactgtctatcattatatgatagtgttcatagatttttcaaatttatcacactagaaattatctgccaaagtagtattttagagactttgtcaattttgattactgctccctctgttctttttttcttgtcatttagggcatcgacacaatctccaatgcacttgttttatcattgccctttttgcttttatatttacaaaaatcactatgtattaacaaataactaaatgaaagtagttttcatgtgaaatctactaatgctattttcacatattaaatacaaattagtttgtgaattaaattttgaggttcacttattctaaaacaacatctagaaatgaatgaaggcagtattttggtttctatgttgtcatgcaagttgtttgataagtacctctcattggacattgatactccaaatccaaacatcatcacttcatatgatgcttggacgatgaggtgcaagcctcattctaaatgcatgagtatctgaactctactgatttctcaatcatgcattttctttca

SEQ ID NO: 44522 - DNA, 1501 bp, Oryza sativa
tgttctccttacaaaccctgctcctttagctttatcatgcgctccatcagttccactgcttgggcagcctcatctcctgtaggcaatgaattccatgtgtcttggtagaccgtagggagacaagaatactcgggaagggctggttcaggattttgaacgtagaaccagttggcgtgccagcctttgtttgaggtcttcaagggcatggagaagtatttttggcttagtgttcccctgagttggaaaccagcgcccccaacaacacatggtttgctcttgtttggctggggcttgaggaagaagatgcggcggaacaaggcgaaatgaggcctaatgcctagaaaagcttcgcaggcatgaataaaattggagatatgcactatggagtttggattcagatgatgcaagctaatcccgtagaagttcagaattccccggaagaatcttgaggttggaagagaaaatccgccatagaagaagtgagagaataccacgatctcatgtgtatcgggggtcgggattgcctcgccgaacgctggtcgccacccgatgatttccttcgccggaagaacgccgtgcgccaccatttcttttagattctcttccgttacatcggagggagcccactgactctcgaaactttctctctcttctgccatggatgcaagttgaatggattgatttggtccaagatataggtggaggggaatgaggaatcaatgcggtggacatgcggagaggtttcgtgggattttttgagaatggattggggcggattgatgaaccctagctttgacggtgcggtttgatactgtagcaaggagtggggaaatggcgagagtctcggcggggaaaacgaagcgccgcttggactttggtactttgttagggtatcgggagtgctaacaggcctaggcctgtacagtacttcagcccaatattattaccagcgtggcccattgtgatccttaggaacttaggcactttttgctttagcaatttgtgctcacaatgatgtgacccgatgctgctaaaatcctttttaatgcgattagataattctttagaattactacgatgcaaataaaaggtacccaacagaaaagtgttatactatttttgtaagcttttttaggctacaaaagctgtttgggttaatttgagatgactggtttattagtagtcattctcttagcatgttatatgcttattttgattatggaaagggttatagcctaggctattaaacttcttaattaccatgatctttatcatatttggtggatcattttaagagtttcctactcggattcttgtcaaatgtgtctttttgtggaccttttaagtgtttctcgctcgggcccttttcatatttttattcttgatatattcaagtccaaaagcagtcggctgggtattatactgaatactacgtgtgctcttgtcgtttgatgtttggttgtaaaaccgctcggttcttgactacctgtttagtttttca

SEQ ID NO: 44523 - DNA, 418 bp, Oryza sativa
gtatgctgaaaaggtgttttttttattgtagtatactgctgctagaactgcataacttagatatggttaaaatatttattgactgcagttgcaaataggaaagccagtggtagttcatcccagacagataaggattacattcaatctttaaagggtttgtatttttctaataaaagcaaatcattttacatttattaaggaaaaaaactgacataatcaaatatgtatgttacagcatcatacccagaacgatcgtactactgacctccgacatatgaatgcccattttgtggtgccatcttttggtatcaagagagagttaaaaccctctctgctgtctcgaaaagaaaaatagtttacaacctatgttgcaaaagtggcaaaattgaattgcctcctttatgtcctctacctgaac

SEQ ID NO: 44524 - DNA, 1002 bp, Oryza sativa
acggagcggagctcggggctccggggagaaccagacgggccgcctccggtggtgggctcgagcggctggggctaaccggtttcgcccagcgcgagtcggaatggctcggtcgggctttgtacggatctgtcgttttgagtaggggtgaaaaaagcaacggatttttttttgaatatctaaagtggctcagtttatacgttttaatatgttcatattagttgttcaatttatcattttagtttaaacttattcttagaccccactttaaagccacatggctaaacataatcaacaactctcttgataaatactcccttcgtttcaggttataagatgttttgattttgattaaagtcaaactgctccaagtttaataaagtttatagacaaatataataatatttacattaccaaattaattttattaaattaataattaatcatagttttataataaatttatcttggatcgaaaatattactagtttttctataaacttggtcaatttgaaggaattcatcttataacctaaaacggagggagtaacacttatacacctctcattcgcgcatataagattttattttagaaagttttaccattcacgttgaagttaacactaaatagttaattttataagtatgaattttttaaatacgtttaccccctttttatgaaaacaaaaggaaaacgtttctgattatttccgatcgcttttatagcttcggcgacacggatgcagttaccatttacgacttacgacttgagaggaggaagcaaaatttatggttctttttggatttgaaacaattcgagacaacttcacagatggacaagatagagcatgcttgacagaattgtgcatatttgcatttgatctttatggtagagccgccattttctatctagtttccctacaaaaaggcatttccaacatggtaattggctaaaaagaagtataaaaaatactcctactctgcattcagaattcaagaccttta

SEQ ID NO: 44525 - DNA, 178 bp, Oryza sativa
tgaaaatcaagtcctttgaatatatctctctcaatgttctgaaattgtcaaaaattcaagaatatgtacctcttttgtgaagccaatgcctttccttttctctttctatccattttgtgttgatttcttcagttgaatccttctctttcttttgttgtttgctcggcctgcctgcagc

SEQ ID NO: 44526 - DNA, 213 bp, Oryza sativa
tgtgccgtggtcagtttgcgaccgtggttttggtgtgagatggaaagtgaaattcgctgtgtattaattggagggatcaaagggaaaaaaatatctcagtttttgaaagaccgaaggagaaatatctcattgcactcaagttgatcgcatttttcccgtgtagtacagtaatatttactccggctaggcttacctgcttgtgcatcttcacag

SEQ ID NO: 44527 - DNA, 835 bp, Oryza sativa
catggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgttgtttttggtgaattatcagtgtgcagatgaatttcatccactgctattgaagaagcttttagagggatatcttgtcttgtcggactaagagctcttatctctttcttttcccacggtaactagagattgaataatagaagcctgattcaataatagaagccagattcaatatcataagaaaatagagattgtagcgtagagtcaggctatcccatgtttgcaataacagctttgggatctttcctgttaatgatgaatagcttgcctcaacagagaatcagaattctttttattcggtataacaaccttaaaaacgaatcgatctagatgccccgctcttgccatctttgatggaattgaatcatcaactgacttacttgaggaataaaaaaatctgca

SEQ ID NO: 44528 - DNA, 1501 bp, Oryza sativa
atccacaatgcagttcttgtccatctatgttaatctgatctagtcttctaaattgattagaaataaagtcacgatgaacctggcaaagaaactgaaatattacctcgatcatttcggctctaattggtgccaacggcttgatcttggtaaccatgttgcgtcagacagagccacagaggaatgaaacacgtggtcggcatttcgtcgagcaagttgcgggcccagaatgcacccgccagagattcatccgccaaaccagggaaggctcttgaggcgctgatcacggatcacctcgtcagttcaatggtgcgcttcagtaccaggctccggtggccatagcagcaacgttcattgccgtggccgatggagaccgcgacggcgtggcgaccatgggcgcttccccgcgccctctactcggagacgtagtgcttcccgcttaaggaaaggaggtgatgggcggagattcagagaagcggcacggcgataagactgccgttcggcgacgccgcggaaggcagccgtgagccgtcgccggctcgccgccggcggaagagaggcagtaggggagggagagaaacacgagggctaaaatataaaaaatcctgatcgctacagcctacaattggtagcaatccaaactactccagggatctctttgcatgactcctggtggaataaaatatctagatttcatgggccaaatttgctgaagggccatataggcccaaaacatcaggccttcggttcttcgcgctaagtggcccatctatagtaatcatctgcatgggcctgtattagacctacgcacgggccagattcttcttctggtggatcgatccgtgcatgttctctgttcagcaaccttctatcaatataaaacagaagataggcatcgtggatagagataaagatagggatccctataaatcgaaaagtgcacttcttgactactactactatttcttagactttttcaaggaaacatttttttttttcgattttgactgaatggtcggagcgtagacgagtgagtagagcggtcagatcgtcattgagcagtcaactataattataaaactgctgacctgagagaaggcagcctctctcgggaaacatggcccaatttctattatttcttttctctttccctctatcataacgcaataacaaaaaggataaggactatatatataggaacagagtaattccaatgactgaaactaccataaccttcccaaccaggatgaggcataagcttaccctgattacacttctaaatttagaattcgatattcactaaaaaaaatagtgggttacttcatggttccctaggcccggagcttcttgtttcttttaatcttgaaacgtgttcagaaaaatggacagcatattctatgatgtactttaaaggatgcatatatattgtaggtataaagtgaaatctctgtgcttcatatagtctaatgctcaccatcatttttcaggatatactactgatatt

SEQ ID NO: 44529 - DNA, 730 bp, Oryza sativa
ttgggtataccaaccattcaccccccctctgatggcttagttcttatgattcgatcctataagtggaacagtgatcatccaaaaccactcgtatgcaacacgccagaagagaagaggagagaatcaattgtccattggattatcgcagctgcaatcagtgaacacgatcgatcaaactgaatagagaaaaagattaccggaaagtcgaaatgcacacggttacgttacgtgccaagcttggtagctccccagatgtcgtggtcagcgtacaagagtgcaattagatcgtgccatttcagctgctagagtgccactccgagtcgggctctgcacaaaacaaaaggaagaatctgttctgatccaggtggagacagcgacgtgaggaggagaattactcgaagtcaaaagcagtaaccatgacaagcagcgacgagaaagagaggaaggagagctctcgagaggaaagggaagaaacgaagaatcaagaatcagctccacctcccgtgccaccgtatccatccacccaaagccccggccttttcatcttgtccccctctttttttttccctgccttttcgtcttcgtcttcctctagcctcactcagcatctccgttgcaccggccaagaattccacgcagagctggccggcggcgacggtggactcgccgaggaagcaaggatgtcatgagccggcggtgtgaaggcgccgccgggggatggagaaccggg

SEQ ID NO: 44530 - DNA, 229 bp, Oryza sativa
cccattggcagagagcgaccgaagtttccagtaaaaagcagtgcggatgccacacaaaatggtcgaacacatgttgaagaagatgatggtactggtactatcaaggttgagagggctacaagggatgtagtctctccttcaaggtgaatttagaaaataacttgtaagcgttatcgtgtttgtcttcctgtgccttattattattatttttttgggattctattttagt

SEQ ID NO: 44531 - DNA, 305 bp, Oryza sativa
ctgcagcccagcttgctaaggcattcacagtgcgtcatccctattcgaaaaaccttagagtgccacgtagacttggctacaagttcaaaatttagatttctcatggtgcaagtggctctaagggtggctttgattttatatttcaacccctacaactctttgttttggtcctcatgtttttaaaatttatgtggaggtccaaaatttacaacaaacaccctagaacagattatcaaatcccatccctccccttccccaccccttctctctcccttatcccctccctcgcgttctctgttgccagc

SEQ ID NO: 44532 - DNA, 1501 bp, Oryza sativa
cacaattgtggttccattgtccatgtaaatatcattaaataaaaatggactaatatacaaatttcagaagattgataaatcatctaaacatttgttccctacaaaagtgcttttcatcatcatattcatatggtacttgactatatgttgaaagacatccacatttagaagtgctctttaccacagttttgaggtcttctcttccctaatctataaaattacaaaaacgtctggcatcatctatcctcttgtctcttcaaaattgatcggattagtggcctcttaacacaaccatagctacaccgccgacatgaacaataatacatatatttatctaaaattgatcccagaagtaaactgcaataattttagtagagctcagtttacaaaacaaacaccgatgatatagccaagagtcaggagaagaacatatatcatttaggtgagataagaatgacaaaactgcgtattactctgtacaagtagagattgtattctctgcaaccttttcccttcacccaactcaggaaaaatttgtaaattgtcaaattttgctgaaagttttttctggtttgaagaaagaagaaaaaagagcatgaatgtctgatatacctgctgagttactgcagttcttctactgacagaactttgtcaaacaagaaaaaagatctccttccaacgcctcctcaaaattaaaagggactttctagtggccagttgatgattccctgaccatagtcacttgaatgatagcaaatgtgaaaaataaaaggatcaggttgaaacccctctacaaaattacgagagtgagcatctatgtagcatgaaaatagatgcagataaatcaagaagtacaaacctcattatttccaattccttgcgagcattaggaaatatgagcaaaccaatcgatatgttgcacatccccaccattaatgaaacacaatgctgaaaaaaattgcatttagaaacaataaagataaatatgcactgcacatttccaggtcattgtggagcagaaacaaatccataacaaatcagcaagaggaacataccagcatccagcaacaacaaaaacaagagccagggaggacgttgacaccaggctcttctttctgccggtgacgaccgcagcgatgggggtggaggcatcgtgagggacaggtggtcctggcgacccgcggcagccagcagcggagggcgaggaatttattttattcacttacatctaatccacgatacaattttccttttctcttacattataactttgtgtgtaagcttgttgatgtataaactttatgcacatggactttttaccgtagaaactttgtgcacaataactttatagctatgcacatgaagtcttcatgtccccatcccgtcataacaaaacaaatgaattctaaaataaagaaaagcttaaatatgttttagttgaagctcgaacaagaaacaaaacaacgttcttctggccaacgaagttgcctccattgaagag

SEQ ID NO: 44533 - DNA, 1501 bp, Oryza sativa
cctcaaggaaatgaaaaaattaactagcacagaatctggaaactttgacattggtaatcaaaaggactgtatatatcaggcatgatgataataaggctgggaaaaactgtagataccaggtttgattcactaaagttcaccaaaaaactgtagaagtttttaaacagatgacgtgagctctacccttaagaggaagagaactgcaaccacaaagagcaaaagcactaggaacaactgctttaaattttcttcagaataaggagaaagcaaaatgccaggattggccacatacaaggtacaaaaggacagcagcaaccagccaagaaaccatcaaagtttacctgaacaaaaaagatacgttgtgaaacaggaactgaactactcatctaatcaactgtaaaaataaagaaacaaaatctggaggaaaattgaatcgaaatgacgtagatgaagttggttgtgcgcctaacagcagccatttccatcatcttaaaatattgcagcagatgaggaagaataccagcactaaattaacgagtatacacttgatcaagaagatggtataccattttaatcatagaaaacatcacacaaaagagggggaacaaaatatcgaagaaatacatccgataaccatccatttccttctaaaactgactaggaagagcaaaataaaattgaccgctatcctctaaaacccaaccacaaatatggaaatcgggacagaaaacaaaggggaaaggagaaaaaaaaaactgaagaccatagatgagatggaacccttacacagaagctggagaccatccatagcagttgaaaaattcagcaggaaaacagaaacacacaccccacacaggcgattcccagtcataagcacaaggatgaaatgatgaaagaataccaaaatgcaggagcaaacaaagcgatccgggattcaccatgaacgaaggagatgcaaggaaaaaaaaatactggcatatcatatcacacgatgagagtgatagaaaagagagagcaaactaaccaggatcaatgagtagccgcagcagcgagcgagaggcaacaagagcacagcaaagaaggcgaagagcttcttctatgcaggcgagcgttggttgggcaatgaaagggcaggcgatggcgattgccttcgtggttgccttgcctccaccgctgacgtgtggggccccccgtgccagaggtcgctgctagggcgaaacgtggcgctctcatcactggtagctttcccatgtagaatgatcactgatcacatggtaacactgtcctcggctagccactgcctcgccaaatatggctataggagccttcaatggtgcactgccagcatatcaataagctggttttaggatcaacagcagcaggagtagctggtgcaacaaacaatccaagcgtacaaggctgatgaattgatgtgatagcacagtaggctctctacatctctacttggatcattctacaagcagtcaaagcttagcatcat

SEQ ID NO: 44534 - DNA, 1501 bp, Oryza sativa
tatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccatggtacctttcggtcacaagctgcttgatcagctgtgtagcataagtctttgaagagccagtaaactgcctctttattctttcaaggtactctgagacagcgtcacactctgggattgagcccaatatggtaggctcaatcgtgttctttaccatagccaaacatttcttgttggctaaggaccatttcttttgttcaatgtcatacgacatgacgagaggagcattgtccctctgtctcttttgccagtcaccatctgactcattttcacctctgataagttcagcaggttctataggacatggggtagtcaacacccagtccacctctcccaagatgaaagcaaggtcgagttttcttttctattctgcgtagttatctccttttagggtcggaatatctttaatgcaacccatcaagaagtagctacctaaaataatcatgtacggtgagaacaacattaacattaaaatattatgcattaagcctatatcaccgttgggcagaattagacataacatatataaccataactataacattgcaattatcaacgttggtcagaaaattacaatatcatagcacataattaatgttccaaaaattaaattctcccgttggttcgaaatttaattttagaaacactaattttcatcaattttatctatttgcagcggaaaaactatataaaaatcatatgaacagtagcaaaactctgtaatttactctctgtaaaaattctcccgttggttcaaatttaaacagaggtaaaacatgcaaaaatctattcaaaattctattgaaatttgcatgaaaaattgacaaaatttaaaaggaaaaatgctactattcctttcctttctttttcggccccccgagggacctaatttaaactttttcccggtggcccacggccttttggcgcgcgcgggaaaaaggttagatctagtcgggtggttctatttgggattgatgtttgaactatagagattgaaaacgggagaggatttagatagaccgaccggttgaggtgttggaggatgaagaagtgccggccatcgtcgtcgttggcactcggttgtcatggatgcggcgccggtgaggtcgacggcgatgacggctgcaacagcggtggtcgtgggcgatcccggcgaggtcgtggcgcggcggtggcatttcccgtcactggctacggcccctctcgatcggattagggtttgtagggtggagttggcggcggcggtgaatctcgtcccttgtgccgtgccggcctccacccctcttttatatggcgcagtgtgacgggggcccatgtcgcgaccgagaaaaatacattttcccgaacgc

SEQ ID NO: 44535 - DNA, 1501 bp, Oryza sativa
tccttatataggtgcggaggcaaccggctagatatggtagtgtagccttcataatccgggtacctaccatctatttacaagggataggattggccaacttatcccttatctctttcttagtttacaagttaaccatgtgggcctagggcactcggcccacctcatgccgcatggcccaaaacgccttgctatgggtatctgggtaccatgtaccccacactgaactgaactgaaatccatacacacttaataacaactggagctatttttttaaagtgtatcctggaacatttattgaaaataaatagttagaatatttttttctaatttatttgctggatagctagacagatattaggatgagaagggattagcattggtagatctcaactatcaattacttaggggtaaaattcataagccaatgactctgtcaaaacctctctgccactgtttacatttcttaataaaataataagagtacaatactgaagaatgtaaaaaggaaacactagaaatggatgatatttgtttttcctgctttcctttttttacccctttccttgtgttaagcgatcgaccttactatatactcttgcattttgtcattattacatggaaatatcaccataatgtagtatgatttagtgcatggcttcctattttactacatgatcttcatttgccgacagttgaggtacatagaactgccctcacatgctattttttcaagcatcacggcatcccccttttttctttgatgtgagcatcacgacattcttatccaccagactaccactagcatttatttactattagaacaggctgaacagaagccaccatattctctatcaagggctagaaattacaacgttatcaaataaaaggagaaatatcgtcactgttcatcaggatgagctcagattataatggtgaagatttattggatatattttagagctttctttactatacctgtatgaaagttacaattgtgtttctagaaataaacctaagagttatatagcaaatgcatttctactttcaatagactataatctagccctgcaaattgcatgaagaatccggctatctctttattacaagagatactgcacacttttgtgtggttagttcttatatccagctattagattggcagtaagcagaaaaataattcaacagactacctgaattcgtttgctcttgactctctttgtgctgacaactatcattatcttagcaaaatatagtaaaaaattgaacttgtcaaaataattggtcataaatggtgtgcgtgaatttacttatcatcagctatcactgatatcgtaaacaagtatgagagagcacttttttgtttttgcttcattatttatggactttgttgttctggttgtgttgatagttccttttttacacactgttttattaagtattatccacacaagttacaactgccctttttctttttttccttttttgtttaacaatggaccaa

SEQ ID NO: 44536 - DNA, 1501 bp, Oryza sativa; identical to SEQ ID NO: 41674

SEQ ID NO: 44537 - DNA, 1501 bp, Oryza sativa
ttcacaattccactatatataagaaggatctatataaatatatagcaaatcttatttacctatactgtaatatgaacaaaactatgaataattctataatacagcaccccttcaattaataaaggagtacattttcataaaacagcactacatttgctaaagctatcgcaaactgcaatcttgagaaaaaaattcataacaggcctcatttatttattaaaaaaaggattcacaaaattacattttaagcattatcattgtattctatcgacaccagctgttagtctcacaaacctagccaaattcacaatggaacatatatgctagtaactatcaagcggggccaagtacattgagtatgatggaaataactaaagttcagttttgtcaaatgtttcgaaagatcaaatgttgtgaaacaatcacttgaaaatgtgattttgtgatggttttaccaaaggtagtagggctttcagaaatttaatctcaataaaattaaacaatcatgatatgcatgcatccataggaatgtatggaaatactgaaattagcacatggaaactatactaataggtagatactttgatagttgaaagtatttaggtatattgtctggtcacactgacgtttaatgcaaactggaagaagtgtaaaaagttgacagtaggtgtatcatggtcatcaatgcacaaatatatgggattagcaccctagagagagcaggatattatgtactagaagtctggttcattccttcactgaattttataacaactcctcaatagaaaaagaacagttgatagtctacccaaaacctcaagcatgcaaagctgaccacatgaaatcaaaactgacccaaatagtttgatattgatatataatgtcaacatgcttgcagttgatccaggaacaactcaaataaattcagacagacaaagtacagcgcacagcagaaatataagaatttttcaccaatgatatgcataaactggggtcaatattataccattcaagaatgcattggaggtggaactcgtgtttgcaaccagtcaactacataacaaagaaacacagtaaaatggttaaaagaatgtcatatatgagaaaaaacatacaattgaagataaggcatcttactgtggaagggtcactctcacagaacgcctcaaggcagatactacatgcatcatcacatgcatcctgaatcccaccctcaacaaaggctgcagctgatgtcaaaccctccatcttggctttctcatcagttccagatgccattgcaacggaatcacaacactgatatctagaatatggagaaaagaagggcttagaatataaacacttcaattgaccaaagtctcaaaatggcttcacgatggaaagcaaacacatcagttattcacagctgaggccaaaatgatcccatgaaaacaaatatagtatacacttaaacaaacatgttatattgttgaaaaaaagagcctgtaaacaatggcacagg

SEQ ID NO: 44538 - DNA, 1501 bp, Oryza sativa
tgatgaaccatcattagttcaaattcaaatactcctagcattatgtttcaaatgattagtcccatttaggcccgttcgaatcctctataaatgaaggataaactttgattttcgtggtacgcttttcaaacggttaaacggtgtgtttcgtgcgaaaactttctatataaaagttgttctaaaatatcagattaatccatttttcaagtttgtaataattaaaaattaattaatcacacattattactacctcgttttacgtgaaacacttgatattcatctttatgggtctgtttggttcacagcccaaaccagccatcaagttgtggcgtcgccagagattgtggcgagagaaataatcgccacagctgtggcggaaataagcatgcaaatgaactagcaaaaagtgtggctgccacaactcacgtattaatcaaacatcagtcaaactgttgtggcagccgcatgtttggcgaggcaatgtgtggcggggatccaaacaccccctatatcttcagaaattcaaacaccaccttataagcaactttgagtgtaaaaacaaagaaaataaaaggagagctttaaccccctcctctctgccttttcccacgagtggagtgaagcggaggagaaggaagcatcgcatccgcctccgatccggcgatggcgagggcgccgccgccgctgtcgtcgttgccgccgccgccgcgccggcccacggtggtgctgcttctggggctggccctcgccttctgcctcgccgtcctctccatccagtcctcattcttcaccgctccgagtgagagcgctctcccgaaaacctagctttcgttccccttcgttgtgtgggattgatggggagggatggattctcttgcagggctggcgagtaggctggatctggactccgacgaggtccgcgcgctctcgggcttccagtcccgcgtccagcagtgcgtggtgcgtgaccccggcttgctctgtgctctcttgaattcaaataattgtcctgccatggaagccttgattgtttttaactaagcacatttctgctttgaagagatcaatttgagttcacagtaattgtggattgtgtcatagtgaagggcaggggcagtgaattagctactagtgttatactgttatggtctacccgtgtgtcgtgtccgctgaaacaaccatgaattgttcatccatgcatggtgtctttgcaatcagtcaatcgtgggatcacattattcatcaaattgctggttcttatttgttacgtttagttcttgtttgttatgcatgaatttggtcggagaaaggatgcgatttataggacaccattccataatgaacaatgaggcaatctgcaaaatggtcatctagaatctatgtgaaactcagtttcagttttagaccttctcaagtattataagttacagatttgcagcattttcctttgatcagcagtagaagtttcatttacatgttctttactctcttgcttcttttc

SEQ ID NO: 44539 - DNA, 365 bp, Oryza sativa
attcctgcagccccaattgggaatttctttctttcaaaagggggagaagttttcttttggatttttagcacgatgtgtacgtttgtacgaagtgtgctttttaccacttttgtttttatttttccaaacaccaaaacattttaatgggtttgccaatgtgttcatcaagggggagattgtaaaatcaaaggtgtttttgattattattttgtgatgaacaattgggcatcggagattattggttttgttatttggaatttattcacgaagtggttttggagatgaatggatttcacagatgattgcaggattcgtcattttatgtgaccggtcagaccgggctctggtagccggtcagaccggcg

SEQ ID NO: 44540 - DNA, 180 bp, Oryza sativa
ttctcaacttttaggatagtcaggactatcagacagtttttttttttcgtttttccagtttgtggtagctactatctcatttctattaatggaaacggaagggctctcgccctttgatcttaaaaaaaagaactgagtggttataatggagtttgtcaactctggtgccaactctcaaaa

SEQ ID NO: 44541 - DNA, 1501 bp, Oryza sativa
gcatccgctcgccggatcgcgggagcccaaccggtggtatatccacgctgattccccgcgcgctgctcgctcgggcacccaccagccacacgatggcccccaagcctccctcgaatcagacccgcgtcgcgccgtgccgtgcgcgtcacatggcgccgcgcgtggcgtggtcctcctccagcccgaagcggacaaaacgccaataagagaggcgggcgcggccgtgcgcacggcgccgaaaccacacgcagctttcctcgactattcctcctcccgctccgctctcacatatcgcaacaactagacacgtagcttcgtcttcccgtctccccacggttgccggagccggagtacgcgtataagtagagccccaacgccgcgcggttagccaacgaagcaaccagtcaagtactactactcaactgagcttttctttggagtgtgtgtgcgaagctagtgaattcactcagctagctcggagaggcagagaggaacagactaatcattaatcaatggcgggcctggttggagtttggctgggggagttcgccaagatgggccggggggcggcaccggcggccgacgccggggtcggccagcgagctcagagcgaaggggagagctgcaagagtaaggttggtgatggtgttgtgcaggagatcacgacgaggacgagggacagcagcatcctcctctccgactccgaggccaccgtgtgcatgctcatggaccgcttcgcccctgcctgacgccgctcactggccgctgggctttcgccggtaaaatggattgatggaagcgtgtaccgtgtatatagtagatatactctctgtatataaccactttgccttgctattttgcatcaattgtatcatatgggttgtaatccttcaaatttggagtcgattcattggttaatatatgcagcactagtgctggttctgataactttttgtctgatgtcccatctgatttctcaactggcttgctattgccgtgagcccgtgactactctttactctttcttttcttctttcttttttggcggggactactctttacttgaaccttgaacgtttgcccttgtcaaccaattctcagtggcttctgtatgtaaatcttgttggaaagaaagtattaggatcttctttgaatttttgtttgaatgatctaatcctgggcatgatgagtaacgtgctatccaagaagctctgtaatcaagtagctggcctgagtatccaagaaacgaagagcttatagggtgggttgtgtccatggagtaactattatcaaggttcacgtaaaccgttcagtaataactgtccggtttaccaaacgacctgcactgcaccgattggatacgtctgattttaattaatgggccaggaagtccaggctacctccaatccggcccatttaactcccaaagcccgcaactaaaatcacggcccaatttgagcccacaacgaaatcgaattctctccgtctccactctcctcta

SEQ ID NO: 44542 - DNA, 1501 bp, Oryza sativa
ccgattgtgcgtgttgaactagcccgtgtgttgtgtgcatgctggcatgctgccacactcaaatagtcataggactggagatggacacttcaacgtactaacaggttacaaggggtgtgtttagttcacgtcaaaattgaaagttaagttaaaattagaacgatgtgataaaaaagttgaaagtttatgtgtagaaaagttttgatgcgatgaaaaagttaaaagtttgaagaaaaaatttagaactaaactcggcgaaggataaccaaagttgtcgcgccagcatttgtacggtcctgaggaccaccaccattcctgtgcgtaagtaaattatactacgtagtactgaataccgatccattatgtaaaagcaggtttaatagtatagctaactactagctccaaatcatctataatcaatgtaatagctaattcatacaatagttgcttactatactattaatacctggtcctgcctgtcatacacacattacgtcttggagtccgtgttgcagcgggctacagatctgtagcccgctgctcttatctctctttttttatctctttacaatatgtttacagttggcttatagcctgctattgtaactgctctaaaatactccacccgtcaacctgaccgacctagctatatgaccctgacccaataaagaggccaaaagatggcttattggggaaataagctaaacgacttaattacaaacaaaaaataatttacaaataaaacttttatatacgtattattaatgatataaatgcaaatactgaaaaataaattttgatgaaaaaaattcttaaaatcaatttcaaatttaaggttgaaaatttaaattttagctgataagcataagcgaaaaaaaggcaagaaaaccccagataatcaaccttgagtaaaatagaagcgggctaacaactatcctgacagtactgagtataaaacagatgcacatgcattcttacctccacaatagtttttgctcggaatctttatggacttgcaaatttcctgtgggcatggagttcgcaatctttcatctggctcggcggcttgacgatcagcacatccacaaaactgcacccggcccaactccctcagctatgcaaaagggataagacatgaagaatacacttcctagtcacagatgcatacagagcttaaaaaagatgcaatcattctttaccttagttgcctgaggcgatccaaaatgggcaggcaaatgggcatcaccttcgcgattgccttgccaacagtgtatctttttggtagctactttcccataaagcggtgcgcactagcacaacactgattcttccaccacatcaaaatcaatcgaaccaaaatgcaaaacggcagttgctcccggatggaaacaccccttggagcttggaattccacaatctgcttattgcacatggcaagctacagcctacagaacgccaccaactgaattgacatatatctaacgttttgttaacacagtta

SEQ ID NO: 44543 - DNA, 1501 bp, Oryza sativa
tttaagtactctttgagatttataaagttaaaaccgaaaatatgtggcaaataggtaaaatcaacatactgtaataattggggaccgttgctgtatgaaggccagcctatgggatggagattcataagctgtaaagagaaaagagacagaaggtgacaaagtaagtagacattatatttcaattattattcacacactaagtagtgccattgctgaagaacaatatgcgtggctgaatcttaaggtattttttttaatttcttgtgccgattattctcttagacctgaacaaggcatttcatcaagtagctggtgtgcagaggaggaattgttcatgccggactataacacatttcatcgaacagttggtgtgcataatagaaggatttaaagtacgaacacacccaatcaccagttcaccacccctaacacaatccaatccatcaagcgtcctgctagcatagcacagcagagcaaaggacagagcacccaaccttccagcgcgagcgcgagatcaccgacggcgtcggggccgaaggcgtcgttgccggcgcagggcagcacggacggctcgtcgaggtacgccacccgcctcgcgcgcgacgaagacaccagcaggtcgacggcgagctgccccacgttgccgatcgagagcgccggctgcagccccccaaaaaaaggatcaccaacccgcgtcatgagccatggaggcaaagctattcaaaccggagagaggagagaggtttagggcgacccggaccatgaggagggtggagcagtcgggcgagaaggactccccctcaacgacggcgtgctccatcgcggcggcggcggcgctggatcccttcaaaacttgggcgagaagttgaagggctcgagtgggctagctatggaggcaggcagcggatgggagaaagacgagaagaaatacgccgcttttgttgcgtagaggagagtggagacggagagaattcgatttcgttgtgggctcaaattgggccgtgattttagttgcgggctttgggagttaaatgggccggattggaggtagcctggacttcctggcccattaattaaaatcagacgtatccaatcggtgcagtgcaggtcgtttggtaaaccggacagttattactgaacggtttacgtgaaccttgataatagttactccatggacacaacccaccctataagctcttcgtttcttggatactcaggccagctacttgattacagagcttcttggatagcacgttactcatcatgcccaggattagatcattcaaacaaaaattcaaagaagatcctaatactttctttccaacaagatttacatacagaagccactgagaattggttgacaagggcaaacgttcaaggttcaagtaaagagtagtccccgccaaaaaagaaagaagaaaagaaagagtaaagagtagtcacgggctcacggcaatagcaagccagttgagaaatcagatgggacatcagacaaaaagtt

SEQ ID NO: 44544 - DNA, 598 bp, Oryza sativa
caaattaaacatggtagggactagatcaagaatcctagccaaccagagctacgcattgtgtgccgcagagatgaccgggtagcttttgatctgaaggcagagagagaggggtctctgcagggtgtgcaggaccagcgagggtgtaaaatgtgctgacagacacctctcttttggatgtgcacatattcagcaaagcagaggtataatgcccccaagagagccctcttgggatctttccgtattcatgaaaggaagaggggtatgtgacgatggaagacgctagctgcaggccgaaatgaatgtggcggaatgcgacaacacgatatgggtggcactgctgctagagagagtgtgacatgatagtgatatatccatcaggacaacatccatgcaggcagcatcgatctcaagcggtggtcaggtcgatcagaaattgatcgagcagcaaatttgtaaaaatctgcaaattttacacgctgtttaattatgattagatttgcttatacaatactgaattgctgttaccgatctgatcactagctagctagcataaggtaaacagtaattaacttatgtacgtacgtacgagcagtacata

SEQ ID NO: 44545 - DNA, 423 bp, Oryza sativa
ggatttcaagatcgcaggtatcgatccgccgtccattctcgcagagttgcatcactgaccgtcggatcgtctattccgcccatttcatttgcctcctatactttccgaagtctcaaaccccctccctcccctcccttctcccgccgccgccgccgccgccgccgccgagcatgccgagcgccttccactccctcctcctccccgccattcgcaaccccaaacctagccgtcgccgcggccgcggccgcggcggcagcaaacgccccaagaagaccaccaaatccaagaaccgcctcgccgacgccgccgccggagacgccaccgccttccacctgaagacctccgcgcgcgccggtccggggggtgccgggagcggccggcgaggcgatgggggatgcctcgtgcagccgctcggcaacctcc

SEQ ID NO: 44546 - DNA, 1501 bp, Oryza sativa
actggagtgatgaaacagaaactgcagtggtaggagataattgtcgtcttcatcttttccccctctttctctctctccattttcacccttttttagcttttcttcactgactgttaacattagtaatatgcacgtgctaaacgctatgttgcaactcctatttatctttaataattttaaaatttttcgtggtagcaaaaaaatattattatatgaactgtgcatttgagctttaatttaatttatctcatacatcaaatatttcacatatagtataataatatgatatactaattcatgcaaatatataatacatataatccgagggcttcacgcgcttccctgtcatagcgatttgtgtccatacgtacctaatgtaataatatgattgaaaatctccatttagtcagcaataatgctcgggagtaaaattatttacacgatatgaaccatgtcagttatgttccaaaaacaccgtaatctactataaaatccataccatgcagtaaagtactattattatttttattagatacaaaatacattcgataaaaaattgtagagcagcaagcaatagaaaacgtgatccttagcacgccaacgagggatgtaactctacgtcatatcgtagttctatttggctattctttcattgcttactaaacattaaacattatccatgcccatttggagatcaacaagcaacatatattcttacatagtactaaataattgtatttgcacagtcaatcatgccatgtaaaagccaacaagatggtaaaatcacccaaatccacatcacatacttcataggatcaaacatatatcgcatacaactcttttaatgatgtttatatagtctggtagtgcagccggaaaagtttactttgcatatgaaatttatgtcaccaagtaataaataggcatgtattcaaacaacgttgtattaaaatacaagtgtgtttgaggatacaataatacacatctccatcattgtacatggtataaaataaatataaaaaaacctcaaagttgaaagagcacgtagaaaatggacacaaaaatcactctgatcatccaatgctaccggcaatacaaaattttgtgtaaaatttgtcatttaaattatcctaatcattactctgacaaaacaaagatgttatgtctaatctatatcttgaatcagtataactccagagttcctatttcgcgcagatatttaactatttgtcacttttagatgtggcaaataactatttgccactggactcacatgtcatagacacatgtagacccacacgtcattgagataggggtgacaaatagttaaatgccaaatctaaaaatggcaaatagttaaatccctaccacaccttacgctaggcgagcttgggaatcagattccattgctcccgctgttttccccaccgcatcgccacctccccattttcttcgctgcattgcctcctccaacgccacgcaacccgctcctctttccagc

SEQ ID NO: 44547 - DNA, 1501 bp, Oryza sativa
agagtttggctgatcagaccagttcaacagagtgatggtttcgatcaaacgaggatgggccgaacggttcgatcagatttggctggttagacccaggggcaaagccggtcggattgatacgtggggcgagtagactggtggcaacaggctagtcagatcgcatatgaaattatctggcggaacataatatatctgggactcgatgaaaggttgagatatatggagttggtccagaattgaagaaaaggtcttgggcaacagcgggtgaaaatcgttgagggcgtcaacggcctgtttagcagtacatgatatatctagaatctgcggggtttgcatgatggggatatatgaaaatctacgtcactaaaaaggaagagcgaaggttgtcattgtaattctttaagagattcgaggcaacagtgaacttctcaatttatcatggagctcagtctaaggatgcggaaaaagcgtggatggatttattagctcagttcataaaactaaaagaaagaaagggtttctttatcagtctggtgagtttgatttgtctatttggtgatgacgggggttgtttggctatggattatgtcaagtcaaatttaagatggtagatggagttgaatatggtctttgagaagtctatgatgtgacagctaggaaaggtctaatttcgcttggcaagacggctgtgatgataggagagaatgtgaagcactgttgcaggtggagtccatctaaacaaattgcagggatagcggagtctgttgaaagcggtgggtctggcacagactcgtcgagcggctcatggtgaagctgcgaaaaagaagacaacccaagtctggaggaccggtggatcggcatggtgattctactacttctaggtgacgtatattcgccaaggtagaataggtgtcgaatatactagttctatttggttacggttggacttggagttataataggtggtaggggatggagttagagtcggactctataacccagaatctctcttaaataatgagggggcactacaatgtaatcatggagactacaatgtagcgtagacacgcagggagaggatggtggcaaggccatggactcgtagcggctaggtgctatattgattggggaggagggcccataatcagagctctggggatgtaggctttggctgaaccccgttaacaaatatggtgtgttactgtgtcgtcgtagacatgttttgggtgattaatgactgaagtgatcggaaaggttagtcgccgttccgctatatcgactaacttttatagcatagaccgcgaagattctactctaccaaatgaccttctcacaatcacaaaaatcatcatcagttgcgtcaacacacaacacaagtacacacacaaccgttctgtagccgcaggggagggcaaagcagccgcgacccgcgagcagctgttgcttgagccgaaccaaaaccaaaccggacatgaagcgggccgtctccagcatccgcagc

SEQ ID NO: 44548 - DNA, 275 bp, Oryza sativa
cccccccccggcgcgcgtccagccccccagatgaacaaacaacagcaaaccaagcgcgacgcgagacggaaatggggcggagagagtagcgcgtaacccgcaagctccacgccaccaccaccctccccgaatccaatccaagccctagcgccaaccgccgccgacgaggacgccaaatccctcgatctcctcctcctcctccgccttccgcccccccaaaaccctagccccggcgggaggaggcggcggcggcggcgggggtgcagatcttagga

SEQ ID NO: 44549 - DNA, 1501 bp, Oryza sativa
tgactgtgtatggcagagactggatctagaagaagttgggattccatcacttgacttggttggaagctgctacaaccgaagagtggttttcacggcatgctctagccatgtctgtgatcaaatgaatgtggaagtggagaacagaattgaggttcactgtcttgatcatacagaatcatgggaaattttcaagcagaatgctgatcttgattacttgggccataagcatgtgtacctgccaagaaatatttccgcggaattgcttggttcacctttggagctggtaacaattggaaaggccatgcacaataagaaggatgcaatatattggcaaaatgcccttcattatctgactgaatcatgccttcgtgacactcaatggtcaggtagtgaagaggcaacatttttcagattaaaacttgcgtatgacagcttgacaggaattctgaaagattgctttaagttgtgttctttatggccagagggccatatatttaatcaacggaaattagtagacttctggatagggtcaggattaatacaaggggatgacattgaagcgtcttacaacgaaggtttctctcatattaccaccttgcaagaattttgccttttagagccagcagaagatggagaggcagtgcaaatgcaatctacaatccgtgattttgccttatgggttgtacacagtcaaggcgaggacaagaacaaatggagaatccaaaccaaagagaattggggattggcagagcaagttctattagtggggcttaaaattacagaactgcctcgtattcctagcaatcaaaaaacccttgaagtcttgatactccagcacaattatttggaagacggttctttcgggaacttcccctcgttgctttcactgcagtacctagatctctcttttaataaattgtccaatatacctgtagagatttgcatgcaggtcaacctaagatatctgaatttgtcaaataacagaataaaaacggtaccagtggagttaggctgtcttaccagactgaggcacttgcatcttcggaataatccaaatctagttattccaaatggtatactaccaaaactccagaatttggaggtgctggatgtttgctcatttaatttactgcagtgctcatcctatgaggcgccaattaatgagcttgtgcgtatggataaattgcagtcccttggaattactgttcgttcagaaacctcgtttcaagggattagtaagacaaccttaccaatacggtccctctctattgtcatttataaccatgaagatgggtatgagactcatgtatcttctgaaaattcttgtatcaatcctgaaagacaaacaaacctgtttgaacttggtatttacacaagacaaaagactattgtgcttgacagcattcattcaatgtggaatgttcagcatgttgagaaagcatacctccatggttatttcgttgataggatcatatgccagaagctgcacactggagatatt

SEQ ID NO: 44550 - DNA, 1501 bp, Oryza sativa
cataattcatttggtactttgcaaatatagtgagcataaaattgttgccaagaaacatgccaatcatcgaagtatgggtgaccgtattgagaatggattagaatagatcgtaggtgttgtggattgtagtgaagagtgtgatgaccgtattgagaatggataagaatagattgtaggtgttgtggatcgtaatgaagagtgggagctagtgcatgcttatatgatacttccttctcctttggttgattgccatgtgcatgtttctatgtgatcaatccttctcctttgattgattgccatatgcatgtttctatgtgatcaatccttacgtgaatagtaggcaccagatgttgtaaaatgtactgatggtagatatttagatattagtaggagatcaatttttgtaggcaccttcccaaactctcacgagaaatgcactccatagaattttagatatcaaattttttttttgcacttttagtttgttggaagctaactatatttatactatcaatctaaccatgaaaccatgctcgatattgaaggaggataattttggagagttataccgactagtttagatgtgaagagtaaaatagatatttggacaatagtaatacatgcatgtcacactcacaccaccatatgtacataggcaccaaaataaaaaaatacttagattcataaaacacatgcctgctagtttagtttctagtagctcttaggaaaaacttgcattcacattatatgccattatagcataacagatgtaaccgtggtacgaggaaatgaagaatctaggttcatgcatagtcggacgcatgtattgataatatcatcacaatgcattttgaagtgtgtcttgtaatagaatggggtgtcaattgtccttccatcatccattatcattgccgacatcaccatttctatgaacacaatcggttagtataaaattaatcaaggattcgaaagagaataaaatactaatatatagaactcatgtggttacctgatgatagcaacataaggacaagactaaatattactattataatgcacgtcctcgtccttgtcatatcttgaaactgcatgttgtttatgttaagaatattgatgtcttatgtttcagattgatgatgcctactgattgatgtttcagattgatgatgcctacatatggacaagactaaatattactataatgatgcacatcctcatccttgtcatatcttaaaactgcctgttgtttatgtcaagaatattgatgtcttatgtttcagattgatgacttgccaaggaaataaactaaaataaagatgataacatgtaaatatgtgcatctcatcaatcattttaaggaacaataaatgtgcagtaatagaaaaatacaatttattagtttcttaattagaaatataattgcatttgtagatattaaaataaatgtatatctcaatatttgaaaatatgattgatctaaggaaaatactcgggaattaaa

SEQ ID NO: 44551 - DNA, 1501 bp, Oryza sativa
aatctggtttatattaaaacaaatcaattcccacgtgcttgatgaattaactgaaattcagattatatgcatcgtgattatctggcatattttatctcatattacctcctactactaattaattgattgaattttttaataagcaaagcattttgcaccaagcataatcatatccaaaccttcctcagcaatacgcagtaagcacgacgatgattgaatttttagttagcaggaaacgtctctctcttttctatctctagcctgattttctactagcaggaaatgattcttcccttcggcagtaaggttcgggtacatacctctacgcacggaaaacataatggctcattagagcatgtttcttccgtttcatattaaacctctttatatttgactattttatagaataatttaaatctataacacaaaattagtttcattaaatatatcttgataatatgttttctgttggaaatgttgttatatttttaaaaacattgaaatggatggagtaataaattaactattagcttaaataaacttaaaaagtagaatgaatactgttttttaaagtaattttcctatatatctttttataaaaaaatcacttatcagctcggaaagtacctaatacagagtttatgtaggccggccaggaactctttgttgcctggcatcgaattcgttcggttcgtgggactaataaatattttatctgttttatatcatataagtcatttgattttttttccgagtttgatcaaatctctacttattataaaaattaaagatatttttaccaatattttgatacgtcatccgtgtttgagtcggtttttaaggatattcgtttttgaaaatacatatttgtgtttgagttggattttaagctcatttgcttttgtaaacacaaaagaattcatataagaaatctcttttaacaaactccgcatgctaacttgaatgaatgtcggactcgctaattttccaaaagaaaaatccaagcaaattcccacaataaatttaccataactaaaccatataacaataataatattaaaatagcattcacctgttgcaacgcaacatttttctagtttatataaaaatttagcaacatctaaaatattaaattaattttattaaacctagcattgaatatattttaataatatatttatgttgtgttgaaaatactactcccttcatcccaaaatataagaacgtatgattgaatacgacatttctagtacaaattagataggcaggttatccaaattcatagtgctaagttaatgttacatctagtactaagtccttatattttaagacaagagtataatatttttccgtaagcccattattttctaaaaaaaagaaaagtaacacctagtttactagtattaacgaaaagatggaattacaggtttatagaatcatgcagttttaatgtgtcaccctacggcagatttgggagatgaatgcaacaagatatcaaaag

SEQ ID NO: 44552 - DNA, 1501 bp, Oryza sativa
ccatcagcgcaatgcaatagatagtatgtaggtaatttagttcttaggggcgatatcaatggtaaaggctcgtagcatagattatttaattttctttttctttatgatgtgccttttttgattgatacggtcttgtttgaatatggagtgagtaacaatttttaagtttttgtgagaagcttcttaaaacatatatcgtcacatttggttgtttgttttacattactaaatagcgtagtagcattagtacgagcatatcactagtgataatggtttttttaatatggcatccctgtaaaaaaaatacaataagaccatatatgtaatagctactgtcggtgacatgggaccgggagtatcatgacttagagacttgaggcagacacgatcacccacgtggcctaaccccctcgggggggtcgggcccgagggtgatatggccgcccttctctttgtctccccgaggggtcggaccgctaccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgacgggtcacagaccggtcagatcgtgggttaggtggcgacaggcggtttgacgcacgcctcgccccatcccgtcaggacgagagcctccaagcactcgtccctagccggaaccggcgtgttagctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagccatgttcccacgtcgcgcctgcttccggtggaagtggaggtaggtatgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggattgaaggggggaaaaacaatcccagaacgatcgggggctggctcgcgctttgtagcttcttcatacacagatccaccaaaacacaggagtagggtattacgcttctcagcggcccgaacctgtatacatcgcccgtgtcttgtgtgatttcactctcgcgaactttccacagaacaagagcttagaacctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagcttttcctgttcagcccaa

SEQ ID NO: 44553 - DNA, 1501 bp, Oryza sativa
tcaataactcagcttactggatgcttatattttatattctgcaatgtaaagagtagatagcatacttgagaatcattggtcgtcactgcattataattgtacatcatatatcctaggaaatattggatcaattgcaaggacatgtgtgcagcgtgagcagttggtgtgcatcttatcggggttaaggttagtgtttattgaaaaatacattgaattatgtttcttccttttctttgttatgttattcatctggtactacatgtgaacggcaaatttactttgtaagcattttcagccattgggtttaaaggtagacaacacaaagctctgtgtgctgtattgggttattgggcatatcctatggttttatgccagatatgccaaatttccctcttctgtgcattaatatagttaccaaatatgcatgaattttgaaccactgtttttttctctacatcaggatggagaaaaatggttatataagcaactaagcaatgtatttttggtagtgaagtgtacataatggatacagcatcacttgttatcctgatatatttatttaagatggttttcttgcatgtttggtagtgcaaatggacaccatcaaattgccaatttgccatgatcttggtgcgtgtatggaatcaagtagaatggtagtctcctgcaattgctccacgatgactgaatccacgcggaaggctgtccatttttggcagttcagacttagagagaggttagcattggcctattctttggataggtttaggtcatttatgtgttgagtaaaatttggctaagaagctacggcatatctgttttacgaatggaaaaaatgtagctattttttcatgtgtccttgttgcttgattggtcaggcaagttgccaagttattgctccgtattgcaaattcatcttggtaccatattaactttgacaatctgctttttttggtgtatcaataaatcaagtaaataatgatgcaatgaactcttctgatggacaagcaacagaaaatttacttgataactatattgtttggacgtatgttctggccaataatcttgattccttcttatatcagtccatccttatccttgacgccttatcagtacactgtaatgctcatactgattgtgctggctgagacctaggcgggggccaaggccttcatttaggtcagtacacaccgcctcaggaggtttattccttgtccggtacatatggttgggatgttggatccatttcatttatttctgcaggatgagattgtgaacaatggattatctgttattaggcttgggatgctggtctgatgcaaattactgtagattattcaagtcaaagttactatagtttttttttactgttggagttctgtttcagtgccaaatattcgctgagcatgatgttgtgttgcagtggtgccctaattgcgatttcaatgggatgttctagacagatgtgtggagtggggtggaggagaagcgtagtcgatga

SEQ ID NO: 44554 - DNA, 1501 bp, Oryza sativa
gtccgcatttgctagtacttaacaaattttggttcttgtgaatttgctcattcaggatgaaacgcagcaaagggaaatttgcacctagggttcagacctctgaaaattccttggcacacagaaaggggataactttgtaagttcttttcaacagatatatacttctgattttctgaaaccttcattgcattattgcaatgtggatgctgcttgttgatcgtatactatttttaattcatgcagctgcaccaactgtggtgaaagcagcgacgccacacccatgatgcgccatgctcccaatggaaccaaatcattttgcaatgcttgtgggttgatgtgggcgaactcggttagtgtccacatattccattccttccccttatatatcttgaaattttttttgttgaagcaaatgtttgcttgaatgtttatatgggttactgaattttctaccttcacctgcagagaaaaataagaaagatcagaaacccaacttccggggagcaagaagatcaataatactcaggatcgtttcatttcatcgatggcattcttctttgattcgagtgcattccaatcgaagtttagatgaaacagaatatagaacaacgctgatagcagctatagagacgggagagactgagagagctttgttcttgtagtttacctccggtgtgctaggcaccaagtcaatgatagtgagtagtgatgtcgtaatttgaattttgtagaggataatttaatctttgtaattgaccctgaaacctctgaatattctggatttttttaaaaagaaaaaactggctgttttcgtagcagtgacgtagaaatagtcatgcgatgcacttactatgcgggttaagtgtatttgtggtggtgtatatgcgtgtgtgttcaatgcaatgttataaaggaaaaaaataacctatcagctatggatatgtgcatgctcatccatccatgaatcccactgagcttccactgcccaagggcctgtttgtttcagctacaacataccaattttaaattttagaactaattttagttttttgtttgtcgtttttagtaactttgcttttgcttttgaattgctaaggatagaaatggaaagtcctattaaaaatattattctatatcaatcacatatcttcggaatttagagacagtcacacaaattttcttcagttttaactagaggtttagtcataggattgattcctagataagttgtatctgcttttgagctggtgttgtttaagactattttctcatcattctcctagaaacctatagacttggttcagacaagacttttgcaaggggttgtagctccctgacatgtgagttcttacctcctaaatcaacgagtcaactacggtcaacctgacacgtcagtaaaaaccgcttcccaaaccatcgaaggagtctatttgcactgtttttaagataagaaagacgttatacccggttttgtggttgaggtaggcgattcaaacagtag

SEQ ID NO: 44555 - DNA, 1501 bp, Oryza sativa
gtcctctacgtgtacatgtcctccaaagtcgcagccgaccatccaatctccggcgaggtcgccatcttggtccggctattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagcctttttcttcgttttgcgtgttagcttgtcgtttccgtcgttgcggaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgggctttatatattggttcagctagatattagttatgattgcttagccatgcttagaaacattagcacactattgggataacttatgactcactattatttaatgatggcttaatgatagttcacgatggtcaatcgtgattggttaattaattacttgccaactaaatcttgataatggtgggttgtgagcacatggttttgagagtcgtgctcatggcaattaaggaccggttcgcgagctactgttgtgaaacattaaccgtgccaaccacaagccagcgtgggcaacggctttacctttcgtatagcatggttcattgcagagcaccagactgagaagtggcggagataagcccacgggggtcgctggggagtccatgcctctggtttttgagggggtgattatgatccaggaacggtgcactgtggtgggttgtgttatgcaaggggtaatgtcacagctcctttccgaggtaccgtggtggtactgaggcacattgtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtatgttgttcagtgttgattaaaatttctgattaattactccactgttttacttctcttaaatgttttgctaaatgctgtttttgcaaatgagcctatattatgccatcctttggtatccttgtgcacttgcatatttgctgtgtggcttgttgagtatgtcatatgctaattctttcaataatcaatcaacctca

SEQ ID NO: 44556 - DNA, 1501 bp, Oryza sativa
cgagccagaccatcctgccgggcacggaggacgccatcgtggggcacctccgcgaggtgggtctcaccttccacctgcccaaggacgtcccggagttcatatccgacagtgtcgagggcgcgctcaccgacgccttcatgccgctcggcgtccacgactggaactccatcttctgggtggtgcacccgggcggtccggccatcctcgaccaggttgaggagaaggtcgccctccacaaggcccgcatgcgcgcctcccgcaacgtcctctccgagtacggcaacatggccagcgccaccgtcctcttcgtcctcgacgagatgcgcaagctctctgccgacgacggccacgccaccaccggcgagggcatggactggggcgtcctcttcggcttcggtcctggcctcaccgtcgagactatcgttctccacagcgtccccatcaccgccgccgcccctcttattatgcagtaatactacttaatggtacaacttctggcgtaaactttactacactactttgtttaattattttaattgtttcgtgtcatcgttcctgttcacgtcgatcaggcttcaatttctacatcagtgtgtgtttcagtgtttgtaactgttgtgacctagcggccgtacgcgtgatcgatcctgggatggcacgatttcttgtgaactctcgggcggctttaaagtacacgttatgtcatatatatgcatgtaattggccccttgtttgcccattaataagtggagaatgataaacaccagaaaacggcgcagcaagcaagatcgcagccaaaaaaatgtctcagccttatttgtcttgtgttcgttcttccatgccgtggagttcataccaaaccattaatggtgtacgtattttcttcttcacaaatactaattaacggtcgtctatttttggtcttggtttcaaaagaaactacaatcaattattacacagcgattataggtcgaatatggttacaaaattataaaatcacaactcgaatagaaacaacaaaactaccacttacactaccagtactcaaccagcctaaagacaacaataagaaccctcatccatagagctggtttagttcccaaaacaaaaatttttacagtgtcatatcgattgtttggacatatgcatggagtattaaatataggcaaaaatcccaattacacagattgcgtgtaaattacgaggcgaatcttttaagcataattgcgccatgatttgacaatgtggtgctacaataaacatttactaatgacggattaattaggcttaataaatttatctcgtagttttctgacggaatctgtaatttattttgttattagattacgtttaatacttcaaatgtgcactggtggagaaagcgtttgtagtcccggttcgtaacccccctttagtcccggttttcaaaccgggactaccaatccgggactaaagtcgagctgaccttttttttttcatggccctgttgctgcatggttta

SEQ ID NO: 44557 - DNA, 1501 bp, Oryza sativa
agcaacagagagatgtagtatggagaagttaaactcgaacagggaaaagcagcaacaagttttggccatttgggtgccgtggcctctattcctttctaccggtgctgtttggatgcagaagtgcacttgatttcattgttcatgatgacaaatttttcatgattttccaccatgctttggggcaatggtgcgtgctattgaatttccttaagttgggtgtgaatgcccccttagggtagatgttgcttcatttttagagcaaagtttcggtacataagattttggtaggggggcatatgtatacagggtatagttctgactcatatcgacttcttgtctttgtgtggatgtaacaatggaaaacatcataccaatcttgctgtatggctcaattttatcttcctttcgcagaaaaaattaaccagaattactgccgcagttagtgcggcgctgggttccgtgatagtaatagctgatgtaagcgtggatatgatgtaattcaccagaaatatgaaatatcccgatttccttcgagaaacaaatatgaaatatcattgaaatgtggtacttcttttttcctgctgcttcggaaatgagtatattttgatcttcggatggttgtctcgttgatttaccttcacatgtggaattagacaattagtgttagatttggtctaagatctgctatcctggaggaaaaagattttgaattggagttttaaacactactacattctcaacccgttattgtcgtacggagtatttctctgtaaaatcgttctcaaactgtcgactgtagggttgtacatttcgtattcaattttccgtcaatggagaactacatgaggccgtacatatgctcatcccagtgaattggttagattcagcgggtcaatccgtacttctggtagacacagccgtataaattttcgtcgtcaccacaatttcttttttccttttttttaagaaacatcgtataaatgcttgtcaaacatgtgccctgagattgggtcggtatattcggtatattttgagattactttaccacaaatatcttgttataagtgaatatatcataaatggattattgtccctcgagaggtcgagggacgtcccctcgttttgtgcatgtcgttcaaaatgttactaaattttttaaaatttttttgtcaagatagatcaatatatgatatatcttttcacaaacatgcgagttaaaattcgacttatacaattcaaaacaaaaagaataaatttgactgtgaattacacattcacttcatagtcaaatttgttatttttgtttttacttgtataagttgaatttaaatttgcatgtttgtgaagtaacatatcatatattggtctatcctaccaatttttttcaaattttttaatgactttttaagtgacatgtaaaaataagtggatattcccttaaaggatgatttgagtgttccgaatatatggagtgtagaacctaaacataacatgcaagttc

SEQ ID NO: 44558 - DNA, 1501 bp, Oryza sativa
ctgcctcctctcctcctcccacttcctcgtccgctcagccaaacttttgaccgcgcggcagtccgcgaggtcgtggagggaggtgttgtgcacggtgcaccacttgccggtcgggcgctccctgctaggagcgccggcctccttctttttgtcgctcgcaggcctcccctttcgggtggcccgcaaagcgccctcgacggcgaggacgtgaccctcgtcgtcggaatgggccgacctcttcttcctcctcctgtcccgtcgccctgaccgagcggcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacttgggcgcggatatgtgccttggaagttcatggtgaactgctggcacaaatcctcccaagagtggaccgacgcgggtggcaagttcattaacccaccccgcgcctgtcctttcagggccatggggaagaaattcgccatgaccctgtcctcacccccgggcggcctgatcccaatcgtgttgatctggaaaaactccgcggggttgacgcttccgtcctatttttcggtgatggtgggccggaacttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagagggacagtggagtacgagctcgacggcgcgggttctgctccccgtcttcaccgctagcgctcggagagagattgtgcg

SEQ ID NO: 44559 - DNA, 1501 bp, Oryza sativa
tttgataaaatggaaatattctattatctttttatgctgcattaatatgtgtcatgtgtgatattgaataacgaacttactttaatacggaggagtattttccttgaaccgggatgatgaaatcattgaaaacgcggaggcaagaggacgtgcaacacgtgggatagcgccgacgtcggcgatctgttctaccttctggaaaacaagtctgcaaaaattaatttctgcctgaggcagtgaggctcgcttgtcagtcacccgtatacgtggaaaataaattttctctcgctttctcacgcgggtcgcgaggaactctctctctctctctgtgcacaccccgggaggaggaaccgagggaggaggacaagtcagagcaaggggcctcgacggcggcgaagccctccaactcacaggtgagagaccccccccccctcgcctcctcctcttctctccggcgacagcgacggcgacgagcgagtccgtgtagatctccgaccccgtagatgggttttgggaggggggcggtttaatcggcggcgcggatggcgtccgtaggactccgtaccccgccggggaatccttaggttgctcctctattgctcttggagtacacgccgcagccgctacccgtaggccttagcccgatggacatccatggttgggtggatctgaatggagacggattggagagagcaagtaggatggaagtaatggttatgatgtctagctgatgaatgtactttatacttaactaatagtactaatacgcaaagctttgttacaggaagcccaagattttccccgtgaattcctgtttttctccattgctccatccaaattttgcctattcctatgtctttcaaatgtttgcgataggaggcctcaaagggtctagttagtgtataacactgtactctgtaccgcgaagtagtgcctcaggctgtgaaatgtctgctgttcctttgtcaattgtttggatccctttgaacaatggaaagcatacaatttcatggaaggttattaattacatttccctgttaggttagttctgttatgccatttcagtactaatgaacaaacagtttgtccacctacgtgtcatcacttggcttgatagtgctgcaaccaacctatgtttatgtagaaagctgaggcatatttggattccctttcgtaggtaaaatctgctaaatattgtttgagttttctggcatctgcttcagatatccattcgctaatgactaaccaatttaatcacagaaacaccaatatctaaagcagcttaaattttgaaaccaaaatgcaagttgtattaaaacaattccatgaaaatcttgattatggtaatacatactttctaatttcattttgttggtgcttttgttttcttatgtgacctgtttttgaccaattgttatctcaaaatatatgttccttcctcctggtgaataaacttgaatatatctatctacaggcgccatgtcgatgtcactgttccctg

SEQ ID NO: 44560 - DNA, 1501 bp, Oryza sativa
tctagagttagttcaaaatgaaaatacctttatccaagttaaacgtgtggagtaggtaagatggtaacacagataatggttgagatgcgagatcttaagttcgaatcccacatcctatatattttttatttagtatgcatctttagatcttaagtctcggttactataaccgagattaaaaagagtttagaatcggtattaaagatcatttctctagtgtgtggattggttataagttttacgctttctttaaccactcttatttattgtagtctattagggattatggaatatcaaagttctggatacatgtgtagctcacgattcaatgacaaacatagttgtcggcaagaattcttagagtgtgttttcaggtcaaaaattaaaagtttggttgaaattggaacgaagtgacggaaaagttggaggtttatatgtgtagaaaagttttgatgtgatgaaaaaaattgaaaatttgaagaaaaaatttggaactaaacaaggccttaatttgcaaggaaaatttacaatgtgagctacctccaccagatgaatcaaataggtccccgttatctacatgtgcattttgcctatatttttcccgcatttccccaactgctcttattcaagccagtttattagctaatttggtggaatatcaattatagtatggtacgtcgaactttgtaagatgtgaagaacttgtcaaagttctgggtaggtgtgtactcgctgaagatgccattgtctccgggtatcactacttgcaaggacaaatgacaattaattgatgagctaccgccacatgattttaacgcatgttttcaaacctctcttcgtcgttgtttattacggaattctaggaatctcaaagttctggatagatgtgaacgtacgtagctctcaagattccattgcttaaaaaacagggttatatatgcaagaatcctttgcacgttacccagatgcgcaatgcctatatatatttattacgcatttcttcaactgctcatattcaaggtagtttattagccaatttgagataatatcagtgatagtatggcagctcgaactttgtaaaatgggaacaacttgtcagagttttgggtagatgtctaggtcgaacaagattcaatttgtttcacaaatacgaatcggattctttattagtttttacgaaattgataatacacaattctgaaattacggactttccatttttaatttgaaataactaatttaatttgaaattttgaaaccacaaatgtgaagttgtaactaacgtgtgcgcttcttttagctagagtcagtataataaaaaaaatataaaacctacatatttaagctatgattaaaatttaaaatatatctctatactctataatacccgtgcatcgtacgggttagcggctagtgtaactaatgcatgggctttggaccatgtgtagagctatattttgcatgaaaacttgcacttctctctttttttttatatatatct

SEQ ID NO: 44561 - DNA, 1501 bp, Oryza sativa
gtcgaacaagtccaccgggagcaggatatcgtcgaaggtgtgctcctcgtcgaagaaatcagcggccgtcgccggcgacgtcttgcggtgctcgtcggagctggcattggcggcggcggcggcgccgccaccgccggagctcgacgacggcgtcgggttgtccattggtgaggttgggagttgcagtgttaagtggactggagctttgttgagatcgtagtgacgagagaagaatatcgaacgcgtgactccaaattttatacgcgacatgagatataattttttggacaatattgtcaatatataagttgatgcaaaaatttcctgaaatcaagtttatatgcactttaagtgctgtattttttaatatatatttttgcatcttggaaaactccaattttcaaagaacacctagtttatgacattaaagtataaacacgtccacctacaaatttttgtgagcaccaatgaattttttttacatattattagacatgtgagttacttgtggtggaagtggaacttttgtccatccagatttatagtggaacttgcatgttatgtttaggttctacactccatatattcggaacactcaaatcatcctttaagggaatatccacttatttttacatgtcacttaaaaagtcattaaaaaatttgaaaaaaattggtaggatagaccaatatatgatatgttacttcacaaacatgcaaatttaaattcaacttatacaagtaaaaacaaaaataacaaatttgactatgaagtgaatgtgtaattcacagtcaaatttattctttttgttttgaattgtataagtcgaattttaactcgcatgtttgtgaaaagatatatcatatattgatctatcttgacaaaaaaattttaaaaaatttagtaacattttgaacgacatgcacaaaacgaggggacgtccctcgacctctcgagggacaataatccatttatgatatattcacttataacaagatatttgtggtaaagtaatctcaaaatataccgaatataccgacccaatctcagggcacatgtttgacaagcatttatacgatgtttcttaaaaaaaaggaaaaaagaaattgtggtgacgacgaaaatttatacggctgtgtctaccagaagtacggattgacccgctgaatctaaccaattcactgggatgagcatatgtacggcctcatgtagttctccattgacggaaaattgaatacgaaatgtacaaccctacagtcgacagtttgagaacgattttacagagaaatactccgtacgacaataacgggttgagaatgtagtagtgtttaaaactccaattcaaaatctttttcctccaggatagcagatcttagaccaaatctaacactaattgtctaattccacatgtgaaggtaaatcaacgagacaaccatccgaagatcaaaatatactcatttccgaagcagcaggaaaaaagaagtaccacatttcaatgatatt

SEQ ID NO: 44562 - DNA, 1501 bp, Oryza sativa
ctgtttataaaacattactagcactgaagaccgaacggatgagtaaattttattttaggctatgtatttttataaattgttacaaggggtttctgttagcacgtccggtttatctctatccacatcaataatgccgactttagtttcaatccttttctttaaacttctaactttttcatcacatcaaaattggaggtttggttgaaattgaaacgatatgacaaaaaagttagagtttgtgtgtgtaggaaagttttgatgtgattaaaaagttgaaagtttgtgtgtagggccgagtttagatccacagaaacttccaacttttcccatcacatcgttctaatttcaaccaaacttctaattttagcgggctagtatgtttcattatcggcgggaacatggatagccgagaaagcttatcagccagcaacggtggtggcgctttgtttaaggctacggtaagaaatgcattctgatgtaacgattccatttttctttacaaagtataaaaatgacaccttcagttttgaagcgaatgttcacatatcgtacgtcataaactataggtccttgaggtggttgtgattatcatcaaatacatgtcaatggaaaaaaaaacaaccatgttctagtcagtgccaaaagaaattgatctttcggtcgtagagctaaattcgatgaggattagaaaatgcaataattaaacatgagcgcatagttgccaaatgtttttgaggaaaaaaagggtatttttccttgctgttgatcgagaatcttgcctaatgtcatggcaagtccatcttttgcggttgcgcgctgtttagatcccaccccaaaattttacaccctatcacattgaacgtttaaacaccggcataaagtattaaataaaggataaaaaaataactaataaatattacacacattgcgactaatttgcgagacggatcttttaagcctaattgcttcatgatttgacaatatggtgctacagtaaacatttgctaatgatggattaattaggcttaataaattcgtctcgcggtttattgatggattttgtaattagttttttattagtgtctaaacaacccatgcgacaccctatagaatatccgatgtgacacaccaaaattttacacccctaggccgagtttagttccaaattttttcttcaaacttccaacttttctatcacatcaaaacttttctacacacacaaacttccaacttttccgtcacttcgttccaatttcaaccaaactttcaattttggcatgaactaacacacctctagctttaaaaaccccagagttctttgccagcagtacagtgtatgcgcgaaaaggaaaactgcgagctgccataccacatcaccctgggcctagtcatgcatcctgactggagaccttgtcactttgtcagcactcagcacgcacccagccggccgaccaccttcatcaagctaggacccaacccaaaagagttgcaggctgcgagg

SEQ ID NO: 44563 - DNA, 1501 bp, Oryza sativa
cccaacagccgcttacccgaaatgggccaacccgtgcgctaggccgagcagccgcgcctaactcagcaaaatggctaaaaaatgttaggagttaggagtcgaacccgcaagctaaaaattgttgggagttgcgtgaaaaaattgtcaaaaacaaagttatatgacttatcgaaatctaccaattttattttagttatttctccatctgagtttgattgatctatataaaatttgaattttaaaatataagaaattcaaatatatatttttttgtgtagtaaatgatttcaaatgaaaaaattgtcaacaaaaaatttgtataacttatcaagatctacaacttttgttttggtcattttgctatatgactttgtttcaataatttgaatttgaatttcaaattatgactacttcaaacaatattttcaaatactaaatgatttcaactgaaaaagtcatcaataacaaagttgtataactcataaatatctataacttttattttggtcatatcttcatctggcaaagtgatattaacattgttcacaaaatttacaaatctctcttatagtttataaaaccatattaaaattttgtgaacaatcttactatcgcttcgtcgaatgaacaaatgaccaaaataaaaattgtagattcagatggattatacaactttgttgttgatgaatttttcagttgaagtcgttcactaataaaaaaattctatttgaagttctcaaactttgaatttcaaattcaaattgttcaaatagagtcagatggagaaatgacaaaaataaaaaatttccgtctcgatgatttatacaactttagttttggtgacttttccatttgaaatcatttattaaccccaatttttattcgaaattatcaatttttgaaaattcaaaatttgtattgttcaaatgaacttatttgtaaaaaggactaatacaatagttgtagatctcgattagttctataattttattatttatgattttttcatttgaaacaaaaaaaatcgacctaaaattacatttaatgttttcataaattgaaattaaaaaaaaaacatatgatcattcctgtttcggcccaaatggcccaactatttctgaccgtccatcttcgatctaatggttctgatcgccgtccctaaccctagccctatataaaaccctcctctccacccctcctctctctctctctctccaccctcagccgccacactcccatccattctcctctcctttcctctcctctcctctccggcggtgggtatcggcgatgacagcgtgcggcggcgtcctccttcgccgcttaccacgccgcctctatctccgccgccaccacgctcgggagcggtggatctgctagatcccgggcctagggcggctagatcgagcggcggcaatccccgggcggctcgaggacggcgtgcggctgcatcgacgggcccaaccgctagccgattccaaaccacgttggccacagcatc

SEQ ID NO: 44564 - DNA, 757 bp, Oryza sativa
tactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcctgggaatttgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttagg

SEQ ID NO: 44565 - DNA, 1501 bp, Oryza sativa
tcttctaccttctgtcactgttgcttaaacatacaccatataatttattattcaatgatcaaacgatttatacacgctgatacatcaagggatgatctaggcagagaccccaaggaattttttgcatctaatacaagttttattctactcactgccaatagacattcaattaattaatgccagacacttaatctcaatccatttatttagaataatacataaaagctactcttcaacctatgaatcaaataacttatccctatttttccctgttgcttttctttttctttcctttggcatgtgtggattatctgcaaatatttgaatgtccaaaagttgtactctcatcagcatgtattggtagaattacgcatttgtggacacttcgatgaattggaattatgttaccatgctaaagacaaagtgttgtgtgcaaaaagacttcgtaactggtacttacaatggagctcaccatgccaatgtgaaggatgtaccacctgtcagtgatattgtgtggagcttttatgagagtgtttatccaccaaacaaataaaacgtaagcatcttgatatgtacaacccttacttccttctatataaggtgcctatcacttctatcgatcaaaggagacatttttgctcgacacagatctctataaaactatttgcagtagtaatcatttaatagtatctattatccgactgaggatacctttgttgctaaacgtagatctctataaaactatttgcagtaatcacttaatactaatagtagtccatctattatccaattgttgaggatacctgctaaacggagatctctgcaaagctatttgcagttatagcttagtggatttcattctccattccaggacatttatgagacagaatttaggcatcaatttccaaggattgaaacttctttttcaatcattggagcacatttcctggtaaatgtgatctataggaagttttctatagcattcacatagtagtatccaatctcattggagtatggttttctcatagattttagcaagctatttgcagcaataaaattgcaattctcgttctcccttgcgaatgtcttcccctcatacatctccactaagctatttgcaaacatagcaatttccattctccactggagtatggttttctcaaaataggtctccaacaagctataatcgattagtagttcccatcctccattggaaaatggctttctcgctgtagatttgtaggaactatttgcaacttacacgcggtagttcccattatccattggaggatgcatttcataccatataaatcaacctagctacatggtatgtagttaatcgctttcgtttttaggccattcaacatccaaaaatgtctctcaccataaaactataattagatattgttggtatcgtattaatttgatttctatttgaggatgcccttctcgctatatatatgtagccagcaagctacaccgtatactatacagtattctc

SEQ ID NO: 44566 - DNA, 1487 bp, Oryza sativa
tactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcctgggaatttgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaattgatgaactaagtgttgatggactgatgttctgttgttgttctcaaacccatttcctggagtgataggctgatagcagtatagcacctgaattgtgtataccttataggcttataccattctgttttgctgtattcttttagaatatttgttatgcaaattatatgaagttatagaagaatatattttgctgtgagactcagtttgaggggtttatgtattccgataaattttcgttaccgtatccgcgccggttcgttttcgctccgttttcggttttgataatattcgtttccgttttcgttttcggggtttccgatttcgattccgattccgaaaaaaaatatgaaaacgaaaacgataaaggttgtttccgtccgtttccgtaccgttttcacccctaatgacatgcacgcattatcatacatccatgtctactaaatttttttttcaagtttagtttgcacctataaaaattaaaatctggaaattcatttgcacgggcgagtacttaagagaacgcaatgttgaaattgatctccacggctgtcggtatatatttacaaatctcgcgaatttcaacgttacaggccatatagtcagcctcgaaaatgcccatgtaaacgaactagctatcggcggtctacacaaacatttttttata

SEQ ID NO: 44567 - DNA, 1501 bp, Oryza sativa
  unsure (1)..(1501): unsure at all n locations
gtagtaaaatgcattaattatcataccaaccccaaatcgtgatggttagctcatatttttagcggctgtttatcatgtatctttcttaattttaacatctcccagtgggcaatttcatgtagtacctttcttaaatttaacatctcctagtcccattcgagttgtagtaatcaccaaccaatgcaggctcaagtttaagctgctaaatacagctgaaaaacatatatatctcgatatatatacagtcgaaaactcaaaatgagccctgcacaacatctctctgtatcctgagagcagggagaacagtagttcacgacatggtcaagatcaatcaggctcgaacagaaaaaagacagaaaaattagggagtttcaaatttatatgaaaaaaaattcctaaaagcatatttgaaacaaataattaaatcatctcctttccattgaaactctaatataatggacgatactacagagatcttttttctagggaaaatactacatagattttggaggaaaattcgtaaaagctacaactttagaaaaatttcccttgaatctgtcttttttatttaattatgtcagtgtcaaggataagacatacctcctatacatggattcatggaataccgcaataccatatacctgattatatacgacaatgtatcatttgattacgaaatacgacagataaagaagaaaattaccttatcggaatagaatgtgttagaatcctgtcggagggtgaactcctcaagcaggggatagtgagagccccttgttggttcggccaggggcagcaggtgagactcaagggctcggtggatagttcagtgcataggggtcaggcccctcaaggacgatgagacaagaggggtttatataggttcgggccgctgagaagcgttataccctactcttgtgcttagctaattgtgggagaaattacaagatctccttgttggagtagaaggtgttaataatgaggggcaggagaactcctcaagtgaaaaagggctcaacccctccctaagtaggcctggacctccttttatgaataaatggatagagcctggctccaattctggtgaaacaaaaagcaacgagcttaacttcttaattggaagaactccctgatctaattagacgttaaaaataaattagtgcctgatatagggaaaggctgattttcctatgagtaacccagtatcgaatactggtaataatatcagcaaaagaacgttctcccgtgcttccagacacgctgagctccccaaatttttgtacgttcaaaaaaggaattgatgccgtaaaagatgggatcaaccagtaaatagaaaattactgatatttcatccttgtgagattattaattttgtaccaaaggtgtattttgagtataacgaattagatatgacccaaaaataacaggggccaaggtcggccagtgagacgatgggggataagcttcatcgtcgnnnnnnnnnnnnnnnnnnnnnnnnnnn

SEQ ID NO: 44568 - DNA, 1501 bp, Oryza sativa
cgtcattttggcagatcttcttgcccatgcggttggcaaccgctccttctcgcccgtatgcaaaaaggggttttcgtagtaacgatagccatactccgtcaacatatacaccgtgctggcgatcctctggccatcgcagccctgcaggtagtgccaccatgcggccgacacatggacaccctccttagcatgacattccatatttctcgtcatatcaaagtttaaagaagtaaagaacgacggcagatagctagcgaatcatcaagacatatacagaagaacatgggagttgttcatcatttattcaccacacatgcttcctaacaaaaggaaacactaattattttaggagtaaattgcattcacggtatatcaacttggcaagtggatacaatttagtgtaagataatatctacgggagcaatatattctaagataatataagacttgtgcaagaggttcttattgccatctatggatgagggttatgcatattcttgccaactatggccttgtttagttggggaaaatttttgagattggttgttatatcgaatatacagacacaccactggtggagaaaccatctttcgtcggtcggccgaattccacaatagtcccggttgcaataaaaaccaggactgttgacgaaaaaatcgaacacaccagcctgggagatcttcttagctcctgtgcaggtccaaaaattgatgagatgcgggcgtgccagtcagtttgatcctgcaactgacaagatatgcaaatagtagatcaaaacagccgaacggctgacaagccgatggagtagttccagccgatgccgataatagccgatgccgataccagccgatagcgataggatttaagcaatcggctatataaaggcaatcggctactgataataaaatataacaataatatagtccagtataaaccaatcggctagcattgatatgatagaataagcattgatatgaaggttagagcatacatcagctggaggtccgatgtcatgacatccacaagattagattaaacagtgaagcctttgttgtcatcggctaaatccaacttatatgtatatgcaattcttatgagccgatgcaacatccagataactcaccggctgaaaccccgatgaaacccttattggcaatcaagaagcaggctagatattatggttctaagcacgacatagtagatcaaacttaactgatacagcactaagtatgaaaagaaacataatatctagacaatcaagccgttgactgagttttcagggtggtagatgtctaagctaatctaatctagcaacgggatttagccgataccggcagaaaccctaaaacgagaagtagtcgatagagctaaattgatatgctaagactagattaacagagacatatgataaataggtaggcaagtatatcatccaaaccagagcaatccaagaggtcgaatgtactgatgcagccttgaacgacgccgatgtagacgatac

SEQ ID NO: 44569 - DNA, 173 bp, Oryza sativa
tgaaaatgggatttccttgtgaagattgtagaaacttactaattgccaggattggtctaatttgttccaaggtgtatggcattttttgtatttctttactcctttaaacgtttctggtggcgccgccaccaccaaatgacatttgggctccacataactagttgcagaaaaaa

SEQ ID NO: 44570 - DNA, 1501 bp, Oryza sativa
  unsure (1)..(1501): unsure at all n locations
ttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtcccccgtgtcagactgatagatttgacgggccccacgccatagcaaggcatgccagagacttccaaggcaagcaacaagacatgcatttaatgtgattatcctccctgaataggttcggtgggcccatgtggtaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgatgaagcttatcccccatcgtctcactggccgaccttggcccctgttatttttgggtcatatctaattcgttatactcaaaatacacctttggtacaaaa

SEQ ID NO: 44571 - DNA, 1501 bp, Oryza sativa
tgatctgtactgctccaatccactgttcgtatagtattaatttttagtaatttttagctcgccttggctacccatcttagtagagaagtaaagagagagaagaatggtactcttctcctatcataaatactaattgatttagcataaatttagatcatttttactggtactttgatacgtcatccctgtttcagtcgatttctaagtccgttctcttttagaaataagaagaagtcgtataaaaaatctctttaaaaaactcgtatgctaacttgagacgattggacttttaattgcagcttacaattttataaaaaaaatccaagcgaacaacagtaataatattaaaatagcccttcacccactgcaacacacgggcatttttttctagttatgataaatataaaaggttttgttactatggcaatgccttcttaaggtgaatctctgtagtgtaacattttgattttatcacaagtcaaacctctctgactttaatcttgtttatagaaaaaaacatcaacatcaacacatactaaattagattttatcaaaaccatcatgaaatatgtcttgacattgtatttatctgttagtgcatttttctataattcagtcaaagttagagaatctcactaaagacaaaaagaataattttcaatatgaaacagatgtggtgtatatttgataaactattgatcaaatgccaaaatatttataaccacagtaacagaatagcagtaaggcaaagccatacgatacgacgacagtcagcatctatcgtttgacccgtatataaatgcatggtacgaacgctaaaaaaccagcgttactacttgatgaaattattgatcagattggcagtagctaggcatgctttcatttgatgggtttttttttttactggcataggattcgccggagttgaggtgaaacttgtgttctttgtacggcgtgtccggccaacaaaagatgggcagcgttgagagccaatgcaaggcaaaagggttgagtttttatcggcagatatggaggccggaatggcgcagggcggtcggtcggccggccggattcgcgcgtcggagcatgggtcactactcactactgtagtcccttttttccctctgcaaaatccagccctgcaacctgcatcattcctgctctcatgttctatggcttcttgctgattcgttcaaaaaaaaatgcattgtactacatttgtagcatgagtctagctctgttttgaaaacgcgggattgaaaaaacagatgaatagaatttttttttaagattttgctaggaatacaagtgcaaaatataaagttccgaaaacggaatgatcgtttggttaggagaaaacgtaggaatcggatagtaaaagatatagactcaaagggaattttccaagaggttagagctcttgctaaccttttctccaaaatctctctctctctctctctctctctctctctatatatatatatatatatatatatatata

SEQ ID NO: 44572 - DNA, 1501 bp, Oryza sativa
cggcgccgcctgctcccaaccccaccgcctgctcccgcacactcggtgaggagaggaagacaagagagtatcagaggagaggagaggaacagacataaggagaggaagagtgagaggagaggagacgaaaagttttaagtggtgagagcgaaaagagagagcacgggaaaaaaaatctgtgaagaagagggtattttcgcgtgcggacaacttaagagacacgcatacgaaaatttatttggtatgtggccccttaagatgaccgtattggtaaatagacttatttttacatgcgatcccttgcaaattgctaccactatagaacatgacgtcgtgaacgggacatccatgataggggcttgcatcccatcatatagacctcccatttgacgggacataataaacctcgacacaaaagcaccattacaggcactcaccacaggcctctagtctggacctgttactaatgacactcatcctcgacacagatgagttttgacatcactgaccaataatctgtaactgggctccttgccgacatagaagggacccacccaacatggatgacctattccataggtgtgctgtggagtcttgaactacacatcgtctatcaaaaacattgacaaggtcttcctattttacaagctacaaggtaccattctatcattgatattgttgtcaaaacgacaactgcatacgtcgaaagacgtggttactcaacagtggatgggaaaatgaagtgtactaaattttgaattttccttggggatcccccattacatggccctaggggactatttatagccccattacaggttcttactactagggtttaggttgtacagggaaatttacatgattacccttaccaaaggggcatttacaggggtacataatgttataggggctcatgggcctctgatgggccgtctggcgatcgccggcctgttgggccggaaaggcttcctcggccctcacgggggcgaacttgtcaaggcgaagtcatcctccttcggcagatagtcttcgccctgcacccttcgcctgagacgcctctggcctggcgcttgtacgactcttcgccttgcgccgttcttgttccatagccttcgccatgggtttcggcaggtttggttgaaggacctcatgccatccgccaacaagcccctcacgggcaagggtgagattggagcttcggccgagaccgtgcaaaccatgtggtatggtatgcggcgccccctttcgaccgatgctcctgccgaaacctacattattcctgcgaatgaagtttgttatttgtgcggctggtattattttgccgcgcttcgcctcctgcgattgatttttatatatattcttttttcctgggccgaacggaagccttcctatcgtgggcttttcactgtgccgctcggtcgatgggaatttaccatttcacctacccttgcgacacgtggcgctttattactagtggttaggcgaacggtcgcctgggtgg

SEQ ID NO: 44573 - DNA, 1501 bp, Oryza sativa
gtgattgccccaagcggttcggcttcaatccatcgagagaaatattccacagctacaattgcgaatttatacccgtttcgtgccactgggaacggcccaatgatgtctagtccccatctggcgaagggccatactggcgcaatgggctgcagatcatactggggcgcggcttggcttcggccatgacgctggcaactttcgcacttcttgatttgctcaacacagactttcaacacagtgggccaataaactccttgtctaaatactttggaggccactgttcttgcagcctagtgcgcgccgcatagcccctggtgtatctcctttgccatttcttcgccttcggcaaatgagatgcaacgaagtaagggttgaagtacccctgtgcggtaaagctgacccgaaaccatcttatacttcgtggctctgagctgcaaatgcttcgcttctgcttcgtctaccagaagccagccagttttaaggtgtttcacaaatggggttcgccagtcatgtgggtcttcaccccatttctccttgtcgattgccatgacttcggagcagtccatgggcacacttggagcatgcaggacttcgaaaaagatgcccagcgaatatgggccgccttaagcagcggatttcgccaaggcatctgcctccctgttctggtctctaggcaagtgttcgaccattatgccggtgaagcatttttccatggaccgaacagcctccagatacctcttcattccctcttcttttgcctcgaaggatttgtcaacatggcctgctaccaacttggagtcagttcgaattagcaggcaccggactcccaatgctttcgcctttctcaggcccaggagaacggcttcgtattctgctgtattgttggttgtgtcgaactgcaatcttgctgcgtaccgaatcggcacaccattcggcgaaaagaggactgccgcaacgcctgcccccttgtgcgaccacgaaccgtcagagcacatcacccagaactgctcggtgggctcagggtcgggggcaaatactggtgtccattcagctacgaagtcagctagcacttgagacttgatagcagagcgtgcaacaaaatgcaagtcgaacggggatagctctaccgcccacttgctgagccggccagtgacttccttgcctcggagtatttcgcccaaggggtactgtgatggcactatgactttgtgggcctggaagtagtgcttaagcttgcgcgaagccatcactagagcgtaagcgagcttttccatttcaatgtaccttgtctttgctccttgcagtgcttcgaagacgaagtagaccggtttctgtccggactctgtttcttggaacagtatttgctcttcgcgcctgttttctcccgagccgaaggctatcagcaaaagtgcttggccaagaacttgcactgcctctccgccgaacccccggagcgacgttggtgccggtgtaagagcttgggttggcaagcccatcttag

SEQ ID NO: 44574 - DNA, 1501 bp, Oryza sativa
aggatacagagagatgttgtgcagggctcattttgagttttcgactgtatatatatcgagatatatatgtttttcagctgtatttagcagcttaaacttgagcctgcattggttggtgattactacaactcgaatgggactaggagatgttaaatttaagaaaggtactacatgaaattgcccactgggagatgttaaaattaagaaagatacatgataaacagccgctaaaaatatgagctaaccatcacgatttggggttggtatgataattaatgcattttactaccttagaaaagataaagtacttcttggaactccggtcataaatatttgattttgatgttaaaaattagatttgatctctgaccatagataacttctcaagtgcttaatttataaaaaaaataaaaaagtttttttttgcggggaaaaaataaaaaaaataaaaaaatatataagtttgactaaatcttatctaaaatttaatcatttatgactggagtgagtactttttatatgctaataaaaacactccctctcatcatgaaagttgaggacaaagattctatcaaacttttgaaaaatttgaacaactttatattaaacaagttatttaatctactaataagtttgtaatattatgatagcacttttcaagcaactaggaaggaagcccgcgcggatgcgcgggcattttatttattgttttatataatagtgctaaaacaagtcatatctcactatttctacgtcgtgagatagatcgtagacttcaatatacttaaattataagaacgtctcccagaattaaaaacactttgtcccaattacatataaattctatcgtaacaactcattatcactattttaaaagctcgctaactatcaatacatgaaattgcgcataataaaataagcctaatatatcattaatacactacttagctaagtgtttatgtctcacttatttccaaatccacatataaatattcttaaaaatatcactaacgggtgaagccggtcatagccgtagatactttctttctctattaccttaaaagttgggtagctgtgtcccctcaagatcagcccgaagcacatattataatttatctattatatattaataatatattaaatttcctactaacgctcctacgccatcacgtggtactctacaaacgttcctacatcaccacatgacgctataataaattagagaaaatcatagatattcggagaaaaaaataatatgtagtatttatttttacttaaattgatgggcctattattttataccattatattagatcttacttaaaaaaataaaaatgtaatttgtcttcccgtcataatccccatccacgtgcgagagaaaatgcatacgttcgtcatgttcactaggaaaaatgtatgtacataaagttcaccaggtacgtacagttcatcgggaaaaagatacagccgaaagaaaaaaaaaactcaaaacaaacatacc

SEQ ID NO: 44575 - DNA, 1501 bp, Oryza sativa
catgcatgcatatgcatgctagcaaggtgccaatctttgtgtaagaaagatgatcaaatcatcatcaaacgcagtctcaataatgactcaatccttggacctcacaccaatatatccaaatccaacgtcgtcgtaagcattggctgcatccttgactttgcactcgcttctactctatctatctgctatatatatgtataggaataggagtattctgctctgcctaggactgcgccgctatgactatcagactatgcctacctcacacaagattcagcggcaacatccaatgcatcatcctgtgtgcagctgtaaattgaaaataatttctctgcatgcctttgtgacataggagtaatattcaggctatcatcagcatgaactttctgatcatttgggtgaaaaaccaattcccttttggacttttaagtctttcagtagagttgaatgctgtaaaagatttggagagtttggcgagtagtagttgttggtcaacactttgcttgaaacttcatcccctgctgattctgactaatgagtaataccatgatgcaagtcatggtgtatacttttttcagatgttgcaagtcttgatatcctctccctttctttcttttgctttttcataagtctaaccagttgggatattttgttcggttgagtgaaggagaatacaagtaaattactagaagatgaagaagatcatatggtgattctgttctgtaccctgcttcaacatgactgacagtaaccttggtttttagcttttgactccttacagatgcaggaatcagaactcaacaatgacaattgagatcgactgataatcatggcgcaataataaatgatacgtttatttacgtggtcagactttgacattcatattgttgtgacagtctgacaaaattgaggttaactaaaataaactacaccacctgaagaattatagtcttcaccttactttcaagcatatatatgtctcattttccaccttaatcagggaaatatagtcaactgaaaactttttaactttttgaatccttacagaggcaggattcaacaatgacagttgatactgacaatcatggcacaattaataataactggtacgtcatttacatggtcagactttgacactcatatggttgtgacagtatgaccattgaggttaactacaataaactagaccacctgaacagtaataatcttcaccttacattcaagcatatatatggcgattttgtcaacggaaatctagctgttaacttgttattgaagttcagactgatatatcatccatttaggctactgaaattctgcaactaagctactactttgttacattcatgtcaaatttaccacttacatgacatccattcagactgatcatcatcatcatcaggctaaatttaccacttacatagttaattacatctgacgaaacacttgagcactcatctcaaatcaacctgtcgatctgaactctgaaagacacgcacga

SEQ ID NO: 44576 - DNA, 1501 bp, Oryza sativa
gcctccacggagctgagattcagcacccgttggaccaccatcttgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggtgcgcttcgtcggcgagaggggtgtagaaccagtcgctcttccagtcgtcccacttcttgcgaaggacgcagggaatgtagcggttcagcactggcccccgcagctgaaagtagcagccaccgactaccgacggtggcaacaccggctgtacggtgaagaaccaccggaacagccgaagagatgggcgcaccctgatgaacatctcgcataggtgcgcgaagatggccaacgtcattaccgcgttgggggtgaggtgcgccatctggagatcataaagctccagaacatccatgaagaaagaagagaatggcgggaccagccctgccattacgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaatggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctttcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccaggcgaaacgaactggctcgtcccggttcgcgcgctacttaagtaatgtagcggtcttaaagaaagccgctcattattgtcggtcggtttttccttgccgatgtgcgcgatttgcgaccgctgggtttctgctgcctgtagagaccggccccatctgtcaccaggtctaaggagtggcgtcacgcccgagcgcttccctcgaggggggcgatcgccctggcgtaacgccgggggctactgtcggtgacatgggaccgggggtatcttgactagaggtttggggcagctgcagtcacccacgtggcctgaccccctcggggggggggtcgggc

SEQ ID NO: 44577 - DNA, 1501 bp, Oryza sativa
cttgtcaattaatgcctcctcaaaattaactttattctaattttctcccccctgtcatttcattgttggtatagtccgtagtatatattgttagcccattccattcttattccagctatataggtaacactatattctagttagctagtgtgatagtgagatggggttcccctcgtttcttacgtacatccacatttataattattattatttatttataatttatagaagtaaaacttaaatttgtatgtttatgaagtggtatataatacattaatgaataaatttcataaaactatatatactttcatcaaattatcacaaaactacatatttaaggtgatgtaccacaaaattacagatttaaggtagagtatcacaaaactataaatttagtaacaaagttaccacaacactacagattttggagtttaaatgcttagcactagtgttatatttgagttataaacatgtaagttttgtgattaaattttcactaaacatgtagttttgtgataattttattactaaatctatagtttggtgatactccaccttaaacatgtagttctatgagaaatttaatgttaattaaactagaaaaaatacccgtgcgttgcaacgggtgaagtctattttaatcttattattgttatatggtttaggtaagatgacattattcgctgtgggagtttgcttcgatatatatgtatatatatatatatatatatatatatatatatatatatatatatagagagagagagagagagagagagaaaatcatgagctgtagttaggagtccgatcgtctcaagttagcatgtgagtttttttaaacatatttcttatatgattccttctgtattaccaaaagtgaacgatcttaaaacccgactcaaatatgaatatgtatttccaaaaacaaacgaacttaaaaactaactcatacacggatgatgtaccaaaataccggcaaaaacatcttcaatttttatattagtagagaagagatagagatagagaagatatatagattaaacaaaaacataaaattaaaaccgactcaaatacggatgacgaaccgcggaaacatcttcaatttttataaccgactcaaacacgaatgacggactacgaaaacaactccaatttttataatagtagagatttagttatctttcccggtatagatgcacaagacaagagacaagaagagagaagaaaaaaaaagaagcaaagaaaagacacaagaaacgccgcacagatcgcctttttgagcgtagaaaatccaccgctcgtcgtcgtcctcctcgcgaaacccaacccgcacacgctctctcctctcccctccgcttacaaaagggcctcctcctcctcttcctcctcccccatcgccattaacccattaccacctccacctcgcgcactcagtctgtactacctgtacgtacgtggccgccgctagctaagctaggaattgaaatggggatggagaggc

SEQ ID NO: 44578 - DNA, 785 bp, Oryza sativa
ccgtccgtttccaaattttgttgtattcttatgcaaattacctcttttatagtatactccctctgtcccataatataagggattttgaatataagggattttgattttttgcttgttttgtttgaccattcatgttattaaaatttttttggaattatcatttattttatttgtgacttactattatccaaagtactttaagcacaacttttcattttttatatttgcacaaattttctaaataagacgagtggtcgaaccgtacgagcaaaaagtcaaaatcccttatattatgggacatatggagtagtatttaccgcgtttctatttgtttctttatttgactcatagtttagagtcccaccaattcctcaacaaaatctctaatttgagttgtcaaccacttggtttgaatggaaacaatttacagttatatagtgtaatcttgaatctattttgtcacattatatagttattatgcaaaattaaatgtaacactttacagtccagtgttttttaccttaattatcagtatttgagtgcttacgccgtacagtcccgtttatgatttttttatgccatttttatttctgcctttctacatccctaaccctatgtatacaagtagcatatactcttcttctcataatagtagtataagattttgtgtggatgtagaaagtaaaaaaaaaaaaaaccaaatcccgacgcgcattaacgcatctctctcgttttggtgagcagcgcgggccactggccggtggcgagtcgagcagcagctgcca

SEQ ID NO: 44579 - DNA, 1501 bp, Oryza sativa
aggtgggtgcaatttagtgcacaaacttgtaaaatgtttattttggtgcatgaacttgtctggtgcatgcgggggaagacgaaaaggacactgcatggctaatcttattgatttagaagttgattaggatgctatgtagacatatatcagagaaggttgctactagacatacacatcttcaataaaaaaaagaataggatatagtaatagtagaaaaagattaaaaaaatccaacagtgataaaaaaatccaatcaggatatatggaattcatcatttcgatgatgaaggataaagtagagaccaaatttataaatattgctttttttatgcatactcactacacgtatgcacgtcacaattcttaatcaacatcagctttgtaaaattaatattgccaagttattttggtcctcgttcgcactaactagacaagtttgtgtactgaaacgagcatttcacaagtttatgcattaaattgtacccatctaacaagtttatgtatctccaatgcaatttactcttattaaaatattttaaaacaaactggttttcaagttttacaattctatatccctaactcctctcccttccaaaatgcattttttatgacgtggcacacgtccattgacacattgtaacggtcacatcgagtgatgaaggataaccggtcattttgcaagcaactccttgccgctctcccaaagggttacagagaccacctataaaatgaccagggttggccatttatagccaggaccttgcaaaatatcgtatgtcgctattttacaggcaactcgtttgccaccctcctaagagctgcaaggggaccacctatcaatcgctcaattattacagcataccaaaggatatgtgccacggcataaaaagcctcccatataacgttaggggtgtaattttagcaaggataaaaactttaaaaccaaatttttgtaaaaatattttattgggaacatatcctatgcatacaagcttcccgtggacacttcgtgtacaccaactagtaaatatcacagaaaattctagaaaattggacacatacttccaatagttttacacctacatgtgaaatcttatcttcaaattcattatattttaaccgtaacaaaaaaagataaaattctgacaaatttttatccttaaatctgtcagatttttcacttttttgctacggctaaaatataatgaatttaaatatgagattttgcagatatgtgtagtactattatgagtaaatgtccaaattttttttagaatttttcgtgatatttgccagttggtgtgcacggaaatcttgtgtgcataggatatgtttcctatttttattagtaaatctctactattataaaaatttaagatgtttttgctaagattttgatacgtcatccgtgtttgagtaagtttttaattaatccatcgtcaatcgcgtgggaaccagcaagctttcgaacttaggtcatgtaaaacgcgtgaccctggac

SEQ ID NO: 44580 - DNA, 677 bp, Oryza sativa
ctgtgaattgttttggtttgtaccaatcatggattggggttaggagttgctatgcataacacctgcaggagttgatacgtagagcgcatttatggtagaattcagaatacgcgaaatcagaaaactctcgtaacacactttttggcaccaagcatggattggtgttaggagttgctatgtagaacacctgcaggagttgatatgtagagcacatttatggtggaattcagaatacatgactctcgtatgtagtaggacacacttgtttgtaccaagcatggataggtgttaggacttaggagttgctgtgcaaaacacacttttggtagaattcataatacacgacatcagaaaactctcgtatgtagtagaacacacttttggtagaattcagaatacacaaaatcagaaaactctcctacgtagaacacacttttggtggaattcaggatatacgaaatagcggttgtttcgcagctagtaaattattgttttagctgtgcgtgtgtcaattgttttttttttttttaaaaaaaaatagaagtattgtcctttcataatgcgaggagcaagaatctccagcattgcgcgtgttgaataagttggacggaatcatacatctttttgtaatgattagagatttgcttcataaggagtttcggtggtcattagggtaa

SEQ ID NO: 44581 - DNA, 1501 bp, Oryza sativa
tagatttatcatcgaactgctttaataacatacggtcataaatattcgacactttagtcaaacttttgaaatttcaaaataagtttttacaaaatctaataaatttatgaataatattttaggtaaatttaagtgcacttttttactttctaaaattaagtgtttcaaatggttgagatttaaaaatttgcccaataatcaaatataatgactagagatcggagagagagagtataaagatctgaaataagaaaatagacaatagtagctatagatatatatatgtctagattcatttagatcaatatgaatgtaggaaatgctagaatgacttacattgtgaaacggatgaagtaattcaattactctagatttatttagttattctcatgaaacctcaaatttcagatggaaaagaattatgatattatggtaatatttttgaggtaatttaagtgcacctcttttaattttgaaaattaagcgtttcagatggttgagatttaaaaaattatccaaatcttacatgaacatcaagtataatgaccagagagcgggggagagagtataaaaactcgaaacaagaaaaatagactgattgtttgtttgtagctaatgcactaaagccataccaagagaaccgatcccaatggtaccacattatcgccgatgtgcaaagtacaaaggagttgctagcagaggtgaaatatcgtcatgtcgaaagaggttgcaatagggtactcatgagttagcgcagctgactagtagaacgaagcattgtgcactatggtgggagcatattcccacctgcattcaaggccttgttctcaacgattgaaataactttgttctcatcagtaaagctttctctttctgaaaaaaaagaaataagaaaataggcaatactagctattaaaacataattcaattactctggattttagttattctcatgaaacttcaaattttcagatggaaaatttcacagggtcatctgtcagttctgtcgcatctctgtccacagttgatatatgaaaagaaaaatccatcctgaatagaaaaagaaaaacagaaaaaaaaaccttttgtttttccttttttctcacttgtccctacttgaccagtccttgtccctatctcccctttctcaggtcaaccgattctatccaagatccagtccccctttctccttccttccttcctcgagcctcatttcccccccaatcttcttcccaaaagcagctccatccaaacccaatcaagccccactccccaccaacccccttccctcaattataagcctacaactactgctgattgcttcagactgatccaagaaagggaagtttggttgtggtgcagagaggtgcagaagggggagggagggctctgaattttcaagaaagggaccatctttctgctgctgctgctgtccgggttggtgcttgttgaatttgaggctaaagaagtcggaattggaggttttgtaagagggaaacaa

SEQ ID NO: 44582 - DNA, 482 bp, Oryza sativa
tgccccggggcattgctggcatgaccctgtgtggcatgttatcacgagtgaatgtaacagcaccttggattaagcagcggttgttataaggagatctaactgtaggttattttggtatcttatttcgtagtagacaattgattttttagattaatcttatacacggcattgaaccagaataaaagggggttccttttagtttgtctgtctccctgccattgtggtctggttgcctccatgatgtcatttgagctgcttgggtccagggacatggtgatcaggcacatacattatattatcatacatcagcttttagtgaaatgccattgtcttgctgtgacttttcatctcattgctgtgacattcatctcattgttttcctcagctgtccaaattagtatgtacttgaacttttgtcaattgaaagaaattgtgatgtcaaattaggctgacagcatacccttttacaggtatgaatcagt

SEQ ID NO: 44583 - DNA, 1501 bp, Oryza sativa
aaaaatgcttatattttgggatgaatgaagtatgtaatttggcatgcataagcacatcctgactcatgagttgcgaaccttgatttttctattttcttaagctgcatctatgactattgcatgattgtttttttttttgttttagttgagttctttactctttttatgctagttttcccaactcacctcgctcgttttccacgtgcatgcttttcaaactgctaaacggtgtgtttttttgtaaaaaatttctatacgaaagttgttttaaaaaattatattaatccatttttcaaaaaaaaagttaatacataattaattgtgcaatagtacgtgctccgttttgcgtgccggggaggaggggttcccagccttaatgagctgctaagttgcattagcgacgttcttttatcatatgcaacgattataatttcaagatcatacatatccaggtgatgtccaaccaagaggcggtggatgaaatcaaggacttcaaggatgctcaggcagctgcgaagcatctgacggagcaggccgtgaaccggaaaagcaaagacgacatctcctgcatcgttgtaaaattcctctgctagcagaaacagagtctcatacaagtgtacaattgctaccatctgatggtttcagtgttgttacttttgttgaatattctggttagtcttgtcgaacattgccgattgttgaatgccccaatgggacatgttcatatattatccctacaattccagtggatggttcattaattccttttgccctatcactttttctttatcaaaattctctcaacgcgaaaaaaaaataaattgctgaatttttttatctcaattctgaaacaaatgcataacacaaacatgcaacaaaaattgaatggcctgaagaaaaaaaaaatgctcgcatggggaactagctaaggattaccagctgagtctaaatgtaagcacaacgtttggcttaaaacagcaaacaaaaaatattttatgaataggacttatatatgcttttagcaatttaaaagtaaacggtgaaaaataaactataatgaaaaaactaaaaaattcaaatttagagtggctttaaaggctgagttcagcaagggagttagaatccttccccttcaacatataaaacggaactgtgaattagcgcataattaattaattatatgcttaaaatttttcaaaataaattaatatgatttttcaagcaacatttctatagaaaactttttcataaagcacatgtttaataattgaaaaagttaaatcaagagcgctctcggtttcctcctatcgcgcgacgcatcttatagccgtctatccgtgtcttcgtgctgttggagagacacgattgcttcatcaaagtgaggaatctgtatagcgtccagtattgctacaaaggacaccaccaatcatcaaaactaaagattggctacactagcattgttattttagtttagtttgtaccattatgctgtactcaaaat

SEQ ID NO: 44584 - DNA, 1501 bp, Oryza sativa
catatgatcatggactaattgccagtgtcacctaccaaacaaaggaagggaaactgaatctatcttacagtcccctcattttgtcatgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtagggctcacaaagtcaattgacaatcatcaattcgtttgagcatgcttgcacaacactcctagacactagacaggtattatcattcttcaacatttgagcctcttttactgttacccagttactttttcctgctccttggacccattggtagtttgagaaatgtgagataaacatgcggaaatgaccgcgatttcggaaaaaaaatatgaactttattttccgagaacacgcagaagagctgcgtgtctttggattggtaggaaaagattactgcccaattatcgtgatattctaatattgcaagtagtacctactgtttgactttaaattgtgcaaatatgtataaacttctgaaatgtgaatgcagtatacagggagaagaagaaagagagtgacttgttttttttttctcacctgttcatcagacagcctctcggatggagaagaaaccgagctctcggtctcggccgggctcttctccgtcgatctccgccgccatagccagctccggcgatccatccctggagctctctacaccattcggctcaatgccgatgcttctgcgcctcaatctctctgcttatctcactgtcttcctattcagcaatccaaattcgatgagttcatttttttttctgaagaaaaaggaaagaaattttgcctcttatattaataaagcaggaattcgatgagttcatggtcgcacaagaaaccaaacacacagaaaggaaaaaaaggagttgcagcttttgtatttttgtccgtccaagaacacaatcaaaaagccttcaaaaagtcaacttgatacagtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagaga

SEQ ID NO: 44585 - DNA, 1501 bp, Oryza sativa
gtaatcaaccatcatattttttttcttttctgacttgattatgtgcaacgcgactgatgcgaatgggatgagttcctttcgatgttttctctaagctctgaaacttggactttgcaacaaatggttggggcgcagatgagctgtttgacgaaatgcccagtagattcctgcgtgcggttgcatgcccagcaccggccagcacctgtttgactctattttttccttcggtctgctgtctgcactctggtgatctaatgtatcattttctctgaaccttgttttacccaaccttaatgccaatataaatatattttttttgttgcatattcctgaaaaaaagagaactctgctccagtgcttccaggcttcttaggtggtaaacaggaaaagaaagtaaagcaccaagtggctcctttgctgcaataaaatcaaattattattgtcaaggggatgaaaggaaaagaatacacagcctggaagagctttcaacttgaatccccttgcaattttgtaacactacttgccctttttcacattgcatcatcgttgaaacatttagatttgaatacaaaaatctttgtgggtagattttgcctcaaaaagtgctttcatactgttttaattttttttcaggtttttcagacgttttgcaatagagaatgtcaatgtccattgtgacaaaggcagttggtggcaagaaagggaggagaatctataacagctctcttctgcaatctgcattgccctctctgttctcatcaggttttagccacactgcttcaatatctctttccatcttccgtatttaagtgatcggcactcagcagctctgtgagatatctcttctgggatctgcagtttcaagcatctcccataggagagatccagtgggaatccgtaggttctagcactatgggcacagttttggatgctctcgcttggaaattcttggaaaagctgggtcaacttattgaggatgaggttatcatgacattaagtgtgaaaaggggtattgagagcctgaagaaaaatctggaattcttcaacgctgttcatgaggatgctgaggctctggccatggaggatccagggatagattcatggtggaagaacatgagagatgttatgtttgatgtcgatgacatcgtagatcttttcatggttcattcacagaagctcttgctgccaccaaggccggtatgttgcaatcagcccttgttctctagctttgcaaagttttcatttgatcacatgattgccaaaagaattgataatataaatgaaaagtttgaagaaattaaaatgaacaaagagatgtttggcttggagagaaccaacgggcaacaaatccagataacaattgttgacagaagtcagacatctcctgtagatgaacttgaggtggttggagaagatatcagaagggctattgatgacatcgtcaaaatgattgttagtagtaactacaatgaaagcaggtcaactgtttttgggatccagg

SEQ ID NO: 44586 - DNA, 1501 bp, Oryza sativa
tgaaaattgcgtagcaacaatccaagattgtttcatgtttcgctgagttctaattaattactgatctatggttggctgattctctgatggatgcagtcatgccgaggggttggaggccggcgccgccgccggagcaggagcagagaacgggtgcaagtgcggcgacaactgcacctgcaacccctgcaactgcggcaagtgaagcaagcaacctcctgacgaaaccaaggagatggaagggcctagtactgctaagctagtagtttgatccagttacaagtgatgagttgttgtcactgtaactttgtgtttcctctgagtttgtgatctaagacctgagactgaagaaatgcatcctagttaaataagtgctaagaataaagatgttttgagacatctatggcgtgtgtacgatgatgtagtccttcctctccagtcttgtggtgtgtacgtaattaagaatgcagtgctgtgtcatgtggtatgctttctatctagtgaaactgaactagtgagttggtatactaattttgcttgtttgcttgaatgttgctttaatgtgacttgtgtcactggatgtttatcttgcttacttggatgttgctggctacacgaacttcatctgaagtttcatgctggtaaagaatctagctttgagcctgcttggactatacagtacaaaatgggctgagcctatggatttgtgtactacatgtctacatcgtgtttacttatggacctcagtgggctggttaattccttcatgttcctcgaaatgcaatccatatgttcagagcttgaaaaaaagttcacttcttgtccctcagttatggatcgagtttcatctacatcacttagctgtaagacagctattaaaaccaacgcaaatctagtcctttgtgacggcgaagtggctccctgttcagtcaaatctccttccagatatgcacggcacgaatgctcggcagagtcccaacaccaaagctcgagctcgccgtctctgagaggtcgcggcgtcacaggaggtgctagcctcgttttttctttcaaaaaaaatcatattaattaattaattaaatttaaaataattaataattaattaatcatatattaataagtcatctacgttctaatcccccaacacaccttcttaatcatttagcattctagtcaagtcaattttttcctttcgtcgccacggtcgctgaaaaggaacactagtttgtcataagatattctcacggcatgttggcagtatttgtcacttttcctgaccgaccacttgcgtttggtggcatagtggaatgtacactgcttctaatagtccagcattagcaaatgtccggcactgataaaaatacttattacaaaatccgatagtaagctatgagataaatttattaaacataattaatttatcattaacaagcaaatatttactgtaattagacttaaaagattcgtctcataatttacacataatctatataattagtatttt

SEQ ID NO: 44587 - DNA, 1501 bp, Oryza sativa
tcctcctcccacttcctcgtccgctcagccaaacttttgaccgcgcggcagtccacgaggtcgtggagggaggtattgtgcacggtgcaccacctgccggtcgggcgctccctactgggagcgccggcctccttctttttgtcgctcgcaggcctcccctttcgggtggcccacgaagcgccctcgacggcgaggacgtgaccctcgtcgtcggaatgggccgacctcttcttcctcctcctgtcccgccaccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacatggggggctggcccccgtgcccggaccgaagtggcgctccggacgaggaagcgccctccgatgcgtgggcagcacggcgatcattgcgccggcgctcgatattgaagcaggcatctggccccctacgcacatcttcttgggttggaggcgttgacgagggaatggcggacgaacggcgggtagcggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgtcgggttggagtctctggatcagggatgacgggtgggtgacgcaggagtgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccactgccc

SEQ ID NO: 44588 - DNA, 1501 bp, Oryza sativa
tatttaagtaagacaaataatgaaatgttatttttaaaagtcaatagttttaaaactgagaaaatatatgttagaataaaaaggattagaaaattttcgatgcaaaagatcagcagattgatatggagcttattttatttgtcacgattatctcttcctagttcccagcgagtggtggtgactaataacttcacaaaaatagagaaaacataaaataacaataatagcttttcagtaaacaaccattgatagagtagacatgaacctgctttatgcctacctacgaccttaccatccgggccatttccaggccattttcagtgttatcaagtgcttgacataatggcatggcccaacacatcaataagcaccatgaatttgtgatcttctgaatctcctctgtgctgcgagcgatgcggcgtggtattttgattcttccttgaacgtgcattatacacctctagcgcgccgaatgtatgatgacatattataaagaaatgcataaactttgtggaagaaatatataaagcacatgaatgatgagaatgaaatctatcccataatatagggcatattcggcaagctggttgcggctgcgcttttcggcactgtcggtgtcagctacgccgtttgcgcaaaacagacagccaaacatacccgtaatttatagttccaatattttctttctttagaaaatatttttcgataaagtttaaaaaatatttgctgaagtttaataggacatctacttttagataagccatgactaggctaggtgattgtgtacctgatctatcactaacttattagtatgtccacaagcacatatgtaaaagaatgtaaactttagtaccataaatgttataacatatattgtaaaccctacacatatcatcgccaggcacgtaaataaccctatgttggtatagttgttaataggttgatgcttgacaagtctattctcgttgatgtttttttttaattatactcattcaaaataaaatataattgatagttctgtgctgatttagtttagaaaaatatacacgaactcccaacaactcaacaaacaaacacgtacacaaccttctcaattctcactatgaactagaggccacaaaccagacgccaaactcgcggatcatacgtgatcacgccatgcatatgcgttcggttgtccgcgagcgacggacggacggttgagtcccgaagaatcgctcaatcaatgaggggcaaaaccgtaaactcactcacccccacaggaggtgacttcccccccttccccaaatcgacgatttgttcacggcaggtctcccgatgcgtgccacgtgtacggcggatggcctccctccctctctataagtagcaaccctctccgcccccctccctgcgtgtggttcaggtgctgaaggtgatattcagattttcagagtgagtgctcgtgtgttgtgcgatcagtgcccgcagttcgatcgatccgtgttgatctttgaaagaaaga

SEQ ID NO: 44589 - DNA, 213 bp, Oryza sativa
atggcgacccttctttttttgcattaaggaatcgccgtcattgagccattagctaacagcagcaacactggaaaaagcaaattaagcaaaagcaaagatgaatttaatttttttaggagggtttaattatgaatttaccattttaccccctccttgtgtggccctatataaatgagtggtactcgctctcctcttccccacacacccacaaac

SEQ ID NO: 44590 - DNA, 1501 bp, Oryza sativa
gggaccaaccatatactaagtttaatacagaatcaagtctcatatatggaaggtgttctggataagggaagagaaacaaagtcctacttgaacactacaaggtctacttgaatcgtatccatagttgcctccctcgccttacttggacaagagagcacccgaggatataaatacaagtccaccagaaggagaagggacgcacaaataaaaaaccaatacagattagcataagtcaagacaagactatagcgccacaaaagctagggcaatctccaatcttgttgagttcatgttcgaggaagtcgactactactagtcgtcgacagctttacaccactatactgatagagattatgttaggtcatccttattattgtactcgtgtgatattgatatataatagcaacaccagttccgatcaacaggagtaaagttattacacgtaagtaagagtcttggatatgtataaaaaataaatgtctctcgtctcttaacttttaccttaatcttgcgtataccttgacaccaacgactcctatacttcaaaaataccatatatggggtatagcctgttgacggattccttttctccctgctagagtagtgacacccccaccttcctatgcactaccgcctctagacttgttgtcactcgttggtattgctttcctattaccgccaccactagtgtctccgtctctcctcttctcaagtcacctaaggcccaatttaatttagatttttaaaaatattattgatgtggattttgtaaaataaaaggataagttaaatattttagaaataaaacttaataaatagcttaaaacaagatatataaacaattgatttttttaaggatagaataaatactctgttaaacagaaatgttcagttgtcctcttccctcctctcaccctttccctgccactcttttatctctatggatgcaagcaggatgggttagtgggatttttcttcttcttatttcatttctagtttattttatctaaaagttatattaccatgtgagaaatgaactaacgagtgaactttatttttttaaaaaaaatattatactatcatgtgagaaataaattagcgagcaaattttatggacttgtccggttccctactccatgaccagtcgaaggtcgacgatgtttaggccccctttgattcaaaggaaattcatagaaatttttagagaatttcattcctataagaatttttcctatatagcctttgaatcaaaggaatggatcttatggaatcctataaaattcctatggattgcctaatgccatgtaagttttggagaaattctaacatgaggtaaaacctcttagaaactttccttttgagtctttatctctcctctaattcctatgtttttcctgcggtccaatcaaacggtcattcttgtattttgcaatcctctgttttacacttatatttctatcaaaatcctgtgttttttctattcctatgttttcgtattcct

SEQ ID NO: 44591 - DNA, 1501 bp, Oryza sativa
aatagttgcattgggatttgataaaataggagtattctagttttttttttgttttttatgatatgcgtgtgattgatgaaaaatgaacttattttgggatagaggtggtactaaattatacgaaaccatatggcatattctaaagggtaaagtccaattatggcccttaaactttgctcgaaatccatttttcgccatgaactataaaatcgattggcgttcggcctcaactttcaaaccgaataaatatcaccctgaaacatatttttcaatggctttgtttcaaacaagcaactacctaccacaacaagcaactactcgtacgaaatacgaagctggggagaaaaaaagcagtcaccaaccgtcgtcagccagcacgacgccgctggcaccgaccgccgaggcgacgtcgacgcgctccgcgacgagcaggtaggcgcggtccccgaccgacgccttgagcgagagcgcggcctcgtagacgcgcccgccgccctcctccccggcctcgagcacgacgatccccacgccccgcgccacggccgcgaccaccgcgtccccggaggccagcgcctcgtcggcgccgacgcggaggacgagcgccgggacccggatctccggccgcttgaacccgcccgggaacagcgtcctcggcggctccctcgaagaagcagcaccgccgcccccgccggacactccccctccggcggccgcagcggcgccaacatcgcggaggcggaggcggtggcggtggcgcgggaggaggagggagcgggaggtggggaggaggaggaggccgcccgcgcgcggcaaggggaggccggtggaggaggtggaagcggcgaacatggggagcgacagggatgggactgggagagcgagctctcgcctctcgcgcgcgcgggcgcgtgtggacagcggagagtggaggtggaggagaggagaggagaggagaggggggagtgggaggtagagccgcgcgtggagtggagtggaggggatatggagttttctcgcggatttggttggatagggtgattgcggagcaccgcccggcgcccgcacgggggattttcccggtcgcgctcactcgcacaaaccgtttgatggcagtttccttcaaaaactagcgtggtttaagtgacaggttttttactggagtttaacttccggcttgtgcaaaatgcgtcgggagacatgagtacgtgcactaaccagatattttagtttactataaaagatgtctatgcgttacaacggatgaatattattttaatcttattattgttatacggtttggctatggtaaaatttactgtgagaattcgcttggatattttttttctagaaaatcatgagttgtaattaggagtctgacactcatcttaagttagtatgcaaatttttttaaagagatttcttatacgactccttttatatttctaaaagcaaacgaacttaaaattggactcaaacatggatgtatatttctaaaagcgaa

SEQ ID NO: 44592 - DNA, 739 bp, Oryza sativa
agggtcgatcgtggccggggagaccgcgatttcaccggcgggtggggaggggtggggaggagagagaggtgggattcaaaaattgaatcccggccgtctcgagcgcgggcgcggacgggagagagagagggggagtgggcgcgagggcgacgttgcccaggagacgcgggagcggggtgcggcggcggttgcggggcgcggcggcgccgactggaggtgggagacgggcccgacaggtgggccccacctgtcggcgacccagggagagaggaggggggctcgggcggctggctgggccgtggccttcggccggcccagcggggagggggagagaagagagaatgggccggcggcccattcgaaagagaaaaagggaaaaagaaaaagaaggaaatgaattttcctgggattaaatattgcttgtgctcaattttaattggttaaaattatttctagagctctaaaaattccactaaaaatcttgttagcgtatttcgacatgtagaactcaagaaaaaattccacatgccaatttcgattattatttgcattgatttattagggtttactcttgcttttacaccagtattttcttgagaccatttataacttcaatttaggcttggaaaagaacttcagggtgtgataggagggtagttttgtactttcgcgtttattccgcatcacgcacgcgcatctcttcctcctttgtcgctgtttccgcatctcgccgggcagg

SEQ ID NO: 44593 - DNA, 1501 bp, Oryza sativa; identical to SEQ ID NO: 44535

SEQ ID NO: 44594 - DNA, 310 bp, Oryza sativa
aaagttaaaagtttgatgaaaaagtttagaaataaactcagcctataatacaaattgcagcaaatgtatgcagtgtaatctatgcacaaccgtactagctaatactcatggttagcaagtcgtcatagggaggaacatgtcttcaagagattcaacatcttaatacgtgatacgagtagagaccgcaaattgttcaaccaaaggacatcaccactatcaccaaatgctatcagctgtgtcctttttaaaaattttgtcatgaaccaataaatttggcacttgtagttatttattatgttttggaaaatag

SEQ ID NO: 44595 - DNA, 1501 bp, Oryza sativa
aactctctctccctttattgtgacatcacccttcatttttaactattcttctttatttgcccaaagaaccataaaagtattttttttgcccttggtagttcacaagaggtgctctctcatggcaaatattttgttatcacttacaaaattcataattatgatgcttgatgaagagtgtaattgaactggtaatgatgcaccaactaattattatgatctcaagaatttcttaacacctttttcattattaccctttttattcccatatggtatgagggtaccacacattccaaataaattcataatctgcccttttttttaaaaaaaattctcattaatgaaactaaaactgtatgttcataattttattcatcaatatgtgttgtttggatgacacatgttaattaaagaaaataatactattacgatttttttaaaaatttacatatgatgcaacgaataaaagatatacttatgataccatatcccaattttatttttttccgtttaaagaaaataatttattagattctactattcatgcaggggtaagatgggcattttttgaaaaatttaaatgaagaaccactcaagggcaaataaaaaaagttgagaaaaaagagacaataaaaggggagccaattttatgagggccaaatatactattataaaaattaaagatgtttttgccggtattttggtacgtcatccgtgtatgagtcggtttttaagttcgtttgcttttgaaatacatatccatatttgagtcagtttttaaaatcgttcacttttggtaatacagaaggaatcatataagaaatatgtttaaaaaaactcgtatgttaacttgagacgatcggattcctaactgcagctcatgattttctaaaaatatatatatatccaagcagactcccacactgaattttatcttaactaaaccatataataagattaaaatagactttacccgttgcaacacatggacattttttctaagtagagaatacattcaataatttagagggcaaataagtaattatctcggaatccaagattatgtttaaccgttaccaccatttactttgcactagagtacaaaattctctaaccgacctagtaaaaacacagcttgtaataacatcaaacctacagggtcccaagtggaaaactcccgttgggatttttacatcccaatccctcccgctaccaacaaatcccaaatcccccacgccctcacctcacctctccagattcggaggggccaaaatcaaaatccacccgccgacctcttcccctcccccctctctttccctctcgccgccgccgccgccgattcccagtcgaaccggcgccgcccggtgctcggaggccgccctccgctccgcccgccggcgaccatggaggtgagtaatctgtttcgagcgcgttggggttttggggtagtcagcgagcttttggtctcacgccgagatggcgcttcctctctctttgttccagg

SEQ ID NO: 44596 - DNA, 1501 bp, Oryza sativa
ggacggcagttcagtaaaacctaccagtctacttcgtataccacgaggggattctgccgaagtccaaggagggctacccaactttcaccatcctagcgatcatttgccaatcggtgccgattttcaggtactcggcagcgaaggctgattgcattttgcacggcagcaacaaatgtcccctgggatcgttccccgtgatttgtttggatttattgtagaaacagtagcaaatttattaatatcaaccagaatttttgttacatggtctacacattggagggtatttgttattattatctttaaagtttcactaccaggatttcataggactaaagtttgtagctagaccttaagttccttatggagttatggtagtgaagggctcagatagcagaccagatggaggatggatcttgcaccatatcatttcttctggcaacactcgtcaacttgggaatcataaagaaatgtgctaattttagttagtcgtgtggacacaaaggtaggagccaataacacttttaagatgcacaaaacatttatattgtttcatctacaaaaaacagattagcatacacaaaaagaatactagttacatgaaacaagacttgatctatagaagaatggtaacacaaatataggtacaaatatgccatctacactgaacatgattctcgacaaacactgaaaacctctcgaggaacctagtcttttaaattgtgtccaccagctatgttctgattatgaaaccgaactatcggcaaatccatatgatcccaaagatgactgtaaagtataacgagcaccagtacaacctcatcgaatcctataggtgaattctattcttctttcttctccttttctctcctctcttttatcaatgaggagaaaaagagtggtagcattgtgcatgcagcctcaatcaacagacaagtcggcagcgctgagaaatcacctccagatactcccatgaattcagcaagtgcaaccccaagataaccgctgatgatagttgcgagggcaagtgcagacatgacaaaagccataagtgatccctcacacccagaagggcaaagttttgcaacaagaacactgaagggcagcaccttgaacaacataagaccctccaacaaccctgagaaaacaattgtgtacatggaatccggtattccgaagtttctgtatattccctgaacaaatagtacatctgacagcattacgagtgctgtaagaaactgcagaactgataaaaccttctgtgcaggtgttgttttgaagtacttgttgtatgccacactccaagctaatagagttacttgtccaaaaaccttggacaaaccgataactgatgagtcaagtcttaacacttcagtctgatagaagaacatggtcccaagtagaaatggtatggcagcataggacaatgaaaaccaaatgactgaccaaaatatttcaggcatacacagcgcatatgacagctctttgatttgcttacggacgc

SEQ ID NO: 44597 - DNA, 1501 bp, Oryza sativa
caattagtatatatatatcacgcagcggagcgtgagccgtgcataggtttcacaaatatatagcaatatattttgctagagcaaagcatgtgtcaaccagccattatcctgggcgaaaggaggacatagaggcgagggcattttggtccggagaaaaactaaaagagagtaaaaacattagtactaaccaaaaagatccaaaatagcatttcagtgaacacctcttaggctgtgttcgggagtgagggttgggaacctcacttcctagcacggaaaacggagtagcgattagcacgcgattaatttagtatttgctatttttttttcaaaaatggattaatatgattttttgagcaactttcgtatagaattttttttttgcaaaaaacacaccgtctagcagtttgaaaagcgtgtgtgcgtaaaacgatggaggaaagttgggaaccatgggtatagaatgcagccttagtttagaatagcattttaatgaatcactttgaagggatagtattccagcgaaaccattcttttgcgatagaaaaatcacaattttctagaaaggaggagggagaaggagactggtacataaggtggagaaatatttaactatttgccactattacttgtgacaattaaggatttgctattggacccacatatcatagacatgtgagggctcacatagattgtgaataacaaattcctaattgccacattttaaaagtgacaaaaagttaaatgacccagaagctgaagggagagggaggaaggagaggtaagggagaggatgaaggagagggactcagctggtggattggtcaaggactcctcttttattatgtcgattttttttccttacgatcctctttatccaatgaaaattgattttttcgcaacgatgacttaatagacccgtttgtaaaaacactctatttttacaagtggaccttttaagtgactgttagcgaaagtcgattctcactagcggttcatgaccataatctccaaaatgtattttcacaagcgtgtgtttttttaacccgtcaataaaataaacggacggtgatatgaaaaatggtaatttagtagtgacataaattttgaactggctacaccctaccagttcattaccaaaattttgaccagagacaaatacgccagttgagtcgcactcaaatgtgtgtagcacaagtgtgacgtatgcacgtgtatttgacttatgctcggggttattaaaaaaaaaacatgcgccaaactcaaagtcggtttgcgtcggttcccggtttcccagcactgacacgaaccgccatagcggagccacctccacgtcgaatacgtcaaacacaaacacggtcacgcacggataaagcggccttggccgcaccaccgaccggcgaccacaaagcccaagcccgtaacccccttcgataccgcctctcgcggcaccgccgcgccgccgccgcaaacgaggctacggaggccgaggccatggcggcga

SEQ ID NO: 44598 - DNA, 1501 bp, Oryza sativa
acaaaggttaatttgtggtcttggcaatcccttgaggaagcatcatagtccaaaatatcactggtttgtgatgcaagggactcccctttttgtgttcgtattaagtgcagcattatgttgagtacatatacacacacacacacacacacacacacacacacacacacacacacacacacacatatatatatatatatatatattaataattatattaattaattaattaatttgcactatggttatatatacttggtgtcggtggcatgtgagggtagttattttttgtgtattactaattgttacgcacaaaagtagaatttggattgcgactactttattcttacatcatagattcagaaaaagcctcgaatatttgtgttttgtactaaatcaattccaaattagatgtcatcttagacaattcaaacatgaaatatttgtgggcgccattttatgtagaagtatctcactaacattatatttctttcgtccctgaatttcatatttctttcgtccctgaattttaaactccatatttctttcgtccctgaattttggaaaatgaaaaacgaaattgcaaacccctgctcaagacttcattgatgactaataagaccataaaatcaacgtagccctatcttgtgccattggttttcaaatatcaatttgatatgtctatggtttcttaattgccctccgggatccaactctattatcaatttgactatatataatcatatacatgatttattatttggttattgttatcgttaagtacaaatgaatgtatataaaaaggtcctggacttttgcagaaaatggagtttgtaacttaaaactaagtgattgacaatataatatcattatcaacatgaacaaaatgtctcattcccctaatttagccgcaactccaactccatgatatttgtttttttaagttagaggtacccaacttctatgtttctttaagttggctggagctgtacttaaaaagagaaatgcactgtaatgacatactgtattaaaaaaagttactgttgataaacatttcaatcttggtcaagatatttttcctgtcccagagaattgcagtacaccatgttagtttccctaacatcattttctttgtttagtaaactcacttctcaagctcggtgaatatacaacttatacatctaaactacgctgcagtttgtacgaaggtttgtttaaatttattatactagaaatcgtcatgttcatcttagattagtttttaggggatggagaaaacacaccacagtgttaatttcattaaccaacgtaaaactcgatttctagaaacgtcaatcttagatcgatgtgcataaatgacgctgtcagatcaatgtacaatcccacggtaggacccggccgctcctgatagactacaagtccccaaacagtaaagcatcaactcgcacagtgctacacttccttcataaaaaaaactcaaaccagaaggatatgtgtcacattc

SEQ ID NO: 44599 - DNA, 1501 bp, Oryza sativa
agcaaagttttgaacaaaggaaacccccaagagaatgagaaaagaaagaagagaaaaaattcactctagaagaggaacaaggaattggacgacccttaacaagtccaatgcatgagaactcaaaaacagttctctaattatgctgcaaggtggtgatctaaagagtactattataacttatacatctagagtacttcccaaagccaaggtagggtaattaaccaattaaacacaccgattaaaatgccgagatgagagagagagaaaaggtcccccatatatgttcttgcaccaccacaccgccatggatatgccgcaagaacttcaagctcttctcatgtatctatccccccacaccgtatgccctatatacaaaataagctactacataccacccaaggaaggagatcaagaagccaagaagccaagtagagctagctagctagcaaatcaagtagtagcaacactagctagtgcacttacactttctttgcttctcttctcctcccatgattttgttgatctctccttccttcttgttcatcaatgcatcccaaattgatcttccgctcgccgccgcctttccaagatcatcgaccggccggagacgaggaagaacgcggtcggtagtcgatctgtgttcttgatctccttcttgatcgaccaccggcgatgaaatcttgcaggaattttttttgggttcttcgtttggttgttgaattggctgctctagctagctatttttctgcctatgagatgatgatgatctcttctcttctcttctctctatctctctccacagtgtgctctctctctcatctcagctttttttttccccacaaattacatgttattttttagtcaagagatcgggaaattaactcagggaaaattaaggtggaaaaaaaatagagttaacgacgacggcgaacggcgacgagctagctagctagctagcacagtcggcggcgtggaggcggcgcgcgcggcaggctgggctagctagaagagcgtcgctatggaggatccgcagttggcgaggtccggccatgccgcggcggcggcgccaatgccgccgttgccccagtagaggagcgactgcgcggacggcgccgtggaggcggcggcggcgctgaccgccgggttcatcgacgcggccgcggcggccatgagcgcgtccgacgcgatgatgctcgcctcgacgttggacgacgacggcgtcggcaggtcccagctctgctcaccggccgccgccgccgatgacttctgctggtggtcgccggtggtggcctccgccttgacttggagctcctcgagccccggcacgatggagccggacaggagcggcgcgtagaagccgtcgaggaggccaccggtggcgccgccgtcatgcagccacggcttggccgcctggatctgcgcccccgcggcgccgtagccgaggccgagcaggtgatccacctgcgactgatgctgctggtgcatctcgaacgcggccgcg

SEQ ID NO: 44600 - DNA, 1501 bp, Oryza sativa
catgcgagctacagaggtagaaagacatgcatatggtgatttttgtaataataagatggatgcgagatcaatgggacaagtgttctcgaaaaagatggagagccatgacaaataaactatagctagctagccaattaggaaagcaaagcaaagcaaattcctagaacacgacattattccatcacctagctagctaggttctgaataagtccatcacatatccgaccttcatgctaattaaataaattaatttgatacatagatagatatatgttctcactagctagagcttatatagtacgtacatatatgtgctagacgtatagatagcttataccggttatatgttcctaaaataatttctcaaccatgtaagatctgttatatatactagatgaagttcaacattaattttaaaaccatgtcagtaattaattaattagtaatgcaaaacccatcctatttcagaaggctaattttctttcagtgtcaaataattaatttctttcactcatatgtaaaaaaaaagggtgatttttaaggtaataggtgttggcccagaaaggagatacttaaattcggcgacatcaagttcctttgtattttggattttttaaaaaaatgcaaagtcatttttgacaaatgttagcctagaagtaaagaaatttagcacattggaacaagcatcaaagtattttttttaaaaaaaaggaacaaactaaactcagatgagaattcataattaatataactactataattaagttaaaacacatatatagctgaagcaacaatatttaaaaaaaaacgaaattccaaatcaaatcgttttcccatttcccccatatgcatgcatctccacataaattgtctccatttgtccccccatttaattgttttgtttctatctacctttccctttcctgagtgatatgtactatatatatgtaattacctagcagttggtgtgaacatagccagcatgcatcaaaatgcgtctccgagttgctacgagacatgcaggtaagaacaagcaaagcagccatgtttttggcctctccagcagccaagagcatgcacaaaaaaagattctgaccagaagctagcaacacctccatgatactagcactaaatttgagtacatcaccactactggagaatcctatgatccatggcagaaaaaaaaaggagagaaagaaacacatccatgagaagaagccagccagcgcagaattcaaagatcagatcacgcaacaccgtcgccatgaaaaagagagctaacaaaggtgttaaagctgcaagagcatcactaaagtgagacatgcatccatccatgcactaaaagtgatggagtaactagctagctatcacactacatatatacatatatgtatctggagtatccatgtgtgaagagaactataatcctaggtacacacagaggagggatgtatatatgagcaaattaattaatctgtgaaaagaaattcacaatatatat

SEQ ID NO: 44601 - DNA, 1501 bp, Oryza sativa
tctggttagtgaattagcaaaatcatactagtttatagcatgtaccgtggttcttctaggttgtatccatctgtgtatggatgcaacgtgtttgcaatgcttttctgatgaaccagtgcaattcggtccacaagctacacgcatgctcttgatggttgggttattgatcgatgagtgaaattcttggtttgcggcgtaatcttgttgtttgtaggtgacacatctgaggatgtaagtgttacatgcagattgtggacagtttgaagaattgtaattactaccctagtctccattttttgttgatacttgtagcagcatagcatatctatgtcttattctttgttgtgatgtgagaagtttataagctacaatatccacaggaatatcacgatggccgtgttgatgtgatattgcgacctagcgatataatatttgttcagtcatggcttttagtttattgtgaatgcttatcagatcacatggactgttattctatttctgtcccagacattcttttatttagccattttctgcagtctaagtgaacccaacacaaaatgtatactacaatattgcaaaaaacaccacgaaaacatgcataattgatgtgacaaaattctgagcctttttccatgaatggacgcatacctcgccatgtgccggagcatgatttctattgcaattcattgttcgtcttctactcgagatcagaagttagaaccttagggatgtgaataaggagccgtgacatgaaaagttttgtttcatctcctggtttggcttttcagagttaaattgttctgtgaaactaaatgctgtggaaagaacagcatgtggtgcattgagtcacctaagtgaaactactggtgatgaatgagcgagacgagttattttatttctctttctttcttcaccattaatgtagtcaaattgaattaaccacatgtattaccagtacatttatgctgaaaactgtctatcattatatgatagtgttcatagatttttcaaatttatcacactagaaattatctgccaaagtagtattttagagactttgtcaattttgattactgctccctctgttctttttttcttgtcatttagggcatcgacacaatctccaatgcacttgttttatcattgccctttttgcttttatatttacaaaaatcactatgtattaacaaataactaaatgaaagtagttttcatgtgaaatctactaatgctattttcacatattaaatacaaattagtttgtgaattaaattttgaggttcacttattctaaaacaacatctagaaatgaatgaaggcagtattttggtttctatgttgtcatgcaagttgtttgataagtacctctcattggacattgatactccaaatccaaacatcatcacttcatatgatgcttggacgatgaggtgcaagcctcattctaaatgcatgagtatctgaactctactgatttctcaatcatgcattttctttcagg

SEQ ID NO: 44602 - DNA, 1501 bp, Oryza sativa
actataatgtaattcctccactaaactaatatttgaatatcttgcactagactccaaccttttggaatggtactatttcaatgaatataaagtctattgtgcttgtaatattattcaaacatatgtatcttgttgctggaatgtgacatcctggctcaattaggatttggcatgtgcgaccatgaaagatgtgtgcgcatgtttatattgctagcttagcaagagttgaacaaacttacaagggcttgtccctctaaccatatcactctcgggttaatccttttatatgaaacaagaacgaaggtgtaagtgagcctgctcatcagatgggctgggctgcgcggttttgaagagtgtgttgtacgtacactaagagggggtgtgttctcggacatttagatatgcgggtaagttggactgatagagacatcaggtcttttctttgggtgggggatgtgacattctaacccaattaggatttgtcctgtgttatccatgatttgtgtgtatatctttagtaccatatttcaattaggatctgacatgtgttacccatgagagctgtgtgtacatgtttagaaccacattactagtttagcaagggcaaagcctacttataagggctagcccctccaaccatattactcatgggttaacccttttacacgaaatgaaaacaaaaatgtaagtggggtggtatgtgtaagtgggtccgctcgtccaatgtaggttgggctgcacggttctggatggtggtctgttacatgaaatgtgattgtttcgttagaaggcactatggtatcaagatgtttttactaacgtgtggtagcaattcaaacaactaccacaacttacttccaaacattttttgtggcaatccaaacaacaaacggattgattttgtcacaccttagttgcgaaacaaacaatctaattttgcaaaaaaaatatggctagccacaacttagctaatacttaaccttagacatggaaatacatatctcaaaatcaaaatgacccgatattcgagaggtgggtgtaatatttttttatttaaggtgggggtgtattaattgttagatattaatccacgtcatttgatagccggatcatcaatcttgttctttactaaatgatggttatgttatggccaaatttgtcacaataaatattgactttgtggatttagtttctagacatggcagaactcaatctttgggaaaagacactcttaaaatgcggctatttgctatcggacacaatggtcactaaaatattaatttttggttgagtaggtgataaaaatagagtgaaatatcctcaattatgaccttcatgtgagcaaatcatagaaaaaaactgaataaattggtttgaacaaatgaactagtatcttcagatccaacacatccatctggtgcatttaatcaacaaattacttccaaacccaaagagtaatatatgctcaatcaactcattaacttcagatctgatgtgacca

SEQ ID NO: 44603 - DNA, 1501 bp, Oryza sativa
agggaagtttgttgatattaggatttcattatacgttttctttgagtgttgtttgaacttgttgagacgatgactgtctttttagatgcatcagccaacgacaactttcaaaattgtgttgtcatgctgaagcaatcaatagatttttcatgctatatgggtttgatgaggcaaagaggcagtttgtggctacctggcagtgcaggagtatcttatgattataatgcgcttagtatcttcttaaggataaatgaagtataactcttatagtcttgttgtatacacgtatacaatcatcggctaaatgtaagtatagacaaaactgccatcagctaaatgtttattgtacaaccaaacggaggaaaacgaaaaaaatggttatatacaccaattaccatgctatgagctcatagtcttgctatatttaatctattagactcgctctaacgtggaatacaactcatgttatgattgccaaacccaacttagataaaaacttccaatttgggatgttgggcgatgccacttggattaatgcgaaaatccacgtggaatacaactcatgttatgattgccaaacccaacttagataaaaacttccaatctgtcgtcaccagcaagcacaaattgggggagggggagggagaattaaagatgggaaagaagggtattttggtttaagaaaatattttgtcaatgatgagcgtttgagagtagtaaattaacgaaaccaatctatagagtgatatattaacgagacttacattttttacaatggcataatttcaaatttctctacaaggacatgtacgtcccctaaccttctcttccctcgtcttgcactctagcggttacaatggtattgctagattacaatggtattgccgtaccctagctcctttgaggccggagcctgacattattgatgaggaatacaatttaccgcaactttaaaataggtcaaatgtacagttgacccaaaagaaaaatactgagaagatacataacgagatgagccattaacacacgattaatttaagtattaattacttaaaacttaaaaagtaaattaatatgatttttttgaagcaaatttatataactttttaaagaaactatcattcaacagtttggcccgtgaaaatgtatgaaaattttcactcgattgtatcagtagcgacgcaccctattttttagcattttgttgtttacccatatacccagtgggtatgggtaagattcggtgagggctgggctaccatgggtatgggtatgggtatgggctgccgtgggtatacccataccctctgcaacggctgatccgtacgcgaaaaggaaaagaaaaaggaaagaaaaacctaaaaaaaatagctgataattaaaagagaggaaaaaaaaaactcgccccgtcgttccctcctcagctcctctcccctcggaagtcgaaaccctaagaaacgcgtagcgaaggcgaggctcccgagagagagagagagagcca

SEQ ID NO: 44604 - DNA, 1501 bp, Oryza sativa; identical to SEQ ID NO: 44533

SEQ ID NO: 44605 - DNA, 1501 bp, Oryza sativa
gtgttacacatccagataaccataaagctttataatcccgtgcgttcacttgatctagcgatttaggggggttccctaacctcatacttattcctaactactccctccgtttcaggttataaaatattttgactttgttcaaagtcaaaatgctttaagtttaaaagtttgtagaaaaaaagtagtaacattttcaacacaagacaaatttattatgaaaatatattcaattattgatatgatgatactaatttagtattataaatattactatatttatctataaacttagttaaccttgaaatagtttgactttaaccaaagttaaaatgtcttataacctgaaacgaagtaagtaataactgtccgcttaaactcactgaatggggccttggatactccacaatccagatcattttgcccgacaccttggtctcaaaacaactatatagaccggtgcaaagtgactatttgcaactaaacgcccatctacttgttgcaaatctacttctcccaaacatcctcctctaaaaaaaatttaaatatacttatcacttgagcgctgcgaaacctacagagacttgaacgtaacgcaaacgtttgaacaggtcgaccgcaggattaaaatcgaacggtcaatactgccacgcaacaataaccaccagacaaagatcggacggccaggaaggaaccctagcacccgtggctgcctatataagaggcaatcctctcgccctaaccccctcctctctcccatctcatcccagccgccgccgccgcagcctcctcctctcgccatctcccgtcctctccttcaaggtcagcttcagatcttctcacttatccttgtttgcgcctgttcatgatcgttcgtagctgcagatctggtttggtatcgcgaggtttgggtgatttggtgcttgggcatgttgttttcgttcattttttattgtgtattcgtctcactgctgtgatcttagtttgatgtccgttgacgcgaagataaacttgatttgtccgcgaatcatgtgcgtatgttggaaattatcggtagaatcgaacgataaacttgagttactgcataatcatctacataagtggaaaactactggtagaatcggtagaaaatctgtatctagaatccataatttgttgttaaactactgctgagtagatgttgttattgtccgtgccctgttcagttgggtactgaaattctgtatctaaaatccaatccgtaaatttgtttctgtaaatttgttattgtgctactgctgagtagatggtgttattgtctgtaccctgttcggttgtgtcgattactgcgcgtctgtgtaaatctcatgctgattttgatggctattaacgttctgtggatgtccaagtgatctgatctgagatcttgcctgtgatatttatttggagttaaaaattatacagaaaattgtttctaatctttgttttattacgtagaacagtcagctacctgcttaatcaacca

SEQ ID NO: 44606 - DNA, 1501 bp, Oryza sativa
attaattgcttctgttactgtccacatttaagtgcctccatgttttttgtaaagcctccatattattacacatgtatcaccataaaaatggaaatgaaggtatcttggtagttacctacctaccatagaataaatcaagtttacaccgtaagcatatactccctccatcccattatatagggcgtacctgctctagacgcacagaccaaggattttcaactgttccgttcgccccgatacgtgaagttttgcttcatccgtggaccttgatcttcacagtgtgtatcccagcaggccacgcccacgtattgctgggagagagaggccttttaactaagagcaggtacaatagcaggctataagccagctataaacatattttaaggagataaaagaggagagagaagagcagcgagctacagatttgtagccagctgtagcacggactccaagacgcagtgtgtatgacaagtaggaccatatattaatagtgtagtatgtaactattgtacgaattggctattaaattgactatagatgatttggagctagtagttggctatactattaaacttgctctaagagcacccgcaatggtaaagtaaggtgctatctataaaacatgtacatctcagcaatagactagaataatagtaaaccatctcaatagtatgtctacatgggtatctatagctctctaatacattgcctcgtttttctctatagactatctccaggttagtagatagctttgctctctctcttcatttaatctcttctaagtaggaaaatatgctgacatggatctcttatagagagcctatagataaccattgtgggtgccctaagcaaactaatcagcaataatgcatgcttgtaaacggaagccgaggaggtgatgtcttgaatgcttgcatgcatatgaatggaaacgagcaaaacttaaatgcttgcatgcgaataaacggctgtcgaggagatgccgtcttatattgtgggatttgagtaaaatacaggtacaccctatatattggggtggagggagtggtgctgagcaagaaaaaaagagattgctttctctcatagctttacttgattgttcctgttcctgttcctgttcctattttttctttttctgaaaaaaatgaattttagaattagcatgcaatattttcattgcacgagaaaaataataggtgcttagttctttgtcatcggttcatgcatgccacatgacacctcttatcttgctgtatctatatctgcccatgatgtgctagtttgtggtactagaactaagttcaagcatacatcttttagggtatgtttggatcctaggcaagagaaatcttatcctagcttagcaaggacagcagtttgctaacgacaataaaaatcttacttctgtgggaaagcttgcctataactgcccaggaaagcttgcccagcttgaaggacataaggcacttctgtgtgacagttgatgcatgctaggctacaa

SEQ ID NO: 44607 - DNA, 1501 bp, Oryza sativa
tatttaagctctatttaaatttagatatggtttatgtccaagttctgttgaatttcaacgataactgcatagagtatgatttccctaaggtgcctaattttgtgattctaacaagttctatttcagctcattttggagctggcatctatttacttttaattttacaagttttagataaaaattaggatatttatatgctacatagtttttagaggtgtcctatgtagcataagtgccagattctaatctacagttataaagagtagccgtaacaaaatttggttgttcttaattagaacttaggatgaattccttgcgagtattacaaggctctgttcgcaagaaaaggtttccaactcaaacattacgtatggaaaacggaacagtctattagcacgtaattaattaagtatttactatttttttaaaaaaatagatcaatatgatttttttaagcaactttcataaagagactttttttttataaaaaaaacgcaccaatttaacagtttgaaaagcgtgcgcacgaaaaacgagagtagggagttgggaaacagctcttgcaaatagaacctaagtctcggtacatattatagtaattatttactacacagtacttagagggatttcccataccgaaagtgcataattttagtttacaatattaacaagcacaatttgtttaatctactgagatttgattcatcctatttggagctaaaatgaaatttctatcaatatataggctgaacatatttttcagctgaacaattaaagctttagctactttcattatattttccagattttaaaaacatcggtccacctgtaagtgagagccaatatgcaaaaatgcccctggttttcacgaggagtcaactttgcactccctcacgtagtcacgtatctatgccaggttttaaaaggagtccctatcttcttttttatatctagggggtatttagatccagggtgtaaatttttggtgtgtcatatcggtattatatagggtgtcgcatggggtattcgggcactaacaagaaaaactaattacataatccgtcagtaaacaacgagacgaatttattaaacctaattaatctgtcattagcaaatgtttaccgtagcaccacattgtcaaatcatgaagcaataaggcttaaaatattcgtctcgcaatttagtcgcaatctgtgcaattagttgttttgttagcttatatttaatacttcatgcaagtgttcaaacgttcgatttgacatagtgtaaaattttgagttaatcagatccatgctattacaaatttatctattcagaaaaataccactacaattcgtatatttatagccgtgacactgaaattttataaaattagaaccgtgccactaccgtaacgttttccttccatctcctttgttttccgtctttcttccttcttgttctcaacgacctcagctgttcttgtgctcatcatcccaaccattattccttctccaaaatt

SEQ ID NO: 44608 - DNA, 1501 bp, Oryza sativa
aattgtgcgcgagtgctgtgttatttattctgcctcaagacaacatcataacataagccgagtaaaatgaagcgttggttcatctagtttgtgttgtctaaccagaaaacaaaaatgtcagctgaacactgaagtggagttatcggttgcgtggacttcgccccgattttgtcggttctgtgaaaccctgtatgttgtaggtgttccacgtatgcaattctgtaaaaaaaggaaaataaaaaaaaagttgtatgtaatgtgatgttagactgttagtatataataatattatagttactgatgagtgtagatgtttgctattgctggtagtcgcctcttgctctcagcagtctactcgttaccgtgtgttgatgttgtgaccttgtgatgctgttccagttgaaaccctcagcgggcagatcccttcaagcacggctcaattggatcagcaaatcaattagagtagatatgtgttgctgatgatcagcaaatcaattagagtagatatgtgttgatgttcttttctcaacaaagtggccgtagtttagtggctcaattggatcagcaaatcaattggagtagatatgggttgctgatgatgttcttttctcaacaaagtggctgagtagatatgtgttgctgatgatgctcgtttctcaacaaagtggctgtagtttagtggtgagaattccacgttgtggccgtggagacctgggctcgaatcccagcagccacatttataaattttgcttttcaattttatttcagttttggaattctaatattcgtatttttcatctcagtctcttttaacaaaattccactacatctatcgcataataattgtatttctatgatttaaatgtccccaaataattatccaatagagtactaatgtcatttcaattttggaattctaatattcgtatttttcatctgtctcttttaataaaaaaaattactatacatctatcccataataattgtatttttaggatttaaatttatccccaaataattatccaatagagtactaatgattccattcattacttcccttccattctgacctatacactatttaataagaggcattatggtttttcttctcaaaccttaacactaacaacctagaattataattttttttggacggagatagtattactttattttttccgtctattttctattgatataatttttaattagatttaatggtattataacttttatggttttaaaatatattattagtattcacctatttaaagctgcgtgccattataatttcaagaccattgaataccatgccaatataaaacaagcaggtctataatgtgcgttgaatttctcccgtggaatacgctgttttgacaatagtacgttactcctgtaaagttcagaatgaaaggtggatatccctgtaagcaaatattagcatgatacttcattttaacaacgcaaaagaaccataaacaaggataacagtcttcgtttc

SEQ ID NO: 44609 - DNA, 1501 bp, Oryza sativa
tgataggacgaagacggtgatgctacggagtggcacggttctaattttagaaaattgtagtgatatatgtccgatttcgtgaataatagttgtatttttctaatacggtatatttgcagtggcatggattcaattaacccattttataaaaaaaagactgtaatatattactttctgaaagcattttaagtattttattgcaagctaaatttcaaaattctcaatttggataattgggaaaaaaatgtttgaattaggccattagggtacctacttgcgctctgcgaaacctccagcgacgtaaacgtaacgcaatcgtttgaacatgctgttaccgcaggattaaaatggaacggtcgatactgccacgcaagagcaaccatcagaaaaagatcggacggccaggaaggaaccctagcacccgtgtctgcctatataagaggcaacacggcccaaaccctcgtttctcccgtctcaccctagccgccgccgcctcctcctcctctcgccttctcccgtcttctccttcgaggtcagcttccgatcttctctcttctccatgtttgcgcctgttcatgatcgttcgtagctgcagatctggtttggtaccgcgaggtttgggtgatttggttcttgggcatgttgttttcgttcattttttagtatttttttgtgtgtattcgtctcactgctatgatcttagtttgctgttcgttgaagcgacaataaacttgatttgtccgcgaatcatctgcataggttgaaaattatcggtagaatcgaacgataaacttgatttgatgtggaataatctacataagttgaaaattgtcggtagaatcagtagaaggatttgtatctacaatccgttcgcttagatctcttcctatgtttctgtatttttttattctactacggctgattagatgctgttatagtctgtagcctgttcggtccggtcgattactgcgcgtctgtgttattctcctgccgattaactgatttagcactttgatagttgtcgaagtttgaattaggtacctactttgatagatgcccaacttttttgtgtgtattcgtctcactactatgatattcgtctgctgttcgctgacgcgaagataaacttgatttgttggtcaatcggtagaattggatgatgaacttgatttgttgcataatctagacaagttgaaaaatatcggttgaattgttggaagatttgtgtctataatccgtttgcatagacctagagcttagtttctgttctgttttttattctactactgctgctgagtagatgctgttatcgtctctacctgtttcaattgggtttattactgtccgtctgtgtaattccttcactgattttgatgcccattaactatgttagcactttgttagattaagtaacctgatctgtgagcttacctgtaatatttatttgtttctaatctttgtttcattctatgccgcagttagctacctccttattcaacca

SEQ ID NO: 44610 - DNA, 1501 bp, Oryza sativa
catattggtttaatctaaatgcatatatatgcagtagacccacccgattccttttgagcaaatgcaatttcaatttactaggcatttccatcagttatccatacacaaagattagtcttagaatactacaactgaaagtatctcatgtatttccgcagcaatatcaaaccacctttattttacttttcaacgatcaaatcctatatgatataaattgttataaaccccaccatcttaattatttgtagcttttttcaatagttgattaaaactgaaaattatacaagtgtagctattatttcttctaacatcatacaaaaactcccgcaacaacgcacggggtttcatctagtcttactataaagttaatgcccactaactactaaagctcaatatgcaagtgtaccacagcatcaccaactagcaattattatctaaaatgttttagatcacatgcatctgtgccatatcatcacccactagcaattattatctagagtattttaaatatcattcaaacatgacatatcatttacaattttattgtatttttagaactcaatatgtaagcaatgtcatatcattatctccacattattttcatattatttagatatatgcacctaccattttctataatgtataacatgcattcatctacatatctcacggtaagataggataagcaaagttattgctttcttatgtcctccttattttgactttcaacattgcaagcaatttgtagtaaatgagaaagataactataacttcgacgagcaaacttgtttcatctatgcactggtaccaacactctttgcatgactttttgttaacaacgtatacgtcgtgctgttggccccgtctaccagttgatatgccaatttttgttgagaagtaattgttatgtacaagtcatttaaagccgttgcatgtcaaccaatatatagccatcttaacatacaagcgcagtaatcctatgtgaaaaacataacgaaccactacatttcaatcgaatagggtatatttggtgacaatcaatagcacataattcattttttaatacgttgatgaaaaaagaatagagggagtatatgatattattgagctaaactaagattagttcaaatactcatcttaaaattccttagaaattaatgtagaattgatatttcgtttgttccaaaatgctatcgcgcatggaaagcaagtcaaggcgagggaacacctgctcccattcttcggaaactcgaggttattcgcgcaaaatctcctcccgtcggtcgcccgaggtctgacctagggttccggcgactcccatggccggccgccaccgtaacccgccgcccccatccttccctcgcggcggcggcgggggcgtgggcaggggccaccacccgcctcctccctcgctccaccaccaccgcctcccgccgcctcatcacctcgacgacttccgggagccgccgctgctccccccgcaccaccgcctcgacgactt

SEQ ID NO: 44611 - DNA, 1501 bp, Oryza sativa
aattgtgtataccttataggcttataccattctgttttgctgtattcttttagaatatttgttatgcaaattatttgaagttatagaagaatatattttgctgtgaggctcagtttgaggggtttatgtattccgataaattttcgttaccgtatccgcgccggttcgtttttgctccgttttcggtttcgataatattcgtttccgttttcgtttccggggtttccgatttcgattccgattccgaaaaaaaatatgaaaacgaaaacgataaaggttgtttccgtccgtttccgtaccgttttcacccctagaccgtacgtttgctggtgtgccggtatggcggtatactgtagtgaaacctatcgtccaagaaacctgcctcttccggtcatcttcaggcgtgcgagtggtgtttgtttggaccagataataaaagccataatccaatttatccaacgcgtggtgcgaacagaatagcagcgacactcctgtggttcgccgatccaccgtgcagccgtacgtgccaccaatcattttccagccgaaagggtgtgtgagtgtgtgacaaaaatggccagttgcttcgacaaaaatgcaaccgtggttcatagctatctcttggaaggacgaaaggaaaagcaaagaacacggagaatgtcgatgcacatgctgcctgtaatttgtctctctctcccacagctagcgccacctaaagttgattgaaacccgactagctatttggagggattagaaaccctccccgccggcacgaggatcaaagtgaaggattagcacatactaccataaatataaaagtttaagatgtttttgccacaagttttcgtatgtcgtccgttttcgattcgtactgatatcgtctacaaagcgttttccccatcaaacaaccccgccatgtaaatcgaatccgtttccgtctagagcaactaatcagcgaggtccgtaaaaaaaaactaatcatcgagggtgtgaggcggataattaacaagaaatattttaacgcacaaactaatgcctggctttcaaggagacctcatgcttctgtgatatcatacacagttgttcgctagagaaattaataactaacaggagattgactcgactttctgttaacgttaatattaatatttctaatcctataccccactaaataaaatatttgagaaaacgtcttttttattcttcgaccttgataactcttttgatttaatgactggtctcaggattgaagtaaccgtcctgaccatgcctggtttcgtctaacaaagagcagttggagatcacacactactaaaaaccgaagtgctttcgttaaacgttatacacgatttttgtatatcgtcctcataatgaaaaattaaactagactccagttaccctaaaaacaataattctctactcctattcgttttccgttatgagattgtcctcaattcttggttccatcttatgatttttctttcaatttttaggttgaaga

SEQ ID NO: 44612 - DNA, 1501 bp, Oryza sativa
ccttaaaaaaaatttctacaatttaaagataaaaatataataatcttcaaatttacacaaatgtaaatataaaatattcaatcaatgcttttaagtattctatcttttaaattattttaaaattatatatccaatttgtgatccggttgtattcctttaaataaataaactactaatatctatagccataaatacatcacaaatatggagccggcatgtaataattaatgttatgataataatttcacatcatattttaagtgtgaataacacttgacaaatatacaacactaacttaaatgtacatatgtattctccaaattactaaaggtgtctcatgtgattagaaacaatagatgtggaaaacaaaccagacaccgaacgaacatgcactacagtatacatatttgtcaaaatatgatacggtactttggagattatcgtggtaatatttagaaaatcactgtcttggttacgtataaattcttctattgttttgggataaaatttacctccttcgatttatgtgacaggggaatataagtaatataagtctatctttgatcagatgaagaagtatcattagttatatttttaatagaaaatatatttcattaatatataataaaattaaaatgttacctaaagtcatctatagcatacaaaacaaaaaatgttatataaagtttggaaactccaaattttttttaaaaaaatcacacacaatataaatagatatgaactaactctattattgggacatattttttctaataaatttgaggatatacaggttcaagtaatatgcccaacagttattaatgaacatacgtttaaagtagagtaaaacaatatttcaaaaatatcatccacacataaacattcataataataaaatttcaaataagattaaacaacatgctcgcgcgtatgcgcaggctaccttctttcgtttaatagccaaacttaagtataatcaccatactataacaacaaggggtgagattacctccacaaccctatacatatattgaaaatactaattcaataaatattatattaaattaagcaagtactgaaaaacacaacttaacatatacatatctggatatattagtagtgagaaaactaaagcatatacacaatttacttgtattactatatactacttcttaaaaaaaagtcgtcaccaccaccaccaccaccactgacatgttaaccataataatatcaatataactcgtgagtactacgttgctttatcctgcaatggtgtggagtactctctccatcccaaaatataagcaatttttggtagatatgatacttcttaggagtctgtccagattcatagtcctaggagtgtcatatcccctcaaaatcccttatattttagggttaattggatccatgccatcgtaaatatgccttattgaaaatatgccactactcttcacattattagctgggtgccattgaaaatttataaaattggaaccat

SEQ ID NO: 44613 - DNA, 1501 bp, Oryza sativa
tgtcgcggcagacctcgaagagctgcggcgagcggctcacgaagtgggcgaccttgttgggcttggtgagcccaagctgcgggcgcaggatctcgaggcgcttgagcggggtgacgtgctcctcctccttcttgagcgcgtcgacgacggcgagcaccttggtgagcaccttccaccgctccgtggccacctcgagcgcgtgcacccgctttttcttgctccgttgcctcacgttgcggctccgcgtcatcccccgcgcgaaagataactgtgtggggcagcagaatcagctctggccctggcgctggcccccgcggcgcaacagcttggctagacaatcccgcaaacaggtggtgcgcatggtgtcccgaacggctggaacgggcatacacgggagtaacacgatggtacgaacgcgaccggagcaggaagtgacggaggacggcagctatcggcgcttctagccggcggcgagaggaggaggctgggaaggggcagtgggatggccggaaagaggaagggggaatcaagcggagcacgagcctctacaactgaaaggacagcaatggcgatgcttaaaactagcccatgtgtttggatagaaaatctagcccacagccttattgggcttgttaggtttgggctaatccaagaaatattttcaatccaaaagcctataatattgctgtttaaaatccaacccattccttgatgaattcagctttgtgggacttctcgttgtaccacaaatctagcccgatcttattttgggtctctctttcattgaagcctgtaacattttgctatccagaaacatctactaattctacatttcaccatcgagttttaccaaataccattatacaaacgattttattttagtggtgccacgtctccttgcccaccgccggcttgtcctcgattccttcaccagacacctccgttgcgtcctttctctggccgccacgacaagctcaacctcgcataagacgtcatcagtggcttatcctcaatgcgcactcccacctccacctcatcctccttgggcaatcggctcatccttacccaaggcattgccactggttcaattccccttaggccaccagctgcctatatgtcctcgcatatcgacaaaccataaggtttccgttgccctcagttaccatgaccgcgcgaatctagatgggatcaacacaatcgaatcgttggatgcacagctccaccataaagccgagtggcaaggtgagtccaagcacaaaagcaaaatgatctttccacatgggctaataaaacgctatggaagtatggatggaaagacgacaaatatgacggtagtggcattttatagacaaactttgtacttttgtagatattacactcgttaatagaaaaaaaaaaggagaagaggttgacacttgtggatgccaaaacttagattttctcaaaaataagccatgactgaatagctaactagtatcccgcacaattgtacaaaagccta

SEQ ID NO: 44614 - DNA, 1501 bp, Oryza sativa
acatggatgcccaattgcccatggaccagagagagagagagagagagcaagaggggtcctggaattaatctggttaaatcaggggagccatcatggctaatgaggctgattattatgatgacattgaccatgatgatggctttggggcaactaatccacatgcatgcatggccagccagccagggcatcatatcatggcgggctatagtacgtggacggccgtgcatatgggtcagaggccggactgtgttgggagagcatgcatgactaatttgctctgattagctagctaggtatagcagctctgacccctgcaagtctgacacctcaacctaatcaataattattcagtgatcaatatgagctcgatcgatcaagcagcgcggtgggggtgcactggtctaggatattgttgttcttgttcgaccgaacctccccctttttcttcgctcggagatgattgatgctgcgaaacacagacagaaatcttcgggcagttaacacggttgctttcgcgttaagaatgggattagttataagggtctatttaaaaatatggtgacaaatataattatagcataaatgtaatataattacagatgtgattagtgtaattacatatataatttaggaacttaaatatgtaattttcaaacttagacttacattgtaaatacagtaaaattacgtatgtaatttagagatttacaatgaaaatacattttttcatgaaaaatatggtgtcacatttatagcaaatccgtagttataattgattgagtgatactatggttcctgagaaggcatatttttgtaacgtaaaatttaataatatctcggtatacctcttaaatcacaatttttttaattgatttggtcatttttcattgtcgctagcttggacaaatgtactttaggccgggttaaattaaatattttccccagaggtctctgtagttcaattcactgttcttgtgctacagtgtactactatatatgcttcaattaattccgagtcatggggaaaaaggccaaaaaagaagaaaaatattacttgagcagaattgaatttactcggttattgattatttacacgcacacggatgcgtgcgcatgaatggtgacaaattttagtacgtaaaattataacagtatacaatcatgcagcgtgcatgcatgcaggcgtatgtatataccactgtagaaccctagctacatcgatgttgccaaatcattgctggcccatgcccgcttggcttggtcctagttgccctgtcactatatgctgagactgttgctgtcgacgactacgacgaatatgtactctctacatactccctccatactttaatttatgacgccgtagacattttaatcaatgtttaaccattcatcttattcaaaaaaaattatgtaattatcatctattttattgtcacttgatttatcatcaaatattctttaagtatggcatgaatatttttatatttgcacaaaaatt

SEQ ID NO: 44615 - DNA, 1501 bp, Oryza sativa
gctcttggtcaaaaccgcccaaaacagtcctggagggtaattcgtacggtttagaaagtccagggttaaaaatatatggtatttgagttctaattcgatcatcctcgatagttagagggttattcgtagtttttctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactaacgaccccatcgtggaataagccaaacggtatttttacaaatgaaaagtaatggtaatttgtaaataaaattttttatatacgtgttcttagagatccaaaagcaacaactgaaaaataaacttcgatgaaaaaaaaccttaaaatcaacatcaaatttaaattttggctgataagtaggagtatgagcataagcaaacagacgagatcgtaagctaagagcaggtacaatagcatagcagactataaacctgctataaacatattttaagaagataaaa

SEQ ID NO: 44616 - DNA, 1501 bp, Oryza sativa
tggtaacaagggtatgcttagtttcgtgctaaaataagtctaaccataatttaggagtggtatttaagtgtgaatggttctggagttactgaactttagaatggtcgaattgtttaagttttgtttagtttgttttagtatttactaagaagtttgatattaccgaaatttgataacgttacaagcttacaaatggcaatgaatcaaaggcgctattactatttttttatatatggcgtaggcttttgtacaattgtgcgggatactagttagctattcagtcatggcttatttttgagaaaatctaagttttggcatccacaagtgtcaacctcttctccttttttttttctattaacgagtgtaatatctacaaaagtacaaagtttgtctataaaatgccactaccgtcatatttgtcgtctttccatccatacttccatagcgttttattagcccatgtggaaagatcattttgcttttgtgcttggactcaccttgccactcggctttatggtggagctgtgcatccaacgattcgattgtgttgatcccatctagattcgcgcggtcatggtaactgagggcaacggaaaccttatggtttgtcgatatgcgaggacatataggcagctggtggcctaaggggaattgaaccagtggcaatgccttgggtaaggatgagccgattgcccaaggaggatgaggtggaggtgggagtgcgcattgaggataagccactgatgacgtcttatgcgaggttgagcttgtcgtggcggccagagaaaggacgcaacggaggtgtctggtgaaggaatcgaggacaagccggcggtgggcaaggagacgtggcaccactaaaataaaatcgtttgtataatggtatttggtaaaactcgatggtgaaatgtagaattagtagatgtttctggatagcaaaatgttacaggcttcaatgaaagagagacccaaaataagatcgggctagatttgtggtacaacgagaagtcccacaaagctgaattcatcaaggaatgggttggattttaaacagcaatattataggcttttggattgaaaatatttcttggattagcccaaacctaacaagcccaataaggctgtgggctagattttctatccaaacacatgggctagttttaagcatcgccattgctgtcctttcagttgtagaggctcgtgctccgcttgattcccccttcctctttccggccatcccactgccccttcccagcctcctcctctcgccgccggctagaagcgccgatagctgccgtcctccgtcacttcctgctccggtcgcgttcgtaccatcgtgttactcccgtgtatgcccgttccagccgttcgggacaccatgcgcaccacctgtttgcgggattgtctagccaagctgttgcgccgcgggggccagcgccagggccagagctgattctgctgccccacacagttatctttcgcgcgggggatgacgcggagc

SEQ ID NO: 44617 - DNA, 1501 bp, Oryza sativa
gcggcgaccatgttgaggacgatagcttggttgatatcgtcttgatctgcccccagcatgtgttgatggtgcctcatggtcttgtagccgccttccaagttgagccatccggtcttgcaactcgtgaagttcttgtcgtaagtcttcacttcttggagtaggtgcctcaggtctcaggacaacgaacctgttgttgttgtagtcggactgtaacgccccgattttcgttcgggattaaaaatcaattaataatgcatttctagaaattatattaaaagttaaatcaatttaatcaagtgaaattatagaggaaattaaaatttcctttaaaaaaaatcattggccgggaatattttgtaatattctttgtgccctaatgtactctccggaatttttcgtgaattttcggagctcgagaaatagttttaatagcataaagatcattgcatcaattaaaataaatagaaaacaaataaaatcatccttcctctctttgggcccctttcggcccaatccctcctttctctcccgcggcccgcgcgctgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagtcacaccggcagatgcatgattaatgcaagggggtacaaggggtaataatataggggttaagttttgcagtaaacagcatttaaaagtcacttagttgcccaaagccattttataaagacgatcctagagctacacagtattattaatcaaggcagtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgcaaccatgtgccacataccaccacggtatacagacggaagacgtgacatagtttccaacccatcctagctatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctaga

SEQ ID NO: 44618 - DNA, 808 bp, Oryza sativa
ttgtatgtatgatcaataattgtagctcatattaatctttgtcgtcataaatattgaagtgtttgtattagctaacactttttttactattcatgtgtaattttcagattatatatagctgttgaaatgaatgattaagttttgtattgattcaaccaatatctttaattattcatatttaattttatgcttatattcatttctgactttggctattttttgtgcttatataatcagaagtgttaatatgccatcaaagagaaagcaagatccaataaaaatagcagaatatgataaatcagattgcaagaaaagaagatatatcagactacaaattctaagagagaaaaagcgaaaaagagaagaagaaaaaaatatggtgcataataacaataaaaaatgtaataaagatgaagaagaaacatcaaaaaatagtaatataagagatataatatatacagaaaagcaaaaaaatattaaaaataaaagaaaaatacaatataatttagattatctagaaaaaattgcaaaaaagaaatgtttagagatagaccatatatcttcatatttatcaacttcacatggcatggtgtcctttaccccagaatacattaaatatctaaaagaatcatatgaaaacaaatcatttataggtatgccagagtataaatgtaaacattgcaatgctatattttggtttgaagaaagaaataaaagagagacaaagaaaagaaaaggtgaaattatatatcaaattgctgtaaaaataacaaaataaaaataccaccattccagaacccaccagaaa

SEQ ID NO: 44619 - DNA, 642 bp, Oryza sativa
ctcggaattggagcgttcaagtgtctaatttctccttaagaagtcaagaacccatttttgtgcttgcttcggcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgattaaattaatgcattatcgctttatttaaattcccgcgttatcactgttttatttagccatgcctatttacctttgttaagacattattattgctattgttattattaccttgttcaccctagaataaacaaaaccccaactagtggacactctactcatggtaccactagcatgattttaggtagatgcttcgctattttaattaggtaactttaggtggtttttcaactctagacttggggatattcatatcacctggacactttggaattgttggtttattgtggaattggattcacaccgccccctctattcaaaatccccaaaatggttttaggctgggctcggggtgcatggttttgatagtagcacctcggccacataaggaccggt

SEQ ID NO: 44620 - DNA, 899 bp, Oryza sativa
taaacatttactaatatcattgcagatgatcaatgtacaatgatgaaaaatactaaaaagaatagacaatgtttttttttctggtaaatatccatactacacgaaatgttattcacagctgattggttgtgctatagcttttctaaatagaaagtaaaatttgctgtaacttgctgcaaattatttagaggaaaagattagactttgtgactaattgatttacgggattgaagttagtataattacatgtaagtacctaggtttgtcaattaagggtttgtttggatcagaagtggaggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcattaggatcagggcaagttgcagtaggctggtgttgatgttctttgattcggtataaatcaatcaatcaaaatgcaaaatactactggatctgggctaatttgggggctttcgtgatcgtgcaaggtaatgcaggcgatcgtgtacctgacctcgtcctcgtgttcactaatacatgtgattcagttcactgacctcgtcctggtgtcgccggacctgctcgccgcaga

SEQ ID NO: 44621 - DNA, 1501 bp, Oryza sativa
ggcttgggatctacggctcgtcctagggtcaagggggctctgatacctgcaaggtgtcacgaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttcctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaacacgtgacatagtttccaacccatcctagccatagacaagagtaccgacccaatcccacctacggccggaacccccaggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaccatttttggggattttgaatagagggggcggtgtgaatccaattccacaatactccaacaattccacagtgtccaggtgatatgaatattcccaaagtctagagttgtaaaaccgcctaatgttacctaattaaaagcgaagcatctacctataatcgtactagtggtaccatgagtagagtgtccactagttggtgttttgtttattctagggtgaacaaggtaataataacaataacaataataaggtcataacaaaggtaaataggcatggctaaataaaacagtgataacgcggg

SEQ ID NO: 44622 - DNA, 1501 bp, Oryza sativa
gctttgaggaaattcatgtgtaaaactgtgttctatacaaggcaaaactctgaagtctgaagaaacaaagcagcagcccggtgaagaaatgaattgtgttagcaggaagtaacatcacatggcggaccgtgtattcaatcagtcaagtgctactatcggcgcagctggtggttactggttagcagttgaaccgatggatggatgatatgacgaattctggattgtacagtcgtacagatgaactgcatgtccattggcttggggagaactaaccgaaaagggcctcatgctaaaccgaacagtaagtgctggggatatttttggatcctttttcctttgcagcttgctgcagcactgatctcatcgaatggttaattaagcccttgtttagttataaattttttcttcaaacttacaatttttccatcacatcaaaactttcctacacatataaactttcagctttttcgtcacatcgttctaatttcaaccaaactttcaattttagcatgaactaaacccaccctaagactcttacagttgcaggactggcaccaagtcaccagagttttttttttttaagcagagaacagcatgaaagctgaacaggttttcgccgctacctaataaagaggccctccatgaaatctcctccgcctcttccttctaccactgcgcggtcaatcaataagggccagctagttgatcaagaatgccagatcagtgtccaagcagcagtgcaggtgcagcactctgtacatgtacatcctcctcccatcaacacagttattgattcacagctttgtagcagtaacaggattgattccacatgtgtagtacatctcaataataaacgggtttaatgtcaaaataagcatatggagttgaatctttgagctctgtttgattctattattgagtagatcatcgatttgattatagggataatcaaatgttttgagtaatagatttaacaaatgaattaaaataagtggtctaaataatacaatatttgttttcagtgaactttttttttaaatgtggagttaaagaattcattttaataattcagtgaataggctgaaaagaacagagagagtacagcatatccatgcacattttttctttatagacaatgctggtgtttgcacatgttctgtaggagtagttattactgctacaaagtcagtgatcagttaagccaaagctgtggccatgaatttgctatgctagcagtatgattccagtacttgcagttacaacatggtgcacaggctcacagcaaacagatgcatgtatatgcaagaacaccatgcattgaggcagacctttcctggcttgctctctaaatggcattaactgccatctagcgacccacccacccaccaccatctcctcccccaacccctgcactgctctccctatatctaaagtctccgagatcatctcatcacttcactgccttctcatttactgcagaaggtgaaggtgaaggaggagg

SEQ ID NO: 44623 - DNA, 1501 bp, Oryza sativa
ggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaccttgcaggtatcagagcccccttgaccctaggacgagccgtagatcccaagccttagcaatattttcgaaataaaaatcctttgtatttgtgaaaatcctcgtctctctctatcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccctggggtatccacacggagtggactaccaggccaggccgcttccggagcaggagggtgacgatgcagagccccacgctgcttgggaggtcactgcagtgatcctcgctggctctcccgagcggacttcgctgacagtcaccgcgggtggagactctttccccgccgcttgccagagcgccgctctcctcgccatcggcactcttcaccagcgctacccggacgagttgcagcactcgccctaccgctaccaccctcgtcgcggaggagcccgcgaccacaccaccttccgggatgctagctcggaggatgacgctaccatcgtgcacctggcgcgcatggtggaggcgtacgacgcggctcgtatcgacttccatcagatggtgcgccgtgggatggtcgaggacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttctgtcctggcccgtcgcagcagtagacgagcatttagtaggcttgcgcgtgtgttcattctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcaga

SEQ ID NO: 44624 - DNA, 1501 bp, Oryza sativa
attgtttctgaccggtagagtcaccggaaattgttagcaaccaattctggacaaacacaatcgaattggcaaattggaaatttgccgctagtacagaagcagttaaactgactttgcagctcttagtacttcggacacctcacacacgcacaaaaagcgaccatagcgcggttcacattacctggcgaatttcgattggacgcgccgtaatctgcagttttttagcgtggcaaaggcatccaaaagctagtagagtactccacttcagaaagcatcacgagcacgatacggtgttcagatcatgccgtaaagctttggtatgtcatattattattatatagagcgtcgttttgatgtgtatggagtgtttggacaataattaaaaaactaattacagaatccgtcagtaaacagcgggatgaattattaaacctaattaatccgttattagaaaatgtttactgtggcatcacattgtcaaatcatagagcaattaagcttaaaagattcgtctagcaaattagtcgtaatctgtgtaattaattattttttaatctatatttaatatttcacgaagttattcaaacgttcgatgtggcagggtaaaaaattttgggttgggaccgcataatgagagcagtaagcgagctgtccaaaagagcaagtttaagcaaaagctgtccaagctgtgcatgactctgtactggagtaccctgttcgcattgctggcatcagttgccagcttgtatgattgtatcccctgacatggcaccacacgcagtaaaatccagaacgcataatttcgatatcatatgacgaatgataatgctgcaaattggtgatagtacaacagttataaacagttcgaaacaacatagtactccagtactcttacaacagtaatactgctgttcgtaacatccttgcagctgcagcccacaattttgagcccttttccagctagcaagtagtacgagtagtagctcacttaaacccgtggaattagcggttgttttaaaaccacaaaccgatctgcttagctaaacacaatcacaaagctcgcaagatcaagatcgtgccatcactacaacgtcgacgtcactggcagctcactgggcgagtcactgagtcactgccagctcagcaaaagccaaagtgtcaagcttaccacatcaaaccattaatcaaagatgaaaatcccaacctcaatgattaatttgctcgtgggccccaccccaccacctcctctcccgccattgttgcccacactcgcacgcattgctcctcctcctcctcctcctcgtcgcatacaaaagacgcgcgcgcctcgcactaccagccgctgcaccaaccgggcctcgcttgcccaagaaccaccaccaccacctcctcctcctcatccatggacgagccacctctcctcctcgccgccggcgaatagcaccggcggtatatccgatccgatcatctggtggtgtgttctacgggttgcagcttcttt

SEQ ID NO: 44625 - DNA, 1142 bp, Oryza sativa
cagaaatgtcatcaagctgccatcatcgtcgttgctgtgatgccgtcgtcgccatcgccgtgatgccgaggcgtcttcaagccgacgctctcgtctacaccgccaggcgatggagattgctgtccatgcgatcccgccggaggttgccggcaagccatcgtcgttacatcggtcttcgcccatgccgtccaatggagtggagtcgccgtcaaccgggaggccatgacatccactttgtcatcgacgctctaaatctcgccaacctcgtcgagccgccagtgacaccgtctgccgaaggccatctcgtcggaagacgccttcgtgccgtcatcgccgcaccaccgttggactctgagcatgtctcgtcattgagactccgccgaccggcaacactttcacgctcgtcgcggtatctgaggcgctgctgatgttcacttgatcgtgttcgacggtgctgtctcctccctcacgtgttctccgttgctgtcgttgccggcgccgtgtgattcacattgccgggggctgccgtggagccgatggccaagcctggagaagagcacgccatctgcagcaactatggcaaaaatcatcacacgctaatgtttcacgtgtgcatgcatgctactgtgcgcacagtgacaagcaaaccaataaaatggcttattgctaagctatactcatttggccatgaggatgtgtatcgttatacactaatttctcaagtgcaagtatagtttggtggtctgcatcgaccatctcctactactcctttctttcctaatatgatcccgatgcaattgttatgacgtcgagccgtccaagctacgcgattccatgcatatcttcttcaagcaatctacaccgacacgtcgttcaagaccgacgaggctagacgacgagggcgggcgaagccgacgctaaggctacgtcaccaacaccggcgcacggaccgacgaggccgtggattgctgccagtgcccacatctacatcaccatgacaaccatgcatggagaatgcgaagcgaagacgatgagacgaccactagcagcttaatcggaggttctctgcaggcctagacctgcggaggtaattaaccgggagctttacgaggccccaggaaccaggagaccacattgctcaa

SEQ ID NO: 44626 - DNA, 1501 bp, Oryza sativa
aggcgtcgacgttcatgtgctcccgtttttctggacagctctgctacctactattccatactcggttgtggatgatcgagtctggactcgtgactcgagagctataagctagccccccatggttcccgtggacttggagagacccagctgtggtcgcgaacacgcgttccggcatccaattgatcgcgggcacgagatgcgtctcgtcgtcgtatttcctgccatcttccggctgccatcggtccccgagggaggttcaggccaccgtcttcggcttgaagcgttgggtagccggccagacaactggctgccgcatctactgctagcggttgcggaaacaatacaataagcgtgataaaaactctggcgatcacagcccgtcacatagccacgattacatgagattctgcacagttatctgctgtgcaacccgttgccccaaggtcagactgctgccagcgttcgcctgttcccaaatcccaagtacttcccatggatggaaggtgtgttcgtcagggagttacagtgcaaagaatgcgacaaagttctgatgatatcgccaggacgccagaccatccatgttgactaaaaaagtaaaaatacagcaaaggccatttctgaatgggcctcaatcccagcccgtccacgtgcatatataggacgggatttcctttagttaaaatcccagcccacttacaatgaatgggccggaattctggcctgccaaacaaggacgagagtcgcggtggttggactcctcggggaggagcaagaagacgagccgtcgcccgtcggaggcagccggaggaatcgtcccgtcgtccggcgtccccccctgtatccccctcccctcgcacggcgatcggatccagcgcacgggtggggaagcaggcggcgccgctctcccccacgcacccgaagtgcggcggcggagcaggtatgcccacccaccccaaccctagaaactcgcccctcttccgctcgattttgcccattccagatcaatgtcagaacaacctgacttgactttaggacaatgaaattcatgtatgttcctaagcgattgctgatgattaggactagtcccctttgctacttgtagaactgtggaatacacagtaccgatactatccgagtgttggttgccaatcattcgtacaaactaatgaatctccagttgcgttcaacaatatgcgaaacaacgaattaatttacatgagtataaactcactagcatatattgcatccctacattcttgttccgtcaacagaacattgttgtattgatgtaaaatagtacagacgtattctctaattgagcataaatgcggtgaacagaaaaataaccaagagaaccgttgtccattttttatctactcctcccttcctggatgtttggagctaatacctagctaaattaaatgccttttcaggaacctcacttcttggtggcggttgaatctgaaatttccaaactcggaaggctagtaggcaatggccg

SEQ ID NO: 44627 - DNA, 1501 bp, Oryza sativa
aataagtgtttaatgcaggcttcaaggaaaggctgttgtttttgcaattgattttatttgaactcttttctgaaagcaactaagtgagtgcttctcaaacgacatggatgagacagtgcgtcttgtccggtcggagtatgtgcaaatgtatcagtctttagaattgatcaagattggcacccgaccaacaactttcaaacggccacccgggccaacaactttcaaatggccacccgggcctagctgatcccatcagctgcagatttttcaaacatcgaacccctttccacaacagcaatttcacaagcagtagtcaaacaaaactacgctaggaatcacctcacatccacccatgaccgtgggcacggctgttcgaacagtttgttaacctctgcagagggggtacactttatccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaaacccaggggtcctccccgacaccaccccggcgaatccacatgtctctcggcatcaaggctcccctgataagctagttactcagccaggggtgtcccattccacccatgtggtcgtacttgtcttatgtttggatgaaattccaagaaaacggtccttaagtgcaagagcgggaaaccgtacacccggtacgttccccggtccgcggttttggaaaattcatttagttcgcaagcaccgacccaggtgtcgggttttccaagtcttttgtaaaacccaagttttacctaagaagtttttcagattttaagtttgaaggcgaccgtcgatactcgtgcagagtgcacgatttccgaggcgcaactgggtggttacaagggaacatggtataacaattaacaaaggaaggatcaaatgcaacaaactaggtaggtccgccaatctgccttgcagacgggacaaacagattaagtgcgatcctatcaatgcataatatttttcaagcaacataattaaattcaaatataagctcaagatgttcaaaggtggcttgccttgctcgagatctggagcttgatcctcgaaatcctcgcactgcgggtcttcgggctccgaaactacgcgcaaaacgggacaactcaacaaacggcgaaaataaagccctattaatgacctctaagcgtgccattagatagatctcgagatttgagggattttggaagttgaacggagtcaaacggatttacggttgggaagatattgaatttctaagattattggatttttggtctacaggaaaaggacttaattaaatcctttttgaaaaagaaaagaaaagaaaagagggagggaaattagacttccctcgggcggctagggcgcggcccgagagaaaaggggcggctcggccgagctaaa

SEQ ID NO: 44628 - DNA, 1501 bp, Oryza sativa
acagtatcattagactcactttggtgggacatcagcattaatcagaataccagatgatcaagtggcagtaacaaaaggggctattctttccgatcctagaaaaaggaagagtaataaagatgattctagtactgaaaagttgatgtcaagggacagtaacaaactaacaatgcaaattattctctctgatccaacagagctgacttgttaaatatcctgagattcgtatttccttcaacgtctcttgtgcagggatgcaaagagcttcctacaggacagtgcttaaaccgtaagctagataattgtccactgcttttcttgtactggatataccgattagaaaggggttctctgacccagtgatggccactaaacaaaattccaatcaatctaagcatatcaaatttatttaggacggcgagcggcggctgataagcttagcttagcgccttagccactcaaccacttcccatgctgaatatattcgcgataaacaaaacggaaaggggcactctgcaagtgactctgctttttgtagtcctgtacatatgtgccgtgctactctaatctctgtctgatttcctttggattctggtgataatagtaggctttgtgctgcagattattcgcaagatgacgtcgggcggactgtggcaataatcgtaggcatcttggcagggctggcgatcctcgtggtgttcatctctttccttagaaaatcatgtaagccccttgacttggaaatcctctctgttttgttgtctttggagagaccactactagatcataaattagtaggagaatctctgtatctgctcctctggcacgttatctttcattccatatgcaagcttcactaacctgatataaacatgatgtatcactctaaactgcaggctagcttcgtttgatgtctggaaggagtttcagtttcagtcctcgcattctgtgtgagaaactgagaatgacttgtaaagagagcttcgcttgcatgacgttggcaagagcttcatatcgcttgtaatatcatttttccagcaatagatatgtaagcgagatcttggtagggctatcggagcagcactaccttactttgggtcatcgttttttcgtccactaataattggcctacttgtttattatcaagtctgaagacaacatcatgcacatatttggtcataatcattcttggatcgattgctaatcgagtaatttacagagggccacatcacacacaagccatattgttgggtacaacaagcatatgacacctactgattagccatcacacaaggggccatattgttgggtcgctagctatattgttgtctccatggtatatacagaagttcacacaaatgaggtctgcaaacctccggggcctttggtattcaattttacctgtatatagccggggatcaagcactgtgtcctccttcagtcattgggctccatctcgccgagttgtaacggccgcaagcgttgatacttgcttccatca

SEQ ID NO: 44629 - DNA, 342 bp, Oryza sativa
ggtgggggaggggactgggagaacggtcgagctgtggatgcgtgtgcgtgcgtgaattcgtgatgttttttttgctgcgtctgcccatggatcgggtggtggggggtggtgcggcccgctttccccatccgctcgcatgtcgaccggggttgtcccccttccctccatccacttgtcaagttggggggcagggcacgcacgcacgcacggcagcacggcccctggtttgcgcctctttcaattcgcgcctcatgtaaaacgttacggcttcttttgaatttttgtaacaagactaaaaaacggctggtaccacgggttaagcaattgtactgtttgcagaaa

SEQ ID NO: 44630 - DNA, 1501 bp, Oryza sativa
  unsure (1)..(1501): unsure at all n locations
tgatcaagtgatcaagcttaccatttgcaagttgccaattgtcctaagctatctcggttagatggtgtaagtttaaccgtgtaaagtacagtatggagagtccttagctgagcaagttgtgacgggaattgattccgatgggcaatgggtaaacttaccaaagttgatagagagataaggtagaatgggtaaactacatatagttaaatttatttagccacctatggctatcgatcaaattgctcagcttgctcagctaaggacgagagcaatcacttgattgaaggcagccacgctactgacaaaccaaaatttagcttgctggctatagactactgcctgtaagccaacaaccccccataacttacagacttatatctaagttacagtgtcagtgtcatatatgcaggaagctccaacgacacagttcagtcattttcctgcaataaagaaaagagtaaatttcacaaaactacacgttttatagtctaagttgcagaaaaccacacacattttgacacttggcacttaagtacatatattttggtagtgtagttttacaaaaccacactatcaatgaatggattcacccgcgagatgacgtgactgtttcacctaagacgaggacatgtcatcttcgagtgtggaacaaccacgtcctcatcctagatggaacaaccacatcatctcacaggtgaattcattcatcgatagtgtgattttgtgaaattaaactactaaaatatatgtacttaagtgccaagtgtcaaaatatgtgtggttttctgtaacttgaaccataaaacacaagttgtnttgtaaatttactctaataaaatttgcacggctaatcacctcggcttttctggtggactgcatgcaaatgacagtatcattagactcactttggtgggacatcagcattaatcagaataccagatgatcaagtggcagtaacaaaaggggctattctttccgatcctagaaaaaggaagagtaataaagatgattctagtactgaaaagttgatgtcaagggacagtaacaaactaacaatgcaaattattctctctgatccaacagagctgacttgttaaatatcctgagattcgtatttccttcaacgtctcttgtgcagggatgcaaagagcttcctacaggacagtgcttaaaccgtaagctagataattgtccactgcttttcttgtactggatataccgattagaaaggggttctctgacccagtgatggccactaaacaaaattccaatcaatctaagcatatcaaatttatttaggacggcgagcggcggctgataagcttagcttagcgccttagccactcaaccacttcccatgctgaatatattcgcgataaacaaaacggaaaggggcactctgcaagtgactctgctttttgtagtcctgtacatatgtgccgtgctactctaatctctgtctgatttcctttggattctggtgataatagtaggctttgtg

SEQ ID NO: 44631 - DNA, 1501 bp, Oryza sativa
cgtccgtcttatttgaaaaatttatgaaaaaattaaaaacatttagtcacacataaagtactattcatgttttatcatctaatagcaataaaaatactaatcataaaagatttttaaataaaacggacggtcaaatgttgaacgtgaatagtgcaaaactgcacttattttgaaacggagggagtatttgtagaggaggttgtcctaagtccaccgtttctaaccgaatgcggtctttgatgcgcccacctccgagctccgacgcaccgtacaggtggtggcatctgaagtacccaagaagaagtgccaaataatacgactaggtggtgatggagacttgctgagctctcgtgaaactggccgttcattacttcattggaccgaccaaagacaatcccccgaccgggcgacgagaccttgcaacgacgcgcatacgcagcatccccgggttgcacctgcagtaccgatcgatgaggcccgtgtcggtgttggtggcgcctggcgcgcgcggcagcataaccgctagtccgcaacgcgacgcgcggcagggccgaaacgaggccggaattctcgcgcgtccgcccgagcgaatgcatggccgcggcgtatgctggtcatcctccgccgcacgcaggtgggccttgccgttactgtgcctgaagagaacgttcgggagcgtgagccgtgaggtactagtagaggagctgaaaagacgcgggtggtggccatatgacgcattgacgcgagacaccggtccggtcgctctcgcccacagctgttgcgcgcccgaatgaaacctcggcgcgcaaagtcgggccctttcacagtttcaccttcacgcgttcctctttttatctccacgaatctagctctctcggttggcacttggcagggggtaaatcttcccaaaacaaattcgcttattacacttttggaagctacacgttcgctaccacgttagtttgtgtgcagcaaaggaccccttcatgtcaactttagggttgcgagcttgttggctggaatacagaattacaaaggtatcatccgtaccagccacggacgcaaccgcacccaagtgaaaagggccgcagcctgcaggagccgcgatgaaatcagctgtatgcctgtgtggaaatggcagttgcttattggcgaagcaaaaatactcaaaatcctgttcccatccccgtatcccggattcccagtctagactgaagaggcagagcattcagtcaaacagcctattgctcgagtgcactcgtcgaaacggcattggttatcttcagaccatatgccacagattatgataggttgcatcctgtcactgcccataccgtcttaccccaatctggtacagcacaaggataactgaatgtaccgaagcaatcattcagagcatagttatcgggagggaccaaagccagtagaccactgaccagagtcacccgaccaaccgctacgaggtccaaccggtgcaaggaggatgcatcgccgtgtcgag

SEQ ID NO: 44632 - DNA, 1501 bp, Oryza sativa
tagattcggggcgtgtgagtggtcaccatttttggactaacgaggtctccccaattcagtaatttatgttcttactgcttagtgttactgttacgttcgattgacttcttcatggaaggactgtacaagctcgatcaatatcgttcggatgtggcttgagtgtgaaaactaatgccttgtgtcttttttagcttagtagtagatgtctctggatgcatgcgttggtggataatagtttgatggggtcatctccgcgttggatagcaattaaggttactgttttttttttggctattcttctgtcagttctgttgattacaacagtttttagctattttgcttgagtcatcgtctgttgacagtgatgacagtaatgtggttctcttgcaacgatgatgaacttataatgggcactctttttctttctcaaagattgttccatgataaaggaaagtacatacttttagctatgccatgcttaaagtcaccagtatttttccatttatcggataccccatgtaacaatgctacaattagttgtcgtgatctatgtttttgggctgaaatgtaagctggaaaccccagtgtgactctttaaaacctgctttcagaaaagcagggccatctggcttatcatctaaaagaaacaatgctacaattagtagcttttgcccatagttggatctcccataagacaatgctttttgctctggtactttttgcattcaaaagtatcaaatggacagacattcagtttatttcgtcttgaatgcatcttgaccgacaagggatgatcagagatggccagcttggcgactgtagtttctgtctgtaggcaactgatttgtttttgcgtcttctcaagtgcaatcctggtgtgtcaacttatttgtgttctgatgtgaacttctaagattaatttgcaggtttccgtctccatttttagctggcagaaaaatgggaaagagtttatttctgtgtgacttggggcttacttttacatgtccaattctctttcttgcattctcttttggtatgtttgacttgcagcttataggatggatattttctttaacttgcaatagactgatagtatgattctgataatcacgtgcagtcttcatggccatatataaatgttcaatatcttgattcttccataccatatgggatttccaatttgtctgatgtattcaccatttatcaacttgaactatgtaataagaactttagagcatatattttgcaccgaatgcaatccaccattcatctagttggataattcaacaggttctatgccaaaccagacttaaaaatgttatggtcctgttttttcttcaatatcattggggataagttgagttccacataaatgtagttgttaggtttctttgaatctttgtttctagcaaaaccatcagctgtttctaggaatctaagactgccttgcacaattctatatgataggaataggaagaatatctccagcaagactttcatc

SEQ ID NO: 44633 - DNA, 1501 bp, Oryza sativa
tcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccaggaatcgacctctcgtgacctcgccgctgtttccctcttccctccccaccggttgacgccaccgcaatccgccgccgtcgagcatcctccggcgaatccgagccgttggctcgtcccccctcatcacgagcaaccgcccggtgtgctcgcttttgtccgtatcgccgtggttcgctctgccgctcgccgccgccacccgccgtccattcgcggccgggtcgtcgtctacctcccgccggcccgcgtggcagccacgtaggcgccacgtcggcgccagctcggccgagatcgggtcgggccgaccccgatcagcccttccccgtgcgcgcggtccaccgcaagccgtaaggctgcacgtgggcccgccgcatccgcgtcctccgcgaaccgcgcgcgtgcaccgcgccccacacctcaccctagcgccgcgccgcatgctccctccgcacggtgagccgagccgctgacaagcgggtcccacccgggaccacgcgtagtgagcccagtccaccggctctctctctctcctcccctcccgcgcgcgcgcgcacttgggccgccttaggccggccggcccatttaactcggccggtccgctccaattcccttgggccgcgccttagccgcccgaggaaaagtctataatccctccctcttttcttttctttttttttccaaaaaaggatttaattaaatccttttcctttagacaaaaatctaataatcttagaaattcaatatcttcctaaccttagatccgtttgactccgttcaacttccaaaattcctcaaatctcgagatctatctaatggcacgcttagaggtcattattagggcttcatttttgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacataatctgttgtcccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatcca

SEQ ID NO: 44634 - DNA, 1501 bp, Oryza sativa
aggtaccaaatcaatatgataaactggatggcagctttaagtagcagtgtcagggcaccggatatctttaatattcctgttaactgcactgatttctagaaggtacaattcaaaagttaatagtacacaaaattagagaacagcgtaatgctttcaaacaatcagtaccatttcatggatgtgaattgatggattttctctcaataatagatgcgggtcacttcctgctcatttacccaaagcagaacataggtcaaatttcaacaaaagacgcaacagaaggtcgaaagttgttggaaactcagcctgtatgatgtgcactaagtggaaggtataaatgaataaaatccaaaagtacaatgaaactgcaaaaagaataatacctccatttgcaacaatgtccacttccataccagcctgtcaagaaaaataaagaatgactaattaactaaaacatagagacatatgcacatagagttggttcttcccaacacatagcatgtcccaatatcacaatttttttgccacttgaagaaaatatatatgcttagtaaatgcaaggcaattttcttctcttcatttcaaaacctgtcttatctaacaggactaatatttgcacgtgtaatcacactttcagggagaaaaaaaagacacatttttaagggagaaccaaaaatcaagggcattaatcaacccgaagctatgtccgctcacgctttcagggggtgcaaatgaccaccactgcattagttacttcatctgtgcaatcgcacaactgacacacaccacatctcctttctttactagttattaccctgctatctaaccgaggaccatatgctacactagagaagtgatgaattaagtgcaaaattcatgaaggaatattaactatcacagcacatcgaaatacacctacagctagctggagggactaagctttcccaatcaaaacaaaacagaactaatatgagatgatgggtttgggaaggggatcaatacctggttggcgagggagagggagtggtactgcatgcgcgggctgcgcccaatgtctcccagaactaccaccgccgctcgcttcctcctccctgcctctagtgccacggccattgcctactagccttccgagtttggaaatttcagattcaaccgccaccaagaagtgaggttcctgaaaaggcatttaatttagctaggtattagctccaaacatccaggaagggaggagtagataaaaaatggacaacggttctcttggttatttttctgttcaccgcatttatgctcaattagagaatacgtctgtactattttacatcaatacaacaatgttctgttgacggaacaagaatgtagggatgcaatatatgctagtgagtttatactcatgtaaattaattcgttgtttcgcatattgttgaacgcaactggagattcattagtttgtacgaatgattggcaaccaacactcggatagtatcggtactgtgtattccac

SEQ ID NO: 44635 - DNA, 1501 bp, Oryza sativa
cgacgtgtacgcactcactagcttaagctcgtttaattagtttttcttctctgtgtttctttctagcagccgaaagcgagagctgggggctgcacgccaacgcgacgaaacgtcgtctcgtcctagctagcaaggaactttcttgcccggttcgattgttgccgtcatgtggtcgttgatcgataatactatgctagagaactatggtgcgcactggtgcgccatggccccacatgtaagcgactgcggcgcccgggacgatcgccatgtgggccccacatttcgtacgctgctgtctgtaaccgcgacgactctgaaaattgaacgaccggattttgtgacatgtgtgccctttggagcgtgtcgtcttcggtagtgtcgagttttcttcttcaaagtacacagttgagtgctggctaattaagcctcgggtgcagtggccgagtggcgccaccacctctgcacgtctcgtgcatggcattggccttcatgctgttttccttttcgatttctaatcgatcgtcacttgctttttcagagactttatttctttgatttaccctaatatacatcattctgagaattttctgttgttaattagttgaagtattttattaagagaacgtgcactttgcaaccttgcaagtacaaaatattcatcgagacggctggtcgtgcactcatgcatttcctagaagctttacgtcgggccagttctcgtcgaaaaataatccttcgcatgcatagactctctgagaaattataacagtttgccagttctcgtcaaaccttggaaaaaatggagtacaactatcaaataatttctttttattctaaaaacatgacgcatagcttaactgtttttcctaaggcaacgagacaactctatattatgcatgtatgacggaattggattttttttttcattttttagtgtctctgaaccatggatttgcttggttgcgtaggctgttttttttaacggctcacatcaaacagtgcaaagtttatattgatagagtagaaaaaattataagattacaatcataggaggtcataaccagaaaaaaaataaagaaaagaatcgttcattgtaaacattccatcaatgcacctaggtgccacatgcacagtaacacatgttatatataagttggtttgatgccaagaaaaaatatactacaatcgattaaaatgccatcttcaaccaatcttcacgttttagtcacagtcaatattgtttagacgaaagaaaaggagggtttcctgtagaaaaacggatagtcaaaagaaaatctttttcacccccacctaattttggatcgtgcacagcctccagcctcagactcaacgtgcacacgggcgcacttgcttgacacgtttctttacacacgatggagcatacatgagggcccaaacggtgcccaaacctaaccaccatgtgcgtgcgtgcgtgcgtacgtactgtacatgccccgctagccgtagccggccagagtaa

SEQ ID NO: 44636 - DNA, 1501 bp, Oryza sativa
agtcgccggcggcgaggtcgccgaggcactgcgacacaccctgcacgttgccggagctgctcaccttgtacccgttggcgaggccgccctggagcgcggcgaggacggcgtcccggttcttgaggaagtcgccgtcgccgctggtgctggtgctgcacttgcggtacaccatggcgttgtcgggctggccgacgaagttgctgctgtcgtagcgcacgtagcacccctccagctgcagcgacgccgcgtacgcggcggcgcacacctcgttgagctgccccacggcgtcccgcacgcacgccgcgcagtcggcgttgcccaggtcgccgcggcactggtacagcccgtacgccgccgcgccgtccccggtgccgttgctcccggccgtgaagctgttgtacccgccgttgggcgccgcgttggcgatggaggcgaggagcgagttgaggttgccctcgaacggcgtgcccggctggtacttggacggcgagcacccggcgtagatgaacgtgccggtggccgcctcggcgaccgtcgcgccgatcacgacgagcacgacgacggcgtagcaaagccggtcgagctgatgcatgactgaactgacggctctcgcgctagctagctgctggcttgaagcgcgctacgcaacgcccaggcttggctgggtcgaagcaaagcggcgaatgcttttttccgagtccctgtcgcgagagcgaagagaaggtggtggggagcacccagaataaatgcgagctttttagttaagctaacgcttcctcgatggtctgtggtggtgcgcgcgcgcggcgtctctggaatttatacgtcgactcgacacggcgatgcatcctccttgcaccggttggacctcgtagcggttggtcgggtgactctggtcagtggtctactggctttggtccctcccgataactatgctctgaatgattgcttcggtacattcagttatccttgtgctgtaccagattggggtaagacggtatgggcagtgacaggatgcaacctatcataatctgtggcatatggtctgaagataaccaatgccgtttcgacgagtgcactcgagcaataggctgtttgactgaatgctctgcctcttcagtctagactgggaatccgggatacggggatgggaacaggattttgagtatttttgcttcgccaataagcaactgccatttccacacaggcatacagctgatttcatcgcggctcctgcaggctgcggcccttttcacttgggtgcggttgcgtccgtggctggtacggatgatacctttgtaattctgtattccagccaacaagctcgcaaccctaaagttgacatgaaggggtcctttgctgcacacaaactaacgtggtagcgaacgtgtagcttccaaaagtgtaataagcgaatttgttttgggaagatttaccccctgccaagtgccaaccgagagagctagattcgtggagataaaaagaggaacgcgtgaaggtg

SEQ ID NO: 44637 - DNA, 1501 bp, Oryza sativa
ctcgccggagtcgccgtgccaaacgtctcgccgaccgtcttcggcggtgttgtcatcttcctcacgccgttgcgccgccggaacacgggatatcctcgtctggccggtggcgacctctacctcacagcgccttcatcggtgcgcgccgtcatcctcctcacgcgcgctgtcgtcgagtccggacgtgccatcctccacctcgtcgaggtttgctgggttaacccggagaaggccatctccgtgccgtcttgctgtcatgccccgaactagtaccgaccggaactagcccgtgacgctccaaattaacctgttgatcgataccagtcccagaaaacagtgctggtatcacagggagacagaatatcacagtaacagaggtctctttattatagagtagatgtacagtcatgttgggctgcggacagatcccgagctcacaactgcattacaaaagaaaagtggaagccaggacttggaccaaataacacaggcgcgacttgggaactaggccgaaaccctaaaactcatcgtagccggcttgctcctggaagaactcctcatcagcaggatccgcttcatcttcttcagcaactggggggggggaattatttatatagagcaagggtgagtacgggagtactcagcaagccatgggaaataagtgtttaatgcaggcttcaaggaaaggctgatgtttttgcaattaattttatttgaactcttttctgaaacaactaagtaagtgcttctcaaacgacacggatgagacagtgcgtctcgtccggtcggagtatgtgcaatgtatcagtctttagaatttaaacaaggttggcacccggccaacagcttttacaacggccacccgggccaacaacttttcaaacggccacccgggcctagctgatcccatcagctacagatttttcaaacaccgaaccccttttcacacagcaatttcacaagcagtagtcaaaccaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaag

SEQ ID NO: 44638 - DNA, 674 bp, Oryza sativa
gatcaccccccatctccccctgacacgctcctctcccccttcctcctctccttcttttcctactacaccataaatttttaaaaaataaaaaaacaaagttaaaaaaatttatgtatagaaatactatatataaaaaatatttgaattcaaatttaaatttgaatcgggtatataaacttttgacttataaactttggttctataaacttgagatgtataaactttagatgtatagaaaatactatatataaaaaatatttgaattcaaattcaattttgaatcggatatataaatttgaattaggtatataaacttttgacttataaactttgggtctataaacttgaggtgtataaactttagatgtatagaaaatactatatataaaaaatatttgaattcaaattcaaatttgaatcggatatataaacttttgagttataaactttagatctctaaactttagatgtgtaaacttgagatgtacaaactttagatgtataaatttactaaaataggaaaataaagtaatacggtgccaaagaaaaaaaccacgtggaggagaggtgagcgatcacccattaggaatctcgaatgtctacagtctacgtacgctgcattcatccatgatccatccggagaggaaaatgacaaatcaacagtcatgctagga

SEQ ID NO: 44639 - DNA, 1501 bp, Oryza sativa
ggtgtttattgcagactttcaaggaaaggctgttgttttagcaattgattttatttgaacccttttctgaaaacaactaagtgagtgcttctcaaacgacacggatgagacagtgcgtctcgtccggtcggagtatgtgcaatgtatcagtctttagaattgaaacaaggttggcacccggccaacagcttttcaaacggccacccgggccaacaactttcaaacggccacccgggcctagccgattccatcagttacagatttttcaaacatcgaacccctttccacaacagcaatttcacaagcagtagtccaacaaaactacgctaggaatcacctcacatccgcccatgaccgtgggcacggctgttcgaatagtttgttaacctctgcagagggggtacactttacccacacgacattactaacccggatcacccagcccatggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaattcatttagttcgcaagcaccgacccaggtgtcgggttttccaagtcttttgtaaaactccagttttacccaagttgttactcaaaattttaagtttgaaggcgtccgtcgatactcgcgcagggtgcacgaatatcgagacgcaactagatggttacaaggggacatggtatcacaattaacaaaggaaggatcaaatgcaacaaattaggtaggtccgccaatctgccttgcagacgggacaagcagattaagtgcagtcctatcaatgcataatatttttcaagcaacataattaaattcaaatataggctcaagacgttcgaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctggagatttgaggaattttggaagttgaacggagtcaaacggatttacggttgggaagatattgaatttctaagattattggatttttggtctaaaggaaaaggatttaattaaatcctttttaaaaagaaaagaaaagaaaaggaaagagggagggaaaatagacttcccttgggcggctagggcgcggcccgagagaaagggcggctcggccgagcttaa

SEQ ID NO: 44640 - DNA, 1037 bp, Oryza sativa
agggttcacggccttgtttaataatactgtgtagctctaggatcgtctttataaaatggctttgggcaactaagtgacttttaaatgctgcttttcagcaaaacttaacccctatattattaccccttgtacccccttgcattaatcatgcatctgtcggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaattattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttacccttttcttccttcttcaaatttcaattagtactagttggtcagctttgtgaagaagaagacatcgtcagttgtttgccgaagctccggaagactgcaagatccgctagcgaagcaaaggaagcagtgaagccagctgtgaagcaggagtgaagatcttggaaaacccatcgcagaacctaagccaccctctagggtagagtcgtttgtcgtgtgtttccttgcttgtgtgtgtagcgcgtggtttgcatcagtggggtgtgatgtaaccatgctaggttgtttgcttaatcaacttgcagaataagtgaaacaaacagcacatcagcaagaagaattagttcctttaaggtcttgtccctagttctggtctattcttttcttgtatgcttcccctctcaacctctaccttgtgacaga

SEQ ID NO: 44641 - DNA, 1501 bp, Oryza sativa
tcctccctcccgcgcgagcgcgcgccttgggccaccttgagccgccttgggccggccggcccatttagctcggccggaccgccccaattctctcgggccgcaccctagccgcccgagaaaagtctatattccctccctcttttcttttcttttattttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgtgtgtagtttcggagcccgaagacccgcagtgcgaggatttagaggattaagctccagatctcgagcaaggcaagccacctttgaacatctttagcctatatttgaaacttaattatgttgcttgaaaaatattatgcattgataggatcgcacttaatctgtttgtcctgtctgcaaggcagattggcggacctacctagcttgttgcatttgatccttcctctgttaattgtcataccatgttcccttgtaaccacccagttgcccctcggaaatcgtgcactctgcacgagtatcgacgatcgccttcaaacttaaaatctgaaaaaacatcttgggtaaaacttgggttttacaaaagacttggaaaacccgacacctgggtcggtgcttgcgaactaaatgaatttccaaaaccgcggaccggggaacgtaccgggagtacggtttcccgctcttgcacttaaggaccgtttccttggaatttcatccaaacataagtcaagtacgaccacatgggtggaatgggacacccctggctgagtaactagcttatcaggggagccttgatgccgagagacatgtggatttgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggtggatgtgaggtgattcctagcgtagttttgtttgactactgcttgtgaaattgctgttgtggaaaggggttcgatgtttgaaaaatcagcagctgatgggatcagctaggcccgggtggccgtttgaaaagttgttggcccgggtggccgtttgaaaagctattagccgggtgccaaccttgattcaattctaaagactgatacattgcacatactccgaccggacgagacgcactgtctcatccgcgtcgtttgagaagcactcacttagttgttttt

SEQ ID NO: 44642 - DNA, 1501 bp, Oryza sativa
actctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgtttacacgattgattcctgttataaaaacaggggtccacagcgcgccgcctcccgccggctgtgccggcgtggctgccttcgggcgcaccgtgcgcctgccgtgtggggcccggccgtcagccgcccgcgtcctcgggtgcggctgacgcgtgggacccacggcgccggccggtgtgagcccgggtgcgcccggtctatcgtggaccgtgaggctgccgcgtgggccccactcccgtggacccggtccgcgcgcccttcccctcggctgacgcaataaaccttttttttaattaaaatttaagtgaagaaattcgcaaatattcatttaaagagcatataaacttcaaatggccataacttggccatttgaactcggaattggaccgttcaagtctctaatttttccttaataagtcaagaacccatttttgtgctttgttacagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaattggtttcacacctccccctctattcaaaaccctcaaaatggttttaggctgggctcagggtgcatggttttgatagtagcacctcggccatataaggaccggtct

SEQ ID NO: 44643 - DNA, 1501 bp, Oryza sativa
gaacaaaagggcctaacacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcagtgcggataaagcataggccacagcgggaggaagcaactggggtgtgtccgggggtgtaggaagggctaactgggtgtgggtagggggagtacactggcgagtacggcgcacgcgagctgggggagcgcgggccactgggagtgcgggcagagccacgggagctgtgggaggacaggtggctggcgtgacagagacggcctaagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccgaaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggtacacagagagctcacagtgagggggaacacggtccatggagtaccccgtgtactcgggacacgagaagccaaggaaacgggcgaggtcacgaagctgagcgacgtggtgaccctcaccaaaaccgtgggaactgaatctggcgttcactgccatctacaattttgaaagagggaggaaaagatcagtaacaattttagaaacaaactattggaaataaagaaaacaaaagaaaccttagcttttcgtaagtagttttgaacttagtatccttagggtcgtcctaagcgtcgggtttcgccctagggccaagcctatgctctgataccatctcttgtcacgccccgaactagtcctgaccggaactagcccgtgacgctccaaattaacctgttattcgataccagtcctaggaaacagtgctggtatcacaggaagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagccggttccgcttcatcttcttcagcaactggggggggggg

SEQ ID NO: 44644 - DNA, 1501 bp, Oryza sativa
gcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaggatagaccgacttgcggtaggagtgttagaggtaaagcggacttgctttcctccaggtccttgcaaggtgatggacttttcggcacaatctatctgtcctttgtgcttagccaaccaatccatccctaggatgatgtctaagctttgtgagtctaggactatcggtttggataggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaggaatgggaagctcccgaatcaaacagaactattgcgggtacggagttgacagagaacatacccatcacaacgtctggagcatcctgagcggtctcagcttgaatgtggttcacccggcctcgaccaaagttgttggaagcacgtgaaccttgtccacttgcctgagagctaggacgagactgagctgccactggagtaggagtcctggcagtgctgccattagcatgccctgagttggtgttggtaggattctaagggcactgtctggcatagtgacccatctggttgcactggaaacactgaactgctgacggtccctgcggtgtcttgaaagaggtaacactgtttggcgcagtattgccactaggggcacgctgctgtggctgaggtgccggacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcatcaagtagaagtgccttgttgatcatatgttgaaaagtgggaaagtcatgagcgagcaactagagtctcattccaactgcgatccctttcaagaacttcctgatcttcttcttgtctgtgtccacttctgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggt

SEQ ID NO: 44645 - DNA, 1501 bp, Oryza sativa
gcttggatctattgttgctcatgtgagggtggccatttccatgcgcattatgctgaaaaccggctacggctgcggctaatccttgcaagatttgtgtctgaactgccatcaggtgctgcatgttgttttccacatgaggtggggaagggaggcgttcttctccagaattgtgactggcagggcggtgagagcggtgagactgttccatctctgcatcacgggaagctgtgcgatgcgagcggttgctgcggcggggttgctcaacttctgcgttgcgggaagcagtacggtgcgaacggttgctatggtgagactgctcattagctgactcatgattttcttctggctcaactctaccttcttcaaaaccgaagcaggctggtgcacgagctgcacggcggggacggctagccatctaaactcccagaagagggcggggtaagagtcagataagcacttaggagggcaaggagcaaagtaaatagcaactcagatagcacacacttggcataaactggatttttcaaatcataaaaacacctgatacaacgggtgtggacaagtcacagagctacgccgagcttgactgtgcgcacaccacctaggagaaccagactaccaaacaacacccacaacaacacacgcacgcactacctcgccacgactccaaaagagttggcggcggaacaaaagggcctaacacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcagtgcggataaagcataggccacagcgggaggaagcaactggggtgtgtccgggggtgtaggaagggctaactgggtgtgggtagggggagtacactggcgagtacggcgcacgcgagctgggggagcgcgggccactgggagtgcgggcagagccacgggagctgtgggaggacaggtggctggcgtgacagagacggcctaagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccgaaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggta

SEQ ID NO: 44646 - DNA, 1501 bp, Oryza sativa
gctaactaaatgtttttcatcatgctctgttaataatgtactgtcatatgtattgcaattatggagccctgtatttgtataacaaaaactagaaagtagtcattgtccaaatcattttcagtacaatactctttgctctgctttctgcaattccagttgtatagttaaatcacaaaattaataagacacacaaacttttattcattacctcaaatacatacaacaacatgggatcgggacgggcaagggctaacatattacagcttattataaaagcatatagtttcatgaccggctgtacattattgtcacatcatatgattataaccagctagtatagcagcttatttatcatctggcgtatcgtacccaataggcttatttactatttcccttgttcctcacaaagtggctgcagactgcatcagcgagatctttaaaccggcaggtcggtattctcatcaaagggaaatggcgccaattttgggtgtgctgcttgtaagatctttccaattggcatttctggcatttgatcttgcaaaggctccaatgggtcaacatttgaattataatcctgaagcaacattcataattttatttaaaaaaacatctcagttgcaaacaatacatgaattctattttgcatgtttttggttttgtagggtggcactcaccaggttagcatgcatcctcttgacgaaagttttgaatgtgctgtagttctgtccctccagcagctcgtctgataatcggaggtaggtgaatccaaatagcttgtgctcaggaggtccattcttgttgatgcctgtcggccttgaattccttagtattgtgttgtaagctgttgcatcgtatcgaccgagtgcgttttcgcatgccacatgtaagccctctctccatccagcactcaggacctgccatttcatagttcatagccagaatattttgataagtgctcttgtgctattctagaagaagagcaatgcagaagttctaacttatagaccagtaagtactagtatgtaatagtccgttatttacctgttggactagttcttctggtgcactctttgcctctgagctttgttcagaatccctcatctcagcacatgtgaagttaacgcaggcacggtgccttgtgagcatgcgtgcgatggttctgtagccatctctgttgtccaagttgtagtatccagcagtgagctcagctgcatggtttggaaccctataccaccaatgaatgccggagatctgccagcaaacattggagcatgtgtcatttatgttctagattcaacaattaatggaacattatatatatatatctgttgcctattcatctagcctgtagtctaatttgaaatcattgaagtcttcaaaattatgtactataattcgccgagatctttagcatgatacttactttgattgccagctgcactctgcatcccaagaagaccttgtttgcttcatccaagatcttgtctccatgttttatcag

SEQ ID NO: 44647 - DNA, 1501 bp, Oryza sativa
tagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgattctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgacctcacctgtgacggccacatagttggagcccgtcacaggtgagtttgactagggttgacctagggttggacatcttctagatcgatccagatccggcgcccactctcactc

SEQ ID NO: 44648 - DNA, 1501 bp, Oryza sativa
aattgtgacgataaaagcgccagtcggcggcagacgtagacagcttgcgttgaagatgatgacgcatattagcggtgacggcgacgtagccaaccgtgaagaagatagcatcagtcggcgtcataacaggccagctatgcaggcggaaacaccagtcggcggtggacgaggcggccggtcggtgaagatgatgacgcatattagcggtgacggcgacgtagccaaccgtgaagaagatagcatcagtcggcgtcataacaggccagctatgcaggcggaaacaccagtcggcggtggacgaggcggccggtcggtgaagacgtagacgcccaacaacggcggcataataggccagccgtgcaggcggaaacaccagtcggcggcggacgaggcggccggtcagtgaagacgtagacgcccaacaacggtggcataataggccagccgtgcaggcggagacaccagtcggcggcgacgaaggcaagccggtcggtgaagacgtagacgcccaacaacggtggtgtaaccaaccaaccgtataggcgaagacaccagtcggcggtggacgaagcggccagtcggtaaagacgtagacgcccaacaacggtggtgtttccaaccaaccgtataggtgaagactccagtcggcggcgacgacggcgagccggtggtgatgttctgactgatccattcctggagcgtaagagataagcttaaagccatgaatcccttttatgcatatttggatttggatcctgcagaacaaacatataggatgagtagtatcacggaacaaagtttcacggatcagaatttactacttaggtacttttgcaattattaagagcagaaaataaatttatctcatctctatgcttttgatttattccgaataatacttagcaccttgcgttactcggtccatccaacgaacccccgggtgctaggaatcgacccaaaggcaaccatccattggcaaaccaaacggaaagcataggaagatagaactccataactcgataggtacttttgtactcagattatgtcgcaagcaatcaagataaatgttatgaaaaatatgatataacatctgtagcccccgactcactactcaatggaaggccaattggtgtagtgaggcagaggaaaaggaaaaatatcatataaagaataaaataaatgatgacttagctttatcgtattcccttggtgacagcagaagtagccgatgtgggaacgaagcagtccatctcaatagcgatgaaaacacctgtcggcggcgacggaggcaggccaagggtgaggtcgtggacgcccgacaatggcggcataataggccggccgtgcaggcggaaacaccagtcggcggcggcgaagtccagccggtcggtgaagacgtggacgcccatgaacggtggtgtgaccaaccaaccgtataggcgaggacaccagtcggcggcgacggaggcaggccaagggtgagattgtagacgcccaacaa

SEQ ID NO: 44649 - DNA, 573 bp, Oryza sativa
ctttggcctaagcaaaaagtgcctaagtccctaaaagaacgtgacaggccacacctgaaaatatgggctgcagacatattaggcctaggccaaaaaatatgccttcgataccctttgaaggatgacgcatgtaacatgctcccgggtgatatagaccatgtgatctgagtgattatcccttatgggatactccaaaatagatataaaaattgaatcccgactggcgcaagtattcggttgatataaattcatgttgcatgtatccggaacaagtccaaattggagacataatacttgtgtttgaactagtaagcctctgagcatatagcttgtccttctgtcgtagtcacaattgtctattgatggtagctgacgcagttggcatagagacaagacgaccaatatagagataatattgcccagcagaggtgacaaaaatattgatggtagtgaagatagtgataccaatcaaaattactgaagtcgcatagccatggaggcgaagaaaccagtcagcgacagacagatcaactaacaatgaagatcaaaggcggtgacgaaatccatcaatca

SEQ ID NO: 44650 - DNA, 1501 bp, Oryza sativa
agtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaatacatagttgtgaagatgactcctcgtccaagtcgaccgacggagcttacacctcccaagtctaagctatcaattgaggctccccgtggactggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtaagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaa

SEQ ID NO: 44651 - DNA, 1501 bp, Oryza sativa
tcagtgtttcaaaaaaaattgatgtgcacataggtgctcctgtaccttcccagtcctaatgaactcctaattgtccaacttgtacgttgtatcgaccctcacgttgctgcgtgcaggacttcccctcgctcgggacaaattatatatgcacgcggcgacttgttggaccaagaaacttgtcattattaattgctagtttccacatcttgcctactcgtgtggaaaagcccgaataccggtcaagtgacaactaatactaactaataacaatatttccaattctactgcagtagtgcactgtatcattttcttcctcttttttctagaaaaaatatataatttaaaccacatatataaacctgaaaaacattgttggataaatatacgtgtatatgcatataagtaaaactcgtggcgtgaacaattgacgcaacagatcattttccactagagttggaagtgcggtacgtgcccgtgcctttacgcaagccaacaggtcatcagccatgcatctttttcctcgggtcaaggggaagactcaacagattaatttccaatcatcattagtggcttagtgcaacaattgtgtgcaatattataccattaattgtcctcacgagtgtctgtccacgaagaatgatttggtacctcagcaacagtgcctcaaccgttgaatattctttagcacgccagggcacgttcggtttaaatataaaatttgctcaatcaagttattggcactattcttagaatgtgcccaatatactagtcatatttagttacggttggacttagagttgtaataggtgttaggggatgaagttagagtcggactctgtaacccgacaactctcttaaatagagatggggataccacaatgtaaccatggtgactataatatagcatagacatgcaaatagataatggcggtgagatcatagactcgtagcggctagaagctatattggttgggtaggagcgcccataatcagagcccctcaaattttattaaataaaccaaattttatttttttaataattaatactcaattttcatatgttaatggttgcctcgttttgagtgcaaaccaaaagctcgattataagagaaaatccaggaaatgccaataacaagcacacaattccaagaaataccattcacaagtgtaagttccatgaaatgtaaccatacaagatactttgtcccagaaatgccattgcctttacggtttggttattaaccctccgttaagtgttataggatgaacagtgtacttaacagcgagggatggcggaaccttaacggcgatgatatttcgggaacgaaatcgcttgtacgatggtatttcatggaactcgcacttgtcgatggcatttcttggaattgtacgcttatctatagcatttcttggattttctccaagtataatgcacattcgaactaagccttaatttcttcagcaaaatttgtcacaggacacgcaaaaaacgtgcaattgg

SEQ ID NO: 44652 - DNA, 1501 bp, Oryza sativa
caagggccaggccagcggcacttgcaacttctctggcgccgcttccatcgtattcaagccatcgccaagtaatgttttgctctcaatctttaagatcaatgaggctttcgcaaatgtgcattcatatcttgattccatctcattgtttatttgtcctgtgaattgtttcccgagatataggcatatgtgatccgaacccaagttggtgcgttgcgaaatcggaggtcggggacgcacaactacaaaatgcactagactatgcatgtggtagctgcgcggactgcagcgccattcaaccaggtgcacggtgctttgatcctgacactaaggtagcacacgcgacctatgcattcaacgatttttaccagaccaccggccgggctagtggatcgtgtgactttgccggtgctgcttctattgtcaaccagcaaccaagtgagttttctctcattttactgtgcatgatatatatgccctactgctactaatgtacatattccctaagaaaaattgcacacttctgtttcaagtagtaagtggttatcttattagtgcttgttcaataatttacagaaataggaaactgcgtgctcccaccaaacaatgctgggacagaacaaactgcaattgaagatcaatcgactgcaaacttaccagcaacagcttggcagtgaggatggattaaagaatcacttcatatttttctgcagagaaaaaaataatggtaccattaataattagttgggattgaagagacgaataaatgtaccgttcactcctgttgaatgaaaccctgctgttagtattcaaatgattgaaccaagggatgctctcctcaggcgactctgaggcgacctagctgcgccggcggccactccggcctcggcgtccacaccccgccgctgctggccacctcgaccgcagcggaaagctcctagcgccgacggcaagtctggcccctcgcagccactctcgtcgccgtgacatcgtcttcttgtcatccactatgccgaccaaccaaagagaacctcccaggcttcttcacaggtcacagctcccctcaccgcgcgtctccagcgacttcactcagcccccccatcgctctccctccccagccgcgcccgttccccccttttggctcgactcgccgctgccaccgccccccagatccagccgtgccatgtcgccagatgcagtttcggaggtccctgagaccccggatccgggggctgggacaccagatccgcgccgcctccaactgtttgccgatgtggtgaagcagcccgccttaaaaccccgtttgaaatcgcatttaacagtgcccgtcaagagcaactactacctcgccaaccagtctccaggccaagatcgacagcaagcatcctacgaagctacaaagcgagggagtacggcgaggagactctcccctgtccagtcgaccagcggcaccattaacactcgagacggaggttggacgccggtcagaaggcgcttctggtgg

SEQ ID NO: 44653 - DNA, 468 bp, Oryza sativa
gccggccatttgcccattttcgctcattttcgctcaatctgctactgacttggtcacaaattacactctgtaatggaaactttcttttaagttaacggtccagagcaatctgcattctacagcactagcgagctgtgtgtactgcagtaatttctcagataagcagatttttggaatcccaatatacagtgatgtgtcctacgcttctgtaggtgattctgtagcattgggctcgtgtggccaagctcttgaccacttatcacaaaatgacaatatatacagtttcaagttccaactcgaaacaaaaacaagcaacaagccaactacactagcgatggcaagctctgctttaggccctgctacctgggagacaattgtgtcacggtttgagaataaccagagcttccatcggagaaagatgctactggaatatgaactacaggggccggcagagtgctagtagcatcg

SEQ ID NO: 44654 - DNA, 1501 bp, Oryza sativa
gatcgtgactagtctcaagggaaacctccccgtagccgctgtttcgacatgtttaattagctcctaaaatgtacggagtattaaacaagatacttgtagaactcaatatataattaatactccctccatattttaatgtataacgccattgactttttaaccaacgtttgacaactcgtcttatttaaaaattttatgcaaatataaaaatacttatatcatgcttaaagaacatttgatgataaatcaagtcacaataaaataaattataattatataaagtttttgaataagacgaaaggttaaacgtttgtcaaaaagtcaacattgtcattgaaatacggagggagtaaaatttaggagcaatggattattggtcacgggagtgcttgcaccttcgcgcggtcgggccccatgaaaaaggcagtcgcgcggcaacttgcatgaagaatgtcgatcatatacttcccgaaaatctactgatcggtctaccgatttcacaaaattttatcgaacgctcagactgaccagtgtactactcaagatttaaaatgtttttttctcattaaccgcttatccgattatatcattgtattgttgtaattaaatctttataacaagatatcgcattattatattataataaaaaatatatatatttaaaattgtcagaacctaatgttttatacgtgatagtgatatatacccgtatgtgtcttcagtgtattttacaaaattcccgaaactacctaccactactctctctccatcttatccatacatgcacattctattgagcttcaaaatgatttttctcctaaactaattatccaatctacgatctgattacaccgttgtattcgttgtaattaaatctttacaataagatatcacatgattatattttaatgaaagaaaaacgtatgcttcaatccgttaatactagttgtttcatatgtgacagcgacatgtttcaacgtatatctttaccaagtttcatataacttttaaatgttccaattgatggttttttcatcattataacttgatgtttcgctcgttggtcaactggaatatttgaccgtccgattatttgggcatcgtgcgtctgatggatagattctttttatacttcctccgtttttaatatataacgccatcgatttattgatatacgtttgatcatttgtctttttaaaaaaaactactcctaaaaaatatataattatcatttatttcattataacttgatttaccatcaaatattctttaaacatgacttaaatatttttatatttataaattcttttaataaaacaaatgatcaaatgtaaacaaaaagtcaatggtgtcgtatattagaaaaagaaagatagtgctaccttagggtgaattaattagagccaaaaacaaaataaaaggatactgggagtggcatgtttttaattagtggaagtttttttgaactcccacatacggcaaagggagcggttttattttc

SEQ ID NO: 44655 - DNA, 1501 bp, Oryza sativa
tttatctttttttttttgcaattgtcatttagacaatttgggacaacttttgaatttgcaaaaaaatttaaatattagctattatttgtttgaattcaattcatacgaatagtcaatctttttttcaaagttatatatgtctctattggaagatggtattggaatagggtctctttttttttaaacaatagcgtgcttgacaatacaccacaaccgaataatgttatagcaaataccatgaatctagagtatcctgaagtcaagagacctcaatcgtggttcctctcgtgcgtaaactctgctaatcccataggatcaatagccttgataaggacagattgagcatatataaggctatgtttagctcttagggttgggcattaatcccttgtacatgtaaaataaagcgacttgaacaacttttttatagaaaaaaaattgtaaaatacacaccgtttaacagtttataaaacgtgcttgcgggagagtggaggttacgaaaaataagaaacacacacagcctaatacatcatttaataataggcaacaactaggagctacaaatatcatgctcccttcagcttttaatatttgacgtagttgacttttgaatgtacctttaactattcatgtaatcgtgttatttaataattttgtgcaaatatgtaaaaatacgagtcatacttaaaagtacatttagtgaaaaaacaaatcacaacgaaaataatattacacatatattttaaaatttaatgacgttaaatattaaacataagagggagtactatatactccctccttatttcttattttaatgtatgacgacgttgactttttaaccaacgtttaaccattcgtcttattcaattttttttgtgcaaatataaaaatacttatgtcatacttaaaaaatatttgatgataaatgaagtcacaataaaataaatgataattacataaattttttgaataagacgaaaggtcaaacgtttatcaaaaagtcaacagcgtcatacattaaaatacggacggagtattatgtagtgtgtgcaaggcacatttctttacgtagaaacaaatcttgtttttcttatttcactcatcatcaatgtcaggcaaaattcacccccattatttacctttgtacatggcctaatacgattgttttgaatcgaaagaggttcaaataattacacttgactaaatgctagtagtagctatcatgttgatccagggatcgtggcttggggtggtttccatgagaatactctcgaccaacttgcattattcctcctttttcctctttcagacgattcagacaatgaaacggacgctacctacgggctatggcagcattgcatgcatgttgccaacttgccaaggaggcttgtactacttccgcagtatcttatcctaaaatgagttacttttttacctaccatattttctcaactaatcattaatattcttcaattaatttattcaacaatttttttctcaa

SEQ ID NO: 44656 - DNA, 1501 bp, Oryza sativa
aaatatctattccttaccattgtattattttgatttgttcaaaaaattttcatccagttcgtctccaagttacaatgtactactgatttatcaattgcttctactccatgacatattgacaatggattggatagtttttaaaagggttaattggatccatgttactgcaactttgcgaaattaaaaaaatgccactactattcatcatatcggccacatgccactggaaatttctataattaaaactatgccactcccgtccctttttccgtctcctctctcacgccgtctccgttgccgtcctcatcccctccctccttcctcatttccgttcctgacttcatccccctctccggcgagcggtagagcttgaggagggagttggtaacgacagggtcccgttcctgcgcacgccttccctttccctctccgtcgccgacacggtctcctcctccccgccactacatattcctcttgctggtgaacttccattgcacgcgcacaagcacagtcatcacagacttcggcgatctccatggctccatcaggtggggtgcgcgagcgcatcgcacttgaatgcatgctcgtgggcgaggcgcgcaaagcctgtggatggggaaggggcgggaaagacgacgacgcgagggcggcgaggaggagggagaaggtgaacggggtgggcggcgaggcctcgcggatgcggtagtagagggcgagggaggcgaccgcgggcgcacagcgctgggacagcgcggcgtggagcgggcagcctcgggagggggccgacgagaaggcaccggcagaggaggaggaaggtgggctccggagccaaaggagcaggcagcggaggcggtgtgggagctcgggcatggcgggagggagccgccaccgtcgttgtcctctatccgtgacaggaggtctcgggagctgccgccgtcgccgtcctcgacaccatccacggcgggagtgctcgggagccactgccaccactgccgtcatcaccgctgtcctctttgcagtcgcagggatggaggaatagatggtgaagaaagaggagggagatggaaacgattaaacatgggggaacgagatagtgaaaaagtgatgggagtggcatgtttttaaaataaaaggaaaataaaaccgctccctttgccgtatgtgggagttcaaaaaaacttccactaattaaaaacatgccactcccagtatccttttattttgtttttggctctaattaattcaccctaaggtagcactatctttctttttctaatatacgacaccattgactttttgtttacatttgatcatttgttttattaaaagaatttataaatataaaaatatttaagtcatgtttaaagaatatttgatggtaaatcaagttataatgaaataaatgataattatatattttttaggagtagttttttttaaaaagacaaatgatcaaacgtatatcaataaatcgatggcgttatatattaaaaacggagga

SEQ ID NO: 44657 - DNA, 1501 bp, Oryza sativa
tgaaaacgctcctttcttgtttgagctggtctccccagcctgtggatgtaaaaactctctttatataaaagctgggccatctggccttctatcaaaaaaaaaaagttccagaaatcattctcgttgaatcgtagtatagctcaaatatgaatagaggtagaaattaatgaccagaatttactttcccaattagctagtaagagcatctatgataaaatccatcagcatgatataacatgaatggaggggaaatgtgacattaaattttatgaaggataaaaaagtgatatcatgcagatctagccaatggctaggcagatgaagacaaacaggagcattgcctttttctatacaggaggaatgagtacaaccaataaactcatcccaaagccatctgtttcaaccttgtgagccaatgagctgatcagctgaacatgggaaaatgagggaagagaagcacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaatatgaagattggcgaatccagctgttgtgctgcaacaatttgtttcatagcaaaaggggaggctaaaatgcctgctaaaatgctgcatcgaaccgaagccaccagatgagttggacatgattacatgagcccttttacagatggaaaccgcgctaacaggggaaatggatttgatggatctttgtatctggaccaggaagaaacgttttcgtgggtatggatgaacaacttgttagtgccattgctaccaggtatacatgtatcctgtaggatagtagttggacgtgggtgtagctgcgtaggcgaacagattgattcgttgtgttgttgcttgtttgtgggagctcagcatgcaagaagatcctttaatagctacccttccagttcttttcctcttatattccttgagaagtggaagaggctgttggtttcgcagagggagagaccgtgggatggtggaaccatggaagatgaaccaaatgacagtttttgatcgagccatcaaggaggaggcgaatcgatgaggggaagaggactcgacaacgcacgatggagaggcctggtgatgcgccgcctacgacactagtcggaaggaggaagaggaaaggttcactggctggcccaggtgggaaaattgggctggcctcagcgagcaagagaaaaggcctcgaggaagcaatttgcaccgttaagaacgtgaatccaacggatggaaataagtggtgacgtggctcaacctcaaagcaggaaattgctaataactacactaagtggggatgatttgtataggtatataggatttgctcgttgatgcttgttttgttttccgttgaaattgtatcttttatcagtttgtaatcaagaattgtaaagttaaattataaacatggagatacgaggaaa

SEQ ID NO: 44658 - DNA, 1501 bp, Oryza sativa
ctcatattacatatgattatgttttttttttgcataaatttacatttgttgactcaaagtacacattcctcttgtctagtttatatttttttctcaatttgtcactatataaaaaaatggacataatcctaagtgataatgtcataataattggttaaatatacacataaatgatcagaccgcgatgaacaacgattattgaaaagcagctaatgtgtatatgtactaaaaatatcacatacaatttttacaatatattagtcaaatagaagatataagcttgtagctggggttttatgaaacactttgccccaaaacctagggttatgcgttacggatggcccaaaacttgcggttttgtgaaaattgctctaaaaacataaatcttatgatattcaactatacaattttccaaaatcaatgattaaagttaagaatgtttgatttacgacaaaggtaaaacgaaaagtaattgaaacggacggattaacaataacatattttactcaaaataatatcatggagctttgagaaaaggttaacttgggccctgtttggaagattagcccaagactaatcttgagagctaatatttagtcatgaattggtaggctaaacattagcctaaggtggtatgtttggatccatgggctaattgaaggctaaatggtggagagagagtagaaagagaggagagagagagagagctgctttttgattgtccccacccaaaattagctccattagcaccacttaaaggggctaatgttttgaggggggctaatgcactttaacctcaaattagcccacatgtttggatccttgagagctaattcagggctaaaaggtgggggctaataattagcccatgaaaccaaacaggaccttgtacacaggggttgtgtccccaactcattggtagtggtagacttggtagtcagtgaaagggagggccaggcgctgcttggaaataaatatatcgtgggaatgattccaaaacacatgcgaatagtagtgtttacctcttactgcaaatagattatttcctagaaatacacatagtcaaatctttcttttttgctggatgtatactcaaacctttttaaataattcattgataaaaaatattatgatctaatatgcaatattagtagatttgttatgaaaaatactttcatataacaatattttttaataatttatataaaatatagttagaaaaaaaatatgaatgaaacacgtgccctagagactatatatggcgatgtccaaaacgtgaagtaaaaaataacagaggtagtgatagtgtgttatgcaaatttaggtgatgggaaagaataaatagttgggtaaaaacgattttacccataaccccaagagcaaatatcatacaactaataataaatagaaagagtggaaaagaaattaacactgcaagcttcactcgtgttcatccaacatacctccgttcaccggagcagaagacgacgccggcgagccc

SEQ ID NO: 44659 - DNA, 557 bp, Oryza sativa
taatggagaggctagtctgtgtcttgtgacgggtagtggagagggtaaccgggtggcgagcggtagtttgacgatggaatcatggaagggtgtagcggtgtggtatagagatgggctcgacgttgcgcagtagcagccatccatcatctagcaagcacgaaaaaaatgtaagaacattttcgttcatgtcatagagatgacaagcaaaagaaaaatagcaaacaacatccatcaccggcaaaagaaaaatagcaaacaacatccatcaccggcggactccaccctatcctctgcggtcagccacatggagcacgatgtgcaaatgtaggacctgtgcggcccatcaattcagatcaagtaatattggagattgcacgttaatttgatttctttgagaatattcttcattccttggtttcttggagacaatccctcaagggtgatctccttcttttgttatttagattgaatgagggtgataaagatgtagtcttaaactggattaggttgttgtaatcttttttttcaattatcaatttagatttttttttaacagg

SEQ ID NO: 44660 - DNA, 368 bp, Oryza sativa
ccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtac

SEQ ID NO: 44661 - DNA, 460 bp, Oryza sativa
aaaagtgtagaatattcagaagtaaataaaattattttctatatttttgagggtaatcactatattatttttttaaaaaaatagttattttcatcgtataggaagtagagaatagaaggaaaccttgacgattagaactatacagtaagggaaaaataactccaaaaataattacattatttttttcgcggggaacgggtagggagctcctgcaatttcccaatagaagaagaagaagagagttatcccacttataaagaaaactggacccaaaatccttactacggcccggttaatttatgaaaaaccggcgaaaaccccggcattgacggagtgaacctaaaatttaagtacaaccgtccagcaagggaaaagcacctaaaacgaagacttcgagaagaacacgtcgacagaacggcgacatcacccgatcctaacgaatctatggttttcacccaga

SEQ ID NO: 44662 - DNA, 1501 bp, Oryza sativa
tagtggcgaactgatattttcccatgttacccaaaatcacaattgtcctggttagattaagaaccagtactaaaagtgtttcaagtccctcaaaacattttagtctaggttgatgttaccgggactaaaaattgatttgtagtctaggatggtaacactaacctagactaaagataaagatgaatgatctttagtcccggttggtaacaccaacccgaactaaaaattaacaccaactcagactaaagatgtctctagagttagttcaaaaggacaacatctctattcaagttagatgtgtgtagtaggtgagatggttacgtacgtgaggactgatgagatggttacgtgcgtgaggactgaggtgagagatcttgaatttaaacccacatcccacatgtatttttcatttgctatgtaactttaagtaccggttctctcaactaggactacgattggctcatcccggttgctataaccgggagtaaaaaccgtttctccagcagtgtcatgatatggttgtcaatttgttttataaaaacattttactacttattataccataatatatagtgtaaaaatattttctacgtacaacacctcctcgggctaaaagtggtaatacgcgtttctcaagcttagtcagttgtgatcaaccataagcatgaaattatattcgtagtggcagtagtggttgttctctccaccacacaaaagtaaccgaaatagccacagggggaattaaaaaatgtgtgaaagaaatgaataccattaaacagggcagaattttcaaattagagccaattcgatcggctaggaacggaatctttcaagggtaagcgattagaagaaaagaaaagaccaagcaaaaagacaaagaagaagaagcagaatagtagttaaaaaaaaaacaagaagaagaagaagaagagaggaagggatccattaaaagccaaaccgttgagccgctgtccggtcactcggtcagcgcggacgagccgtccgacgccgacccgacacaaccacccgtttttaccacccaatttaccgaaactaatttaatttaaacagctatagtaattactaatttagtttaaacaggtacaattaattactcgcgccacctatccaatttcccacggcacatacgcgttcgtacgtgtcggcacatttcacaccaacacggcatggtgaagcgacggggaaaaaaaaaccggcacgacattaattaatttaaattaacgctcactgttcatcgccgtaattaaattaaattaaattgattaataccaaccctggtcgtctccctccttttttacccgcgcgcgtggactttttcgcgcctccgtctcttcgccctataaaaccaacgcgcttctcccctctcccgccaattcattcccttcaactcaaactcctcttcttcttcttcctcccatcgatctctctccttcgcgatcaactcgagctcgaactcgtctcgtggtagtagcgagcatgg

SEQ ID NO: 44663 - DNA, 1501 bp, Oryza sativa
caaagcaatctcaaatacattattgacaaaaacaagtttagagttgaatcaaagccacacataaattaaagcgataacaaataaggtgcccgcgcatatgcgcgggctaccttcctacactggtggagaagtgctttttagtcccggttcataaccccccctttagtcccggttgtccaatccggactacgaatccgggactaaatatcgctatctttagtcccgggtgaaataaccggcactaaagatcaatctttagtcccggttgataacaccaaccgggactaaatatagggatcttaccaaccgggactaaagagggaataacagcagtacagatggtcctctttctttttttttcttttttattttctcctgaatcaagtggcatgcatattcccaaatcccaaatcaaagtaacatcccaaatccacatcacaaatctttaagttacttatacacataaatcaaatacatcgcaaatcctaaaaaaaattacacaaatcaaattacatcacaagttctacaaaattcatcgcaaatacgtcacaagttcacatcgtatacaaatcaaatacatcacaggatcatatgcaataaatcacgaattcttaaagaaaaaggaaccacagaggtgccgctcggccggccgctgccgcctcctctccgcgccagccggccaccgccgcgcggcgcgccgcccgccaccgcgcaggccgccgccacgtcggccgcgccgcccgccacccgaccggtccgctcgatctcgctcgatccaaaaagaagagaggaaggaagaaagagataaggcagaagttagagaggaagaaagaaagagatagagtttgttgtgtggacgagagaagaggataaataatagggattatatagtacgtgttgatttttattcccggttagtaacaccaaccaggactaaagttagatctttagtcccggttggtgttacaaaccaggactaaagatcctaggcgcctaatatagtctgacatggtaccaaccgggactaaaaatcatatttagtctcggttggtatgatttttagcacaaaccgggaataaagatcatctaggactaaaaaatcatttttagtcctgatttttaatggaaccgggactattatagatttgggttgaccgatcaaatatggtttctacaccagtgcaaattgatctaaacaggcccatagccacattcatatactctctctctccgtgtcttaatgcatgataatattgttaacatttgaacaaatgtttaatcatttgacttatttaaaaaatatatatattttttaaaaatatgataaagtaactaacaataaagtaaataataattatatttttagtgagatgtgttttacaaattaattaacagcgtcatctactttaaaagaacagaagagagggagaagaatatactagttcgttaatttctcgccatcacgagatgagcttaattaagctatagtacccgtaccagc

SEQ ID NO: 44664 - DNA, 868 bp, Oryza sativa
cggcacgtggaggccggatctagagtgccacgccgccaccgctctccctccgcccgttagcgtcgcaaggtcattgccgagttgtttctatcgcgggggcgtccccggtcgtcgcggggtcgtcatcgagccgtctccgttgcatggatggtcgccgccccatcctctctcgtccaccctcctgcccgccgccgctaccatcacagccgtcttccctgccgctgccgcctcccctttcgcctccatccgcgccagcaccaccccaaacgctacccaccctccctcccgacgccaccactccggctcccgtccgctgctccaccgcccgccaccgccgctccaatcccattccttgcagacggccgacgggaagagagagagagagagagagaaataaggggggagagagggagaaagaagaagggttggagataagatgaccatgtgggccccacagtcagtgggtccattgtatttattgtgtgtaaatgacaaatgagtcccacatatctatttttaattctaatattacataagcgcaatgttaacgccacgtgggacgaagacaagtcaacaccgtcacgtaagcgccacgtctgcgcgaaaccaccctcgaaaaccattaagagagtcaaattacaccggtttcaatatttcagagagtcgttctattcggttttgtggttaaagggcacgaattagattcggccgacttttaagggagtcagagtggactttttccatacgtgaatagtagtagatggagtagtgggctagtggcaaactggtagagtccatcagcattaggcccatgctcgcgggagtccggctgggccggcccatgcacatgtgaggtgagaggccccga

SEQ ID NO: 44665 - DNA, 1501 bp, Oryza sativa; identical to SEQ ID NO: 38595

SEQ ID NO: 44666 - DNA, 1501 bp, Oryza sativa
aaatttaccgtgcgaattaaccgtacgtccaacacgaccctgaaactgtataacaactgtcaactattaccataataaattctcagatcaatcaacggtacatcgtatgtatgtacgactttacacggcataactctttgctagtagctatagtatacagcgtgcgtcactggagatggcgttttggagtgatctagcttaggccagaggctgtcaccgtggcagacatgaaacaaaatatatgactcacttttttattattttttctgggaaaataaacctcgatcactttggtcgccatcacgtacgtatacgctccgtatgtcatgccagccagaagttttcttgcttatgaaacatgcatgcatctttaaattttataataaatagcaaaaataccagtgcgttgcaacggataaaaataatttacatactccaattataatgactttcaagtttcaatgttagattgttagatcatatatatctggctcaaatcataattatattgatacatattgattgaatatggtgcttctgcatggggaagcgatgcagatgagaaaaaaacatgtcctaagcgcaccagctgcgttctcatgcatgcacgacgtattaccgagtcagaatcggatggctacattatcatgcacgaacgacacgtcgctttattgagtcagacgactcggactcggacgacgctttgccttgatatgccagtaaagcgcttgcggcagccccctctgctcgagccatattctaccctaatacgggcatggaatttttccactgcgttcccaaaagatgtataaattttccccaattagacccttgataagcatgtgagaattcgcaataacacatgagaagctgagatgacatagaagcgatgtaacatggacctgtgaacaagattgaggatggagattgatgagttaaaaaccggccaaatagagaaaagtttcttaagaaaacaataaccacattgctctggtggctagatgagcgcagcatgtagtatgtaccctaggagaccggagtttgaatcccacacacacatgcatgtatccctgatttttgcatagtatatagtccacgtcaccggtagatggttttcccagtctttttcttgccggtagacagtttttttccggtccaacagtcgtatcgctactatatggtttttttagtccgatccgggttttatatgtgtttaactcggatgacggacgaaagctaaggtgagtatggaatcatcctcaatttttataataggtaaagattattattattattattattattattattattattattattatttggactgggcttcttttattattggagtcaacaagtaaccgtccatgcagatatgaggaggtcactgttggtgtcgtacatgtcgtccattccaattcttttatacactttaaatccgttactccctccgtcccgttttgtttgacgttgtagttcattttaaaaggagtctaaa

SEQ ID NO: 44667 - DNA, 1501 bp, Oryza sativa
tgatgtatcataaaactacagatttagcactaaatttatcacaaaactacagatttaagatggagtatcgcaaaactacaaatttaataacaaaattacagattttagagtttaaatccttagcattagtgttatgtttgagttataaacgtgcaagttttgtgattaaattatcactaaacctatagttttgtgataattttattactaagtatatagttttacgatattctaccttaaatttgtagttttgtgagaaatttagtgttaaatctgtagttttgtgatatatcaccctaaatctgtagtttgtgataatttggtcaaagtatctgtagttttgtgaagtttactctaaaatatgaagtaaatctaatttttagagtttgaaataattaaagtttaataaaccatggagaaacaccaggggtgttccggctaactccacaaagtggtaggctaggcgacctgggttcgaagcctcaccccttctaattattgatattaggttttttcctaacattcacgtcttatttgtaggatcgaatcacaataactaagccaaccagagaggggtgaatggttggtatacccaaaaaccaaaaacttttagcggaaataaaacttaccctcaaattcgacggagatcggtctgaccgagattgatctgccggtctgaccgtgtggatgccgtcggtctgaccgatatagatcaatcggtccgatcgccgaagtctcctgccgcgcctgttgccgtcgccggtctgaccgcctcgctcccgccggtctgaccgtcgccttgtaaggtgtttagaacttttagtatgagtttggttcgtgactttaggctgcctacctcgggtataaatagagggggagcatgaggcttcccggtatcgctttggagagcaattgagttgagttttaagttagggtttcgagtttagtcgaaatttttgtaaggagtgttgttggtgcactttgtaaacacagagagaatcaataaagtcgtcatctactactctaagagttcttcgatttatgttttaccgggctttagcggtctaaccaacgactcaccgatggtaagaccggcggcaagctaggaaaccctctagtacaagaaacaaactttacataaccaatcatactaaatttggactccttgcaaattcgacttcgcatcccatacgcacacaatacctccatcgtatgccatatggaatctccatcaaccacgtgcatcaactctagcctaagtatcccgcatgatctctgaccaccacggacgtcgtcttatccccgagccgactcccggtccatcaccgcaaatactctcccgaggcatcgagtcacctacacatgaaataaacaaagaaaccatattccgagaccaagctatctccaacttgactcattagtagcaaacaacagtattacatacgtatagtatccatctaaaagccataatcatgaaataatcacggatatccaaacaaac

SEQ ID NO: 44668 - DNA, 1501 bp, Oryza sativa
atgtgtctctaaatcaaaaagaaaaataatttataccaatatattaagaagctcctccaataaataagaaatgactaaatcgatttctgataatcccaatattctttcctcttcatgggcatcctgcgaagaaaaatgtttagttttagacataattagttttatgggactagatgtcaaagttttgtagttagaattggaagaagcattgttaaggtaaactgaaccgacttatgctaaataacatttagctagctaattaactaagcaaaaatacttaaataatttaacaagcaaatttgagatgtacacttactcgtgaacccgtggactcatgctgctttatatgccttgaaaaaaaattagcaatcacggtttggttcaaaaggaagtccctcaccagtgttgatagctccaccctcattactcattataagaatccacatcattgttcacccaaacaacttatttaagaccgggaggtcggacataacattcacccaaacaacttatttaagaacaagaggtcggacaaagcatgcatcgcatgttcatcacaatttgcatgcttaacctctgcagtaatggaataagtgttgcactgttggtcttcttatgctgcagatggaataagtgttgcactgttggtcttcttgtgctgattggtctttgtatttttttccttttcagcttctaggacaggactattttgggatgattatgggacatcatctcctttcagtttgggatacttacatgacaacatctcctttcagtttgggataggacatcatctccttttattgtaggatgcgctaggacatccttgggaagaagggatgggttgcaaggggtagtgctggagatgctgtgaagttagaggatggggaaacagatgttaaggtctatggttgggttgcccgagaaggggactataatgccgggaatgtggtgggcaggtacttgaggaagcataccaacctgacaaccatatatgaggtctccaagagtcaatcagagaagtcggggaagatggtagcgaaacatctcctttttcactttttggactagcaacacacctataaatatgtatcctatcccgggtttgggatatttgtaggacatcatctccttttagttctaagatgtgctaggacagcatctccatttttactttttggactagcaacacagctataaatatgtatcctatccctcgggatggtatgatattcgtgagaaaataaatagaaaatgccgcaacactcccaatgtcatcctctcgataagagtaaggattctgctactaacaagtggtatttgagccgttctatactgtagcctgatatctcctgctcatatccttcccaagctcccctctattctcagccggcagtaggaacaccagctgttcctgctcatccctctttccctgcgttgacgagttgtgctcgtcagaggcagtctcttccccacgcagtagccccccagtggcgtgcca

SEQ ID NO: 44669 - DNA, 1501 bp, Oryza sativa
caagcagcaggtggtggccttgtccagctgcgaagccgagtacatagaggcctccaccgcttcaacctaggtgctctagcttgcttgactgcttggtgatctccttggcagagagactagagcggtggagctcagggtggacagcaagtctgctctggccctggcaaggaaccccgtttttcacgaacggagcaagcacatctgggtgaggtaccacttcatccgaggctgcttggaggaagggagcatcaaggcgagctacatcaacaccaaagaccagcttgcggacctgcgcaccaagccccttgggaggatcaagttcctcgagctttgctccaggattaggatggcccaactttcctacaagacgatgcataagacttagggggagaatggtagaataagtcttgtgcggttggtcttcttgtgctgattggtctttgtgttcttttggtttttagcttttaggataggactagcatatttcagtttgggatgcttgtaggacaatatctcctttcagtttaggatgtttttaggatagcatctcctttcagttttaggatgcctaggacaacatctcctttttcaccttttaactagcaagaaatatgtatcatatccccttgggatagtatagcattcgtgaaaaaataaacagaaaattgctccagctcttccagtgccatcctctcgatgagagttctcttccagcgccatcctctcgatgagagtaaggattctgctactaacatgcatgaacattggtctgccccatgtcaccagtactggtttccttactttttcccttggtcaattttatccttgatgtttttcctaccattttttgtatcgttttgccttctcttttttctccgttgtgcttgctgttgcaagtacatgattgtcctgtctagattgcaagatacaacgtaaaatgaaagccgcatatttccccaaggttttcaggatttgatggagattatctaaaactgcagagcggatcaacggatgttttaaagcaaagtaagcaatcaacaacttctgaaacttctttactgttaaatattatatcccaacaatcagcgtcccatgagagaatcgccctgatgcttaaagaaggctgggaacatcccatcacacttaaacattggtagaatattcttcgagaccactacaagatccttcaacaaaatcttgacgctgcattttggataaaatggccttattatttcaacaatataatttttagaacataccgtaacatgtacgctagtatatgatgaaatgggataaatcttctttgcagtactgccctccgacttggtcaaacagtagtgtagtgtgtagaggatttgtttatgatggaaccatcttatactaaaaaaattaggatgagccttaaccaatctcacctcatctccaaatcacagccaattgatattgcctaaacgaagaaaacgattaaacccgataaccttacgagcgaaacattttgact

SEQ ID NO: 44670 - DNA, 1501 bp, Oryza sativa
cttcattgagtactattcctttgaaggaattgtactactacctccatttcaggtttcaggttataagattttttaacattgtccacatttatatagatgttaataaatctagacgcacatatatatttatattcattaacataatatgaaacagaggaagtacctgttttgagaacgattattatgatgcaattgataagagtagcaatgtaatttatgagttatatgacactttcttgtgagatttgatagagccatatatccgtatgtgttatggtgtctggatgtgaatttctctctgttattctatatgtcatattggttatttcgaacctcatatattaaaaatggcggtagtagtttgatgaattttaaattttcacatgcgcctccgtctcctctcaggttctgagattcagaagcttcagcgtgcatgtatggtgattaatttttcttagaaatattgtagtacaaacacactcactcataatataaatatatgtatgctcatcttttttaatacacacgtatattctacctttattatttccagtaaatcgaaccattattttaattagtctcgtgcatgatgcagagaccctggaaagggcgatcgagaattctctatcaagtgtcaactcactggcactgcacgtacatccatcgtagacaacagtttcacaaggctctcgcaaatgcacgagcatatatatacgtatgatttgtccctcgtccatcgatttaattagctagcttttggtttgtgttgtcgcacacaagagaatgatcaatcatgttgtccacagctgccaatcgatcgatcgagctttatttcgcctttaagcaacatagtagcatcgattgatggcaatatagaccactcccttcctcctcctgctagctatagccccgttcgacaataacataacggatgaagattaagtgttgacatacacaaaacgagaaaaaacacatggttaataatgtaaaatcaaatgtgtttttgattattattctgtgatgaacaattggcatcggagattattggttttgatatttggaatttattcacgaagtggttttggagatgattggatttcacaggtgaatctacaggtactgctggaattgggtctggtcagaccgagcaggtgttgccggtcagaccggcgtgtatcgcgcggtcagaccggcgcagcccgcggtctgaccggccgacgctgtgtcggtttcggtttcgggttgtttgtttggatatccgtgattatttcatgattatggcttttagatggatactatacgtatgtaatactgttgtttgctactaatgagtcaagttggagatagcttggtctcggaatatggtttctttgtttatttcatgtgtaggtgactcgatgcctcgggagagtatttgcggtgatggaccgggagtcggctcggggataagacgacgtccgtggtggtcagagatcatgcgggatacttaggctagagttga

SEQ ID NO: 44671 - DNA, 450 bp, Oryza sativa
acgctccccctctatttatacccgaggtaggcagcctaaagccacgaaccaaactcatattagaagtcctaaacaccttaggaaaccctctagtacaagaaacaaactttacaaaactaataataccaaatttgtactccttccaaattcgactccgcatcccatacgcacacaatacctccatcgtatgccatatatggaatcttcaccaaccacatgcatcaactctagcctaagtatcccgcatgatctctgaccaccacggacgtcgtcttatccccaagccgactcccggtccatcaccgtaaatactctcccgaggcatcgagtcacctacacatgaaataaacaaggaaaccatattccgagaccaagctatctccaacttgactcattagtagcaaacaacaatattacatacgtatagtatccatctagaagccataatca

SEQ ID NO: 44672 - DNA, 1501 bp, Oryza sativa
ctgcaacggtttggctaggtagaaaaaatagacctgaacatttttttttaataatgaaaatggattacatctctggctttctgtcataagacacacagccataagtacagccataagtttaatagtaataaaaaggtaaggtaaaagtaaatcaaaatgagaaataaggtgatgggacaaatctccaactcccctttattattgactagcgttaaaccacataaaatttttttagctagcaattctaatagaactacgccacccatagtggaacaagagacccttagctaccgattccaagagtatagcaccattgcgcatagtatcctgctcttcctgtggtagcatcgtaaaccaaaagtggagctagtaggaagatatgaagataacctgtataaggttagataattgtttaccattaaaaactttatcattacgacaacaccaaattaaccaacatatagcactagctccaattagaatcatctttttaatggacctagatatccctctaagccaattaccgaaaatgtttttggcgttacggggtgggggatattaaaagcaaaaaacacacatctccaaacaaactgagtgacatgacactcaaagaaaagatgttggattgtctcttgtgcatagcagaaagaacaatgtttgtccccctccccctctccccaaattttcttttagccaggttattatctttcgttagaattactttcttatgaagaaaccacataaagaccttgatctttagtggaattttcaagtcccacagaattctctttttgatccgaacattacagttcatgatcgtggcatacatagatttgatggaaaattgaccattcttatggagcgaccatacaaagctattcttttcatttgacagagttatattagcccgaggatcaaatcgttccactcgattagcttttggccaacaatagctctcctaaaagatatatttagcggcgttgtgtgtaaaatcaaaggtgctttttattattattctgtgatgaacaattggcatcggagattattggttttgatatttggaatttattcacgaagtggttttggagatgattggatttacaggtaaattacaggtgctgttattttatgtgaccggtcagaccgggcagtcgttgccggtcagaccggcgtgtatcgcgcggttagaccggtgcagcccacggtctgactggccgactctgtgtcggttttggtttcgggttgtttgtttggatatccgtgattgtttcatgattatggcttctagatggatactatacgtatgtaatattgttgtttgctactaatgagtcaagttggagatagcttggtctcggaatatggtttccttgtttatttcatgtgtaggtgactcgatgcctcgggagagtatttacggtgatggaccgggagtcggcttggggataagacgacgtccgtggtggtcagagatcatgcgggatacttaggctagagttga

SEQ ID NO: 44673 - DNA, 201 bp, Oryza sativa
caatttaggcagctgtgtaagttgataaatatatttcatgacattccatccttgtagtactaaacattataattaatggataagattagaaagtaatgcggtggttcgatttaataacctaaacacttgtgtatattgtctcacaaatttccattctatttctaacaagccttatgacatatattttctcttgttcataga

SEQ ID NO: 44674 - DNA, 621 bp, Oryza sativa
ccttacaaacgacagaagttaactggagggctcatgcttctctttcggttgcaagaaggtatactagcgattaatgatagcccaaatattcttactcctgattaggaggatttgcattgacaatgtgatgacagcttgacaaggaagaaggatgcgtcgcatgatttttttacccatgtaagcagtggaataatcttggttacttacgaaccatcggcttggacagcatatgcttctcagtcattaacagggattgagatatgcttggagagaagatttgggattgattgatcagatatcattcgaagtagatgcttaataaatcatcttgaccgatgaccaaggggagatgagatgtgatgtctggtttctctgagaaaccctcctaccattcttttgcaaagggctttcgaatggattatgttttttttttcccattgtgagagctcgaagctatgtgaaacttttgtcaaccagaagggtgcgcattattgtttcctgatctcactaaacaacttaacagcactgccaaagtgtgtgacatatatactaatatactcactaccacactttggagcaagcctgtaggtcagtatattttctgtcggtcccgcacacagc

SEQ ID NO: 44675 - DNA, 352 bp, Oryza sativa
ctgcagccctgagttatttgatgaattacatgtgaatttcttgaatttgaggtgttatgtcaatttgttgtgttgaattgaacttttgaaggggttttttgccagggcgtgcctgggccggcacgggcacgatgggctggccgggccgtcgggccagcccggcacggcccgaggctactggggccgtggttgtagcccgtgggctggcacggcttgtttgtcgggccggcatgtttgtcgtgccgtgccggcccgactgacctcggcccaggcccggtcgtgcctgggccgtgccgtgccgggcgacccatatggccaactatacacgggacgacgtcatcttgacgaggca

SEQ ID NO: 44676 - DNA, 1454 bp, Oryza sativa
caggttgtgagctattgttggtgcatcgtggtgctgcctgttagtactactcctacgtaatgtagcagtaggcatgcccattaccttggcaaaatggcagccctagctatatctttgttgtacacttgtgatagagagagatactagtgcagtgtgcacacacatctatcccagcaaagccctcaactagtgtagtaccgtcacaagcttcacaaacttactctaattcacaatgtgtttttgatgacctgcgacggtttctggcagtgtacgtcgcttcgatgatcgatcatatcagtgcatctcccgatccgatgaaggctcagacaccaaggaaaccggcttgattcatgtgtcattggcgccgcagccgcgggggcgtgctcaccagcaaaagtgaagtctcgtcgtggggcaaaagcaggcaaggggcaggcaggcagtatagcttagctcctgtataaatcgatcggcagctgagggcggcgaaagcgtcgtctcccaatggtgggggtgggtctccccgtgcggccggccgacagcgcgcactgcttggataaggtgccggacacaacggccggacgaaaggcgcgccgcggggctcgattccagcccaccacctgatgatggatggatgcaacctgcagatggcgtacgtcacgtcgctgagcgcagcagcaggagataccggagggtttggactttggactgcaccgggtgttccacgcggcccacgctgggaggcagggccccccccccgccggttggtgtcgcccccgtgccctggtctcgacacgagtcgatcgatcgatcgatcgaagaaaggctatagctcaacctctagcgcaagatgccggcagcgcggatggggattgagacgggcgctcgacaacttggccccctcggatatgctttgctaggtaggagtaggacgcaggacgaccacgatatatctcggcgacgtcgctggctgccggtggtgcgcgcgcgggcgcggaggcgaaggcgaaggctttttccgcgggcgcgctgggctggctggccgctttctgtcgcttcgtggccttatcttgcactccgtctttgcaggaatgggccgcgcgcgcgcgctcatgatgagatcgatcgtttggctttggttggatcagcgcgggcggtgcgtcgctaggcggtttaggctttagccctgccgcgcgcacgttcatgagcgctcgtagcggtacgtggtttttgtcgatggatcggtcggtttcatcgtaaatctggtggacgtggccgtaggggttggtttctttctcgtaagctgggtgggggccgcggcgcccggtccagtcgaaagtcgaaaccgtcaaatcggccgagagcagtcgcaatcggcacacgtcgatcgctttcgcgtgcgagcgttgtttcatgcctcgtcaagatgacgtcgtcccgtgtatagttggcca

SEQ ID NO: 44677 - DNA, 182 bp, Oryza sativa
attattaagtccctcattgtaagttcactgtcgtatgtattcttacgtaaagaccctctataggaccgcgctctgaaacagtgcaagtaaggatgttttctgagaaatagaacaccctatccccccattcccccgaaaccctaccactaccctaccagtactgttcccccatccctcctctt

SEQ ID NO: 44678 - DNA, 997 bp, Oryza sativa
catgagaactaatttagtagtatggatctatgttgtcttatttagtactgtgttactatattttgagaaacggaagaagtagcaaaacttatgtttgtgtgtttaatccaacatcgtacaacgctcatagggtgtggcggatgcaggattcaggatgggtattcagatttatcaaatgatgtttcggtggaaatctgtctatctattgctcctgtaggatgtaaaatgttatatatatcttctactattattatcttcggaaagtatggctttgactggcattttcaagcctaactacttgctccctagtaaatcggttagctgttgctactaatgaactacctggagagagtttttcggccgtggactacttggtttcaggagtttgttacgtcgtcgctgcaacagcagctgcgtctttcaaaagggagatcacaacacatggatgagagttgaggaaactccaatatttcaacgagaagaaggaagccttggaatgattctgaaggtggattagtgttatgagaagagatttacctttgaaaaaaaaaatcaggtgttgggaagatcgttgtgtttaagacgggtatgattcagagccatcttcgtcttgagaccgttcgtgctcttatgatttacagatccactcaaatcgcttcctctcatctgcatcagtattctttttatcagatttgcagagaatttcatcagcattcaccactcgaaatttgttggtaggattagtgaatagagacggtgttcttttcttgccggagatgaggcgtcctaagaacaaatatggctttgtcaccgccgtgctctcgtcggcgacgcctctcctcctgggctacggtaagaaccagcgatcccatccatgcgcgcgcgcagatgcatcgatctgtccatcaagcacggcgtgatcttgcgagcgcattggtgatcgatgcagacctcgtcatggtgtgcggctcggccacgctgccggagccgcccggcg

SEQ ID NO: 44679 - DNA, 1501 bp, Oryza sativa
caaagttttttattttattttagataatgtggtgtctactatatgatgtgttagaattaatatgattttgagacatttttttaagttgaaccttttctagagagagttgggagtttgtcacattgtcttaagtttatattatagataccaaaacttagtggttgtgcagaggtcgaagatataaaccattttcattattaaaaagtatctaacttcttaaacttgaaaatagagcaactgatcaagatattcttgttgtggcagaataatcggagaaaacaaaagagtaaaatttactaaaatatagatattttgataaaattatcacaaaactacagatttaagccacagtaccataaaactaaagatttacaaatgattttatcacaaaactatatgtttaagctattatatctcaaaagtataaatttagtattgtctttttttttcacaaaactacatattttagatgtgttatccatacacctattaccatggtaaattttaaaatgtgtagttttatcctcgcaaaaaaaaatgtagttttatgagaaaatggatgcatctgtagttttgtgaaaaaaaaatccactaagtttgtagttttgagatacaatggctaaaatatatagttttatgataaattcgttcctaaatctataagtttgtgatactatggcttgaatttgtagttttgtggaaatttattaaagtatatgtagttttgtgaaattttactaaaaagaaattctgagcaatgcgttaagttctatatgggaaactattctaatccctcgaggggatgttccctcgtttgcttaaaaaccatttaaactgttatgaaaaattctggaaaaatttgacaacattcatacaacacatatatacaactccacaaaatcttaagtccaaactcaaatcacacgtcgagatataaaaaagacaaattcagcgtatgaatagtagcgtactatttatatctaaatttatcttttttgtttctcgatgtgtagatcaaaattgaacattaattttggtggactactaggtatcattatactctatattgtcgattttttttcaaaatttttcacaattatttgcatcgaatttgaagaaaaagatatacgaggggatatccccctcgagggattagaatccactcccattctatacttctatctacatgctacttcaagttgtattaatcaattaatgttccatggagatactgagctcagcgttccttggagataggataatctgagcacattcagttggttaatataggttttaaaatggctgcaaatattgtggactccaggagtcaaataagcctaggatttttgaagttgcttgcacgcagacgcttacaaaatttaaaaagtcagttttcgtgttcaatgtgttgtgtttaatttccacatgcatgcgtagatcagccaacgtttcaatcgcttgttcgatcagattaacggcgtttgctttttccttaaaagct

SEQ ID NO: 44680 - DNA, 1438 bp, Oryza sativa
gaaattcagctgcatctgaatttagtactactacactttcacaatttgtactgtgcttaactgacctaccgcatgttataagaagacaaatacatatactaatgtatatacattagtacagtacaataaaattgtcacacttcaagcgccagttcgttaaaaaaaaggtgaggtacagcactcgagagtcgagatgtgctatgagatactgtaacaagtatatacgggttaaggataagattcagctttttgctaatccatgcgtgggcatataaaagtctttgcagtatgcacttttggggggagactttttccactcttcttggacactaatcccagaaaaaagattgtgcagtacttgctctatgaaaaagcaagcagattgatcaaacaatgatagagctttatgatttgttaatggttgctgcattaccaaatgcagcttgtcaaaaagagccgttgtcccatttcagccatatcggcgccagaagttgataatcacatccacctactctcggaaaaaaaagggggggggggggggggtccagcgacgtgtgagtgacccgaaggaatcactagtactttattttgtcttggcctaggaagcttaatcatgtagtaccgataattttataaggcaggaggtggctaagcaagtactccctccgtttaatttgtttattataccagcactcagttaagatacttactcccttcgtcacagaatataaatatttttagaattagacataattattaagaaagttggtataattaaatggggaagtgttgtgattggagtagaagtaaaggtagataggaaaattaaatgatggagggttgtgattggttaagaagagaatattggtagataacttattatattttgagacaaattataaatactagaagttgttatattttgatacggattgatggagtatcttcttactaccttctaaaacatatgagatatatcttccccttctcaccattcatccagcggttatactagtactaatactcttataataaaatgtaatacttactctaaaagagctaattagaatagagttaatgacggtagtaatgtaatttgtcaacacattctaatttagggtacgatttgatgaaatgaaactaaaatgaaaggtgatgaagtaaggtgatcactgttatatgggacccataactattgagcccacatgtcggccaccacgtccaattcccggcggctatgcaacggccggggacaggtcatacctgggcccaccttaccagaggctgtcaagatgggcccacacgccattcggattgtagtcggagggctcggaggtgatccgaccctgctgcctcctcgcctcgcgccgtctataaatgctggccgatttccactgactcctctgccacacagaaggcgagctctcgaccgccacta

SEQ ID NO: 44681 - DNA, 1501 bp, Oryza sativa
agatgtctgagagatggccctgcctgagaggtggctccgccgatgacattaaggtgcatcatatcaatatggcatggagttattaatgattcaggaatgacgggctagtgagttttaaggcccgttagattaatctaagtttcatttgttgttgatgctaaaaacatatactggcctagaaaatctgtttagctccagtgcagttctaaagaattgctttcgggttctgagcgtaccaattagtttgatcctgcaaccaacaagaaactaggaaaagatgcaaagttaaatccataaacgacagccgatcagctggatcgctgatgacatatcattcaatatttagccgatgtaacgtgtatcagatcggcaatgcgagataaattatagaaatagttaggcccgcccgatcgtctgaagatatcaatgatatacaatctatgcttcggaatacatttataaccaagtgattgggatagatcgtacagcacaccgaggcggtataaatcacttatgtctaaaagtactttgaagtgtagattatatatattcatagcatagccgatagagcaaaccctaacatgtctcggctactactccgatactactttatactgagatatcgatataagggaaatatactgaacgaggatcaatataacaggacaacctaacagaccaatagcaggcttaatatatttcaaagaaacaagatcctaatataaatggcagatttagcatatcaagcaaacacaagaatgacaagataactaaaccaggtaagatcaattgaaactctggtactatctctactagcaaccataaaacaggctagatagtgcagttcaaaacattacttaacagattgaacctaaccgatgtagcattaagcatgaagagaaacacaaaatctaaacaagccgatggtggcctcatcaagatggtggatatgctgtgcagtctaattcggtcgccaatgtctaaccttgttagctgttttcgatgatagaggctagtcgataaagttaaacaatgggaccgatctagattacacagcgttgacggtcgttagtgatcagtttcgactgtcaatattaccaaaatagaggagaactaactttgcttgcaatgcatattcatgttagaataataatattccactaatattgggattactaaccttttgcagagaataaccataaagtggaggagaatcgacatcaaatcagacgataaatcaatcggataatgtcgagaatcagacttatgtataaatgggctcagaattgacacgatgaactgggccaaaattcacaagtttgcgcatgggagcaatagaggaggccacttgccgattttgggccaggctggcccagcccatggttcggccaaacccaccacggcgccattcgatccagggttctcctggacggctgggattgactccctatggcggttggagggtatttccgaccattccaaccgccacaaccgtcattct

SEQ ID NO: 44682 - DNA, 1501 bp, Oryza sativa
atcttcacttctctcttcctcaattggaagagggttaggggatcaagaagaggagacttttgcaaaggtaaatatgcatggatgcatatatatgcatgatcaaaattaagctagctgtacagtgtgctagcaacatatgtgtactactgtactgctgcaatcttttctttgctagctatgataagtgcatatattcctataagttacctgtcttgatgtagtgggcattgtaacaccgtgatatttgatgatcatgtgtgggggcatatgcaggtgaaatataggtaggtaagctcgctgataacatcattgagtcattgaccaccgtgagtccaatgtatactgcatgcaagtaccggctagctagcttaatagagatctaagtcaggagcaataagttgcagacatgtgcctttgggccctggaaggaggcgatcgatttactttgggcccaactattatattccaccacgttttgtttttgcgccatgaagtttgtgttttgtgtgtggtccacactcaactctcttgagaaaaccttagttggtgcttgatttcggaaatagtcttaaaaaagcttttggaaatatgtttgtacagcatggaccatatataggtacttatattggattgactatactcgaaaaatctcatatattatagcattaattatggacaactgcaacatgtacgtcaaaaacacagtggttgttttaagaggttatggttggataactgctatagatgctagcccctcaataaataaaagtagcttataataaattatatatttttttcacatatgaccttgcaacaatagatgagtctaactaccactactagtgagccgtcctaagggtttgtagtcattacgacatcaaacaaccactaactatacacatggttgcattaccttttgtgagtaaatacatttagttcagatatacttggatgtgctttgaatttaaaacttattttaagaaaaaaaaaaggttgttagaggtgtgtgctagtcacacaactaggttttatgccaaaacatgtcagaactaccaccatattcaagtactatcatgctcttacacgtctatattatacgaaagcgggaacatacaagtggtcatatattccgcacacatgccagaggcatatacgtcaacaaactcagcccctcaagtccctcacattattaaccctttacatcgatttcttcttaaagatagcaagggacaaatgctagctagaaaaccatagggccactgcacaaataattaatattccctttgaattgccttctacaattatcccccaaacccgaacccttggccgcgtgagcgagcgcaacggcgtcgcggctataaattgccgcgtccactctgcatctctcactcgcacgcacagtctctcccaccaacaaacacgtacgactttgaacgcaaagtcttggcgccactcgatcgatcactctctgctcatcaggtgtttgtggaaagtgcagaga

SEQ ID NO: 44683 - DNA, 1501 bp, Oryza sativa
ctgggatgccagccgccgccttgatgtcagcgagccgctccgacgcctcctccggcgtgtcagcgatcttctccagcacagccttggcgtcggcgaggcgacccttcatgacaagccaccgtggcgactccggcatgccgagcaccatgagcgcgagcagcacggatggcgccgcgccgacgccgagcatgacgcgccacccgagggagagcggcaggcgcgcgaaagcatagttggagacgtagccgaggaggataccgaggttgatggagacctccgggaacgacgtgaggaagccacgcgacgacgccggcgagatctcggccgtgtacacgggcgcgatcatgatcgcgtaccccacgccgacgcccgccacgaagcggccgaccatgagagtggcgtagtcaccggagaaccccatgagtagagctctggcgaagaagaaggcggcagcgaagacgacggtgaaccgccggccgatccagtccgccgtcctccccgcggcgaaggagccgacgagcgagtagatgttcaggatgcccatcaggatctccacctgcacgtcagtgatcttcaggtctttcttgatgtacagcgatgcgccgctcatcaccccgatgtctgcaaaattttggcgcgaacttgaacagtcagtgctcgctgacagtacactacacttctgaaaacaaattcagaccacatctgaagatttttctttttttttttttttgagatgatgtgaatacgattgtactacgagtaccatagccgagaatgatggaggccatggaggcgaggatggcgcaggtgaatgcatagctggcgttcttcttcttggggtcgacagccatggccgtgagcttggtggattcgcggcattgtagtttgcagcttttaaggaaaaagcaaacgccgttaatctgatcgaacaagcgattgaaacgttggctgatctacgcatgcatgtggaaattaaacacaacacattgaacacgaaaactgactttttaaattttgtaagcgtctgcgtgcaagcaacttcaaaaatcctaggcttatttgactcctggagtccacaatatttgcagccattttaaaacctatattaaccaactgaatgtgctcagattatcctatctccaaggaacgctgagctcagtatctccatggaacattaattgattaatacaacttgaagtagcatgtagatagaagtatagaatgggagtggattctaatccctcgagggggatatcccctcgtatatctttttcttcaaattcgatgcaaataattgtgaaaaattttgaaaaaaaatcgacaatatagagtataatgatacctagtagtccaccaaaattaatgttcaattttgatctacacatcgagaaacaaaaaagataaatttagatataaatagtacgctactattcatacgctgaatttgtcttttttatatctcgacgtgtgatttgagtttggacttaagattttgtggagt

SEQ ID NO: 44684 - DNA, 1501 bp, Oryza sativa
cccggcagctcaccgacctcccgccggcgaccacggttctggacccgaccagcctaatgatttcccccgtacactacctcctccacgttctcacggtgcacggcgccggcctcgccgacggctccgcgacggtggtggtctacttcgagaacgcacgtaagctcgccgccgccaagcccggcgacgagcggtggacggtggtcgaacccgacgccagcttcgcctccgtctcgtcgttcgcgggccgcttctactgcgccacccgccacgccatccgcccggtgatcgtggaggtgaggacgacagaccaccggctgccgccgcagctggtggtggtcgccaagctggccggggtgccttccttcccgcggaactgttagaataattgggctaggcccaatttataatattaaatctcaaaggcccataataaatgttgaggataataataccacttcaggatttaagcgagaaatatctcaacctaaatagggagttattagaggctccctgttgaccagttgaggtgagggtcggaatgccacacgcgcgcgcgcgcggggcgtgggcgaggttgcggcgtcacgtcgctatccttttgtagccactaacccgagggcgaggcgtggcgcggcgcggcgtgcgtcacgtcgctatccttttgcagccactaacccacgttcccacgattccctccgcaacagcgcatccacgttctttctcctgataaataaggaggccacgagtccgatccgacttcttcgcttctttcccggtgttagtttcttcttctccgcgcctgagttgctctcgcttccccgcttctgatctcttgcgcgcacgagagattggaaggagcaatgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccgccgccgacaggagctggatctggatccggagctggtgcgccaggaggaggtgccgtgaacgactacaacaacggaggcaattctgcctcaccatccagcggagagccattctcggggtataatcttctcctcctgctactgctgttagcgctattcatgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttggattaaaatatgtcgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 44685 - DNA, 239 bp, Oryza sativa
gtaaaagtcgaatttgaacttgcatgtttgtgaagtgatatattacatattaacctatcttgtgattttttttggaattttttcataattatttaagtggcatgcaagaaacgggtgtacgttcacccgagagattagaatccatcctctagagtccacagcatcttcctcctcctctgtctctcttttctgccttccagatccagtgcaaggttgaaagtgactgattaaatcttagc

SEQ ID NO: 44686 - DNA, 1501 bp, Oryza sativa
tcggcggccgcgacctccgtcgccatccgcgtcgtcgccagccgcgaccgccgccgccgtccgcgtcgtcgcctacctttccccgcagcggctccctctcttcctgatctgcccgcccagtgccgccgtcatcgctctcctagtgcggcgagggagggagggagggagcggcagcggggcggctcgacgccttcaccacctcctccgcagtgttgccgcagccgacccgctggcacgagcagaggattggagagagaggaagaagaaagaggaggagaatgacaggtggggtccattggttaatagagagtggaacgggagagtctgttggaatagaagacaaatttgactctctaaacttttattaggctggccaaataggcatttggagagccaaaaatggtcactctgttggagatgctctaagctactgcatctattgatttcctgttgattgacatatttttgttaataaaaagaaagatgttcctaagactgctttctagattccagatacatttccataagataaacccagcgctcatgcccacctcacttgcatcccttcctgacgctcgcgacctcatctctatctccaacgaaaatcgaaggcggattcactctaccgctggatttgttcagcggcctcaaggctagggccgatgagctcattgacgcctagatccattacgagggagggggcggttgtcggagtgtgaaccttgataatggggatctggtaggacccccttctgtgagttcggttgaggagctagtcacgtgtaaggaggtgacttgagcccctcaagagcgcaagaaacaaacaaacgaacacgatcgaagtatacagatttgggctatccgaaggtgtaataccctacttctcttatggtggtgatttcttgcgcttgaaggattttacaggtttatcgactactcggagtagttctgcttcctttctttttggggtttattaagagagcttgacataatgtgttgaagtctctccttagtcaccaccatccaatccgctctcctttggtctcggttttccccttataccttctttgggggaaaccacatgactaaagttcgaggaaatatcttttttcatatcaagatcaagtatgataagtcttctcagtaactcctcttcttacctactccgttgacctggggggtacacctggcagggcctactattcgcgagatatatgtgcgagagctcggcatgctaccgtgtcgaatccaccgaagcctcaaggcaactttgagtagggtctactctgagtggggcatcacggaacttgccacacaccctacttaatccacgcaacgacacgatgaataggattcaccatgcctagctggacatggggtccgcctgccattgcccaataaaaggcatgggtctcgatggggtatggtagaacctgaccacatctccttagccgtgttgaacctggacacagggcccgcatgccattgccaacactagtgt

SEQ ID NO: 44687 - DNA, 1501 bp, Oryza sativa; identical to SEQ ID NO: 20517

SEQ ID NO: 44688 - DNA, 1501 bp, Oryza sativa
agacaactgaactgaaacggatggtagataggaaaaatatatggtagaaactagtgaaaccctaaaaactatcgttggattgagaattgataaatagatatttaagattcgtccacatttttcttaaacttaaacaaccattaatataaaacgatagagttcacgggaataaatctacattgccaaacagataaactgaaagcataaaaccatccgtttctaaagaatggggactgcactaaggccacaaacttcctaatgaaaccacacaacggagaaggtgcaaatcgacagggaggtgcggcaatgccgcgacgattgcgaccttgggcctcctttggcgtgcacaacgcttgacaaaccagcaatccccttcggttgcctccacgatgacggcacaaaatagaggtatgctactgagtcacaaattttggtgtaagcatccccatgctcagcaagagttgtccacggagttcgtcgttaaatctaaggagagtaagctcaacccgaacaacaaactctgcatggaacaagctgttaggaaacacatgggaagatggagcccaaatccaggttcccataaccactgaagaactcgaatggtggcaaacgaactgttgtcttcttggatcgacgtacgtggttggggaagcgtgtgaatcttgactaatggaaccttggcattggaagctcccgttcaggcactagagaaaccaccgccacatccattggatgtaccaagccatcatcgggttgtcatcgcgcatcacgagctgcgagctccgggcgaaaacaaatccacgacgtctaagaaatcgtcgctgcaaccagtgaacgcactaggacctatcggcttgacatccgcgagtagcaagctccgggaaatagtagggcgacatggacatgtgctgccagcgctagccaacgaaggcctcgagaagccgccgcagcagccaataggagctgggtggcgacctcccgggcgaagacggtgctgcaaccaacactaccacaaggagccatctccacccgtcgattcgtccactgatcttcggatctcgcaccgccaccaccaccaaccatcaccgccgccgtccacactggcatccgtggagactcaccggcaaaagcaccaactagccctaactacaggaagcacctaacgacctaataacagacctaaccacactacactagtagggggaggtggccggacccctcctccaaccctcgccggcggtgaaccgttggaatctgggggaaggaggggatgggagacgagggagagagagaagctactgtagagaggggagggagaagaatattgtagccaagattcatccacgttacaatgagtaaaaattttactacatttattacttatgagtaatggtgatgtgaacaaggagtaaaatttttactcatggtgatgtggacgaatctcataggctcgtttttagatctaaacaatagtttttaagtttttgctgtataagtggtt

SEQ ID NO: 44689 - DNA, 1501 bp, Oryza sativa
tgtaaaaagctgaatacttgagataaagcaccatagtggcaatctggtttaattcaaaaaacaaatctatatcagtcattgaccagtttcatgttggattcggtgaactgacttactccctccgtctcaaaaaaagacaaacccagacaaacccagggtttgtctttttttgggacggagggagtatgtgcttaattttgaacatcagcaggtttggaacacatctttccacaccgctggtcccctgtccaagccgctgccttgtcgccgatcccccttctcctgaaccacatcgtatcgttcttaattttcctgaaatgtcgcatgcattctatggttttttcggactgctttctgtggtgcctagctgttggtagcgtgcaatattgatgatttacgcgtcctgtgtattcgtagggtataatgaaatttgatctgaacatatgaaatttgacaaatgcatttccatgatccgaaaagtttatctgcagatttaacaaagtattcatgttcattttacctttttcaactcattaacatgaacaaaattggagccatgtaaaagcctatatatttgctttgctacatattcttgccttaatagaaaccgggattttgccaaatattttgggagttaaattactaatgccaagtgatgaatatgtctttatgagcgtgtgtctcgtggtaggcgaacacattgtcttcaatatggtgcttctactaatatgcgttcgatagagaagttcatatggcttcttgaggtgctctataaggaggaaggtgaccagtgaggagcagaagttgcagaatgtttctaggcgatacatgtattgaaaaaataacacctgtagaacttgcaggtgatatttgtatctatatgtggtatagaaagttagacaccatgagttattgtttgtgttttgaaatgttaaaatattgtagaactctattcatggccaactttgggaatttattaacagtataataatattcatgagaacaatacacatctctctatcgttattttattcgtgaatcttaaatattaccttttggtttttgcattatcgattatcaccgttgtgttagcacgggcatagcgacataggtagaaacgtcctggttcaattttctattgtgtataggttattttattttattcttttcatttgcacgactcttaaagttatctaatgctcacaaatttaatagttttcggggagaaaaactgtgctgtgttttctagcaatttcgttaatagaaaatggcctcttaaagaggagaagaaagataaacctgagacaactgaactgaaacggatggtagataggaaaaatatatggtagaaactagtgaaaccctaaaaactatcgttggattgagaattgataaatagatatttaagattcgtccacatttttcttaaacttaaacaaccattaatataaaacgatagagttcacgggaataaatctacattgccaaacagataaactga

SEQ ID NO: 44690 - DNA, 177 bp, Oryza sativa
ggacgctgccatcgaaacggatcgacgcaacacagcctccctcgacagggagccatgggaggaggagagggaggccccggaggagaagccgagcgccgtcgcgagttcaacttctgccttgccgcactccgccgcaaccacgacctccagtcgggaatgaaggagaggacgatgggg

SEQ ID NO: 44691 - DNA, 1501 bp, Oryza sativa
cctcacaaaacctaatggctattatattattctggcctagaaatttatcattgaaattgtcttaaataagtgtaatttgaaagtaatatcttcctctccaaccaccctcgtttaaatttcttcatgctttacccccaaccacctctcatttaatgaggggtatttagattatttccctttttctcctaatattaaaactttagtcattttgaaatggagtaagtaaaatactcacaaccacatttcatgccaaaagtagattatgcctgactacttaccactacaacgatggattctaccactcaattacatgacgcgggagccggcgagagaataaaagtatccaacaaagctaatgccatttgtgaaaacaataaaaaaaaggtacatttattgtctcccctttcttggcagtatatccatcagtctacatatatttttaactaacccatgcaaaccctaaaaaacatgttatcggactaagaacctattgctgctcagagagggagtcagaaattaccaaaacctagaactcacatagggctcaactactagattttaagttcttttttttcaaaaaaaaactttcaatagtgatttaaaaggacctaattgtgattatgtaggcaaaagccctggttgctttaagcttgcttacgtctctccctatggtcaacatagtcacattcaatctccctcaccaaaaatcaccacgaaaatgaatgtaaataataatagcaatttaatcgttagggtttcacaatgtttcatataataaattacatcgggatattttatcacaattgattattttgactattcttcattacagaaattgtttacgccttgcctacatagcagccaaagcaagaagttagcaatggcaataaagctaccatggcgtgccattatggcattatctatcagccacaaagtcacgattcacaaaagctcagaagcaagcaccgaagcgcgtcaccggctcaccgctcggacgaaccactgtgcagccagccagatagcacacgggaagcacgagaggagctcgccgcttgcttgggtctctctccatgaacccaaataaaggcggaccggtttcgaccaccccacttcgcattcacaccatttcgtcatctccccaattcgcggcgacgccagtgagggccgtgttttttcgtgttagttgatctggtgattagaggatttatatatatcatttttcgtgttagttgatccggtgattagagggtttatttatatcgtgcattcgtgcttcttgggcgagcagtgtctgatttttatctctagatcccactttaatgcatacacatgtaactagtaaggctttgtttgcaaataggatagggaaataatattccaccctccaaagggtagtattgtatcctaactatccattcatcacacctcatttaatcctaatcattcatccatttccctttctcaatcccacctctcataacccatttgtcaaacacatcct

SEQ ID NO: 44692 - DNA, 1501 bp, Oryza sativa
ttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccattcttcagggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggtctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagtttaggtgggttggttgggcctgttcaacgtggtgtagcgttgatcagtggagatttaaggttactttaattactcaacagttttactgtgttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcatttttttttcgctgctgctgcttttgtttcggtgtgaggactaagtgcctcttctgtaagtattttacgcttattttacgtttggaactgtatattacttgtcgttttgtgtaccctggctggtcctggacagggatttaatacgcaaaatagtctggaaatttgggtgaaatttctgggcgtgacagcagccgtcagaca

SEQ ID NO: 44693 - DNA, 1501 bp, Oryza sativa
atgtgacgttaatttgtaatgtaaacatgactatgacttatttaccccttgatatatttttttggatgctctattttggtaattctattttagatattttttttcgatgtttcaatagtaccaatatcgttactattgaatctggatctaccgttcaatcacgtttccaaaaagaattagtttgagcttttatttgaaccgttttatccctataagtagcaatggtgctgtagattttccacaagagtgatggaagctagctgaaaaagaatactccgtatcgcttttatggcaaaagtcgtggagaggtaaggatgacgacgagaacgagctaggctgaaaagctacaagggccagaaataaataattaaataaaggcatacttgttgtagtgagatggggattataagattattcgggttatggtggatgagggagaagtatttgggaacatcccaacttgatgggcttgttcaatttgctatcatttttaactttatctttttttggtaaagtagaatggctatatttagtttgttgtcaaattttagtaaatacatatgaaatcttgccaaaatttagcaacattgacaaaattttgacaaccttagcttactaaaatttggcaatgtcaaaacttggtaaggttgaaaatggtagcaaagtaaacaagttcgatattacaaaagtcctaattgatttcttttacattgattattcaaacgaaatagcctcctagggcctcatcgtttggcatattcatatgcttatcagccaaatttgaattttcaacattaaatttggagctgaatttgaggttttttcatcgaagtttatttttcagcctttgcttttagatcgctaagagcacatatataaaagttttattcacaaattaatttttatttgtaaatatgccatattcagaaaatatgccaaacgatgaggctgctagtgatttaacgttacatatcaatctaagagtaggatggtacaaacagtaaacaaatggatagcttagagccaaaagacaggaacattagaatttagtactagaaatcaagcactaatccactctgacacgtcatcatgtatcttctaatctacgccacgtcattaaaaaaaaccttgacctcatatcagaaactttcttttcggccaccacgtgggcccacctctcgtcctcctcatttcgagcgaccttccggtggaccccgccggcggccatcggcgtcgcctacgtcgccgtcaagcctccccggcgaggtgggccccacctgtcatcctccccggagcgagacgaaaagctccgcgcaacgtataaattatttatcccgtacacgccaccttcatctatagccgccgcattttactactgcccaccaccaccacaccacccaccccctgcctagctattagctaagctgctctgctccaccactcgtcttccgcgcgcagcaactgttcgcggaaatgccgagcctggcgctgctcagggcgg

SEQ ID NO: 44694 - DNA, 1501 bp, Oryza sativa
tacaaaatcgtccttgaaccacaaaaccggatacaatgtattcccaacttacaaaaccagtgcaaactagatcccttggcggttttgacccgattttgatcgacttagcagctgactcagcgtgggacccacgtagaccccacatgtcagtatgtccacgtcatcacccatctcttttccttcttctcttcgttccttctctctcttctctccctgcgacaatgacgggcgcagccttgcggcggcggcatgaccctgtggtgggccggcgagggataggcggcggcggcggtgctgctctgcgatggccggcgggcttgcacgccatcgacgctgtctctccctggtccccttttttttcttttattctttgctcggtttctctcccccgatgccgccgctttccatggcagcttgcgtggaggttcgtgcaggcgcggcctggcttatggcgcggcggctggatgtggccggatgcgaccggaggccaggacgacaccgcccgcagccatcaagcccctacccgccgcacatctctcccaccggtcgagctcgccgccgccgtctgcgccctgcatgtcgagctgctcatcgtcactgtctcaatgccgcgcgaacgacgactaccaggggctccgcggccgcgcgcacgatgatgatgtgggtctcctgctctaggaccgccgcggccgtgtggcgggtggtcctgacgagtaagaacatccgcgccggcgagcggccgctgttcccattccagtcgcccaagtacctgaccagcctgaccaggcggtggtggcacggcgcagcggtcggcgttccacactatctgccgcgtgcttcactacttgaagcgcttcctggtaatgaacccggagcagccggactcggctagaccggcggtggactacctcgacatggatgcgcagctgctggggaggttcccagagtgggaggggaacggtgtcgccgacgtgccattcgagatgtacgcgtacagggtgatggagagggacaagagcaacgcgtgtagggacaggagctctgactccggcagcgacgacaactcattgtgtggagatgacagcgtcagcggcgggtccagcacgacgacgacggtgacgaacgcgtcggcgtcggcgtcgagccggccaatacttgaccggagaggtagcacgaggtcgtcagcgccgcggcgcaaggtggccatcgccgccaccaaggcaggcaagtgtcgcagcggtattgttactcgtctaaagccttccaagattacagctagcgctccatgtccatgacgtgtgcatggccaccgcagaagtcgagatcgataggcactgtgaggccgccgtcgccacgcactcgaccgcctttgctccgcttcgccggccgccccgcactcgacgtcttgctccgttccgctggccgcagccgccgccttgcttccctgcccagagagccctagagagaagagtaagagagagatgaggaagggagagagagg

SEQ ID NO: 44695 - DNA, 1501 bp, Oryza sativa
cacttaactccaactcttctcattattgaaatagattgttcgttccatgaatattttgaatattttcttccattgcattcattagactatttattttaaactatttgtaatatttattttttaaaaatatttaatttactctataatcaagtagataatttttttaagtactccctctattttatattataagtggcttgactttttttctagttaagtttgatctaatttatagaaaaatttagcaatatctaaaatattaaattattttcattaaatttaatgttgagtatattttgataatatgtttgttttatgttaaaaatagtaaaatactagtactatattactcactccttccaaaagtctaagttatatttctttttaccaaaactaaggtgtagttaattcattcatgtgataaaactagtgaacatgcaaccaataagtgctaaaatgatttcttaggttctgataaaaaaattaatatggcacatagtgactacaaatagaacttagacttttgaaaagaccaaacaatggaataggacataaacttttggaaggagggaatattatgtaagcttgatcaaacttaaaaacagattgactaggaaaaaagaaaaataacttataatataaaatagaaggagtagcaataatatacttaatatctaaatcaaatgagacgcggtcttacggatgcgtaaagatacacaacattttatttacaaaatcttatgaataactcaaatacaactgcatattatacgaccacaaaaattatgaggcataggcgcatagccgcctacagaacagatggagagccaactggtcgatctccagtgagtcagtgacctaatgacgactacatacggagtcgactacatacggagtacatgtcaaatcctctgcgcaaaatctccaaaagccaaataaatacggaggagtactccataagataaggcaaacacctactactagtactaagaaaatgacggcaatgacaaaacttttggattttagttggaggtgacatcctaatactaataatgtgatatattcaggttcgtagttttaaaatgtatcacatctcgtaaaaatcctttatatattttgggcacgaggagtgggcacttagagccatgtttagttcgcaaacgaaaatttttgacgtgtcacatcagatatacggacacacatttaaagtgttaaacataaactaataacaaaacaaacagattccgccagaaaactacgtgacgaatttattaatcctatttaatccatcgttagcaaatgtttactatgtcaccatattatcaaatcataacgcaattaggattaaaagattcgtcttgcaattacacgcaatctgtgtaattaattttttttctatatttaacactgtacatatgtacaaacatttaatatgacatagtgaaaaagttatatttgtgaaataaacagggccctactgtcatcacgtcgatgttgagtt

SEQ ID NO: 44696 - DNA, 247 bp, Oryza sativa
gatcagtaggtaagacaggaatattcactgcgaaaaggaaaagcaactggtactactaattgttactagcaaggtttcggttggaaaaaaaaatttggggttttcccaaagaaaaccttttttcccgagttaaccaattccttatacatggttagaccgccatagttgttgggatcattagttggttaggttactgtcttactgatcactaattagttgaaaatcaaacttctcggcgtcgtgttca

SEQ ID NO: 44697 - DNA, 1501 bp, Oryza sativa
actatcagaggaatacagggttactaaagcgcagtttgagagaggagagggatcctcatgtaggggttagctattatcggacaacttaccttattgaaatttgtaatgtcatgcttccttgtcctattactacatcatcgttgtgttcaactcttgcactacctccctcctagtttgaatctaatcttatatatgtaactgcaatggaaccagatgtatcatgttcaaattctactactatttctatacatgacataattctccttgtttaattgtatataatgtttctacgaccgaaactatgataggcctatatcaatttcatacactaatacgtcgaataagttacaccataaactcttacttaaaatatgaaattgcaaaacaaccgacctcaatacattttttaaaacattattaacaagttttaccaataaataattctttaactgttatcaatagagctgaaaaaaaaagcatttggcttgtttttttgcatctagacccagatgcaaaaaaaacccagccaaatgcttttttcgtcgggcgcaaattgcattgcgggggacggcaaggacctaagcgcaaaatacgcacacggcgtcgtcgagccgccgtctcttttgtagtcgtcaaacttcgtgattatcttgactgcatgcctaactgagcttgtcattgtagcaaccctggtggctccatcttcatcttcatcaacaccatggtttacttctctcactagggcctccaaggcgcccctgtcgagcgcgatatcaaccaccgaatcgcaatcctcttcgtcagcttcaaggggggcacccacgtcttgctcctggtagttctaggccgtgaacgttcgtcccacgaaaccctcctcttccctaactcaattggctacagataaaaagtgggagagatgaggttacacatggatttcaggtaaacggatttgtctggactatgccactttaaaacaaaaaacccttctagaaaggagaaaaatattgaaagagaggagcaaaatgttgaaatgggtaaatcgtcactaaccaatcgttggactgtttgtgcgctgttgtggttccttcgttcctggttggcgaagagcacgccagctatagatggccatatggcccgaggcccgtggaccaggccaagacacgccgttttggccaggcccaagcacggcccgactggggtcgtgcccgtgccggcctggcccgacagtcgggccatgcctgggctgcaccttcggcacggtgggctggcccggcacggcacgattgaagaaaaaaagtatagggatgaaaaatagacttaaataaccatataaggtaaggcccaaagagaagagaaatacaaaatagacttatttccagccatatgaacacagcccacagagttgagggatgaaaaatatacttattctgtggacaaacacaaagtacagggatgaaaaatagacttaaataaccatataagataaggcccaatgagaaga

SEQ ID NO: 44698 - DNA, 1358 bp, Oryza sativa
aataagacgaatggtcaaacacgtgagaaaaagtcaacggtgtcatctattaaaaaacggaggaagtatatgatatgccgatatggtattgaagtgctggaacaaaagcaaatttctatctccacaagccactgctacaaccaaactgaggccctctttgtttgggcttagacttattggcttagacttttaagtcagcttattggcttatatgatttataagccggtggatttaatgttctaagtttaatggtggagttatgcatctgtctcacataagccaaaaaagcttctctaacctagcttttggcttaatagtgttagagtggcttatggcttaaaaaaaccaaacgaaaaagctgcttgtttgtttagatttagattttttaatttataagttggcttataagcctaaacaaatatggcctgaatcctcgtccagtcacacataacaaaggatcatcagcgtcccactaatagaaagcaaaaccataacgctactagaaacactcggatcaaacagaaccccacacagcaaaacatccgatacaccaaagattccactaaagaaagtatagtagtcacaccaaaactacctatccctgtggtgcgcggttatcctctaacccacacattggtcttaccaaaagcaagctcgcgcgtcgcgtcacgctcgcacgctacacgcacaccccacctgtaaaaaagaaggggacgatcctcctgcctaccgtgcccgcccgctcgcgcggccgcgcggctccaccgaccggcaccccacctaccgcgtacgcgaaaaacctccaaaatcaccgtgagaaccccgcgcgcgccaccgtgatctgtgtgactgatctctcacgttgcagccgcggccccgcgcggctcccctccccccaccgaccggcatggcgacacccagaaaaacctccaaaatcaccgcgaaaacaccgcgcgccaccgtgatctgactgactgatctgatctctcacgttctagcggcgcaccgcgcacgcggacccgcacacgcgagagagcgcgcgcgcgcacggcgattcggtcgtcctcctccggtttactactactagtacttgccaccttcccgacgacgtcgccgtcgtcgtcgtcggcgcgcgcgcgcctctctctctctcaaaggagtggactgcgtgctagtgctagtgctacaggctacgggtcgagaaaggcgaggccaccagcagagagcaagctgagggaggagacggggcggcctctccgccttgcagatctcgcatgcgcggccggagtggacggcggcggaggaggcggcggaggaggagggcgcagtaggggaggcgtacgggcggcggcggcgg

SEQ ID NO: 44699 - DNA, 217 bp, Oryza sativa
atctagggagttaactttagtctctatatttaaataataattgagagtattaaatatagactacttacaaaactaattacataaatgaaagctaatttgcgagacaaaatttttaagcctaattaattcataattagagaatgtttactttagcatcacatacgctaatcatggattaattatgctcaatagatttgtcttgcgaattagtccaaga

SEQ ID NO: 44700 - DNA, 379 bp, Oryza sativa
cctaacccacacacgtggcgccaacaccacggggggtcggggtgccccagcccttggggccgaaacgggagcggctcgacccctcggggagacagagggaggggtggccacgtcaccgtcgggcccgacccccccgaggaggtcgggccacgtgagtgatcgcggctacccaagcctctagtcacaatacccccggccccatgtcaccgacaatagcccccggcgttacgccagggcgaccgcccccctcgagggaggcgctcgggcgtgacgccactccttaggcccggtgacaggtggggccggtccccacaggcgggcagaaacccaacggtcgcaaatcgcgcgcatcggcaagggaaaaaccgatcgacaataa

SEQ ID NO: 44701 - DNA, 1501 bp, Oryza sativa
aacgagatatacctcatttgatattaggttgtttcatttttggtccatgagatggatgtttgatgggaaaagttttttatctactggggtagacagctgcacaccacacgataagtgattcgtgcgtacacccgaccacttcccggtatttcccaacttgcccgtattttgcccatttgttagcggaccatggaaatactttcatgcttgaggtcacgactatagtatttacatggcatgaagatcattgataccagggtatatgcgagattgagataaaaaagatagagacaatgatttttatacaggtttgggccccttcacaggaaggtaacgaccctactcctattggccgtagtctgtgtttttctttattcatctgaatcacactaagtacaatatttgagataacctatctagatgtcgttgacttggcggcatggatcaccaacacatagtcaacgacagggtagttttactcctcgagtacgaactcgtcgagattagagatggcgctagatctctcttgttggcctccgcaggcaccagattgagtctgtttaggcttatcactgatatcaatgtctggtggcgtgtgttggtgtctattctgacttgtgtgtgtgttccctctctccccctatgggtcttgtatttatacctatagatgttcccttgtacaagtagtattaagaagaccaatatagatacaatccgagtagtccttgtcgttttcatatagaactctactcgtacttccttatccggaactccttctatatatgaggtacgattccgtataagatttggtatatggtgggccccgctgagcttagccgattactattgggtacgtggtatccataaccatgacaaatacgactttatacgcggatcctacctcgtacaatcgcactggcgttcacgggggcatacttctccctcctcttctcctcactgacgcctctttccctatcacatcgccctccgtagtgcatcttcccatcctagactatgcatatcccttctttctataaagttaaggccaaaagctcaaacctcgtgcttccacgtcatcatcaaatagtgaaccgttggatgaatatattagattgcttctcagacgttggatggaatgcagcatagagcccaacccattagtcaccgggtgagtctcttcgcctcctcagtgccaaatatagcccacatgaacacattggcctatgtccacacacatatacatgtatccagcccgtcactccgtataaaagagctttatgctgaacgctctttcagttgacatgtgttacctaaattatctacaaatttttgatagggctgctaaaaagaatttctccaagaaagctatttgtttcttcttgatattatacttcttatctaacaaattgatgttaaccaagtcccacagcaacacgtggggcatcctctcgttgtatatactcttcccatccgttaggaatgctggcgttatagttggcca

SEQ ID NO: 44702 - DNA, 1501 bp, Oryza sativa
tcatccaactattatggttgtgtttagttcagcgcaatggattttggttgaaattggagatgatgtgactgaaaagttatgtgtgtatgacaggttgatgtgatggaaaatgactgaagtttggatccaaactttagatctaaacacagcctatatgatgaagaagccgagaacagatcagattatagtagcagtatggaacagtagttgtgagatatccaccttcccttcctccttttgactgaagtagcaagggactatcagattatgttaaaaagtgtgtcacgagtatctaaaatttcatccaattattattggagaaacgaacacagcctatgatgaagaagccgataacagatcgaattatagtagcagtatggaacagtagttatgagatatccaccttcccttcctccttttgactgaagttcaagggactatcagattatgttaagatgaaactacttactccctccgtaaaaaaaaagagacaaaccctggtttccgtgtccaacgtttgacagtctgtcttatttgaaaaaattatgaaaaaaataaaaagacaagtcacgcataaaatattaatcatgttttatcatctaacaacaataaaaatatgaattataaaaaaatttcatataagacggacagtcaaagttgggcatggaaacccagagtttgcctttttttgggacggagggagtacatatatgtttttttttttgaaaatgtagttaaaactacctgcttcctcttttttagttgacactgttgatttttgacttgcgtttaacaatttgtcttatccttttctttaaatgcataagatataaatcataattaaaatatttttagtaataaaataacttacatcaaaatatgataattatgcaaaaatattaataagataaatagtcaaatgtgtatccaacatcaatattatcgtggtatatgtatatcataagtacgttgtctgttcacgtgatactctaccagactatcacagagacgtataacagataacatgcaaggaaaattaataatcgtgctacaggctacagtatatactgagcactgaacagtgagcatgccttcatatattatcaggacgatatacatcgttatcagaaaagatggccatgccaactgtttctgaataaatctccgttatccattcaaaaggggcaactgaaaactccagcgagttgatattaatattgcgaatatacagtgaatcgcgcacgtgcagttagctagaagatggagcaatgagtcgatgtccacttgccataaattaaaacatctctcttcgtcacatatatgaaccataaaccaaccggcgaacaattcaaaccatcaagttctgctttgtacttctgttagtttttgttgggtcaaaaggctttcttctgcaaaaaggaaaaacgaaagaaacgtatatactacaaattcctgatcttgttgtcatggtgatgtggactagaaaaaaaaataataacag

SEQ ID NO: 44703 - DNA, 1295 bp, Oryza sativa
tgtataaattggaaaaaagaatcgcgcccgagaggcacatggaccctccttatataggggaaggagtccgctttacaaaatacagtccatatcctaacggaatatgggattatagataaaatacaatcgtaaccgactaggatcccgggtatttccttgacatacaagtttagaatccaacccgagtcctcataaagatattccatctatatttggtaccgtatattcgactaaagtataactgtcatgcagatatggggtatccataatctccacagtagcccccgagaccttcgcagttgacgaaataaccttctcgaaacaaaaaacagtagtccgagtgcttcaattcaacttgctccagcttgccgagtactagaaatcaaaaactgtgaagggcgaaaataaaacatggtgcatcgagtagatgcacctaattaggtgtagcccccgactatgtgattagttgaaaaactaaacatatagtcaagaaccgagtagttttatagcgaagcatgcatggtacttagtacgatacccagctgactgctgctcaacttgaacatatcaaggacaaaaaatacaagaagggccgagcgataaacactcaaaggtccaaaaatagacatgtttgataggaatccgagtaaaaatctcatagaatgacccaccaaacatgatagaaaatcatggtaattaatgagtctaatagcctaggctgtgacccttaccataaccaaaataagcatataacatgctaaaagaatgactattaataaaccagtcatctcaaatcaacccaatcagcttttccagcctaataaagcttacaaaaaatggtataacacctttctgtcgggcacctttttatgtgcatcataataattccaaagaattattaaatcgcgttaaaaaggattttaacagcattaggccacaccattgtgaacataaattaccaaagcaaaaagtgcctaagtccctagggatcacaacaggccacgctgattatagtattgggctgaaatactatacaggcccaggcccattagtactcccgataccctaataataccgaagtgaaaaacgtctcttcgtcttccccgccgagactctcgccattttccccatttcctgctacagtgcaaaactgcgccgggcaaactagggttcatcaatccgctcaaatccaccctcaaaaacttcacgaaatttctccccgcatccatcgctccgattccccatccctttccagccgtatctcaaactaaatcaaaccatccagttcacattca

SEQ ID NO: 44704 - DNA, 917 bp, Oryza sativa
caaatacatggtaacaaataacagcgtgatagaaatctggtatgtcccaccttggaaatcagtaatctgccgagtgccaacgtacacatcagatctagttcttgtgattttttgtctgaattgttgtcttgcctttcgtatttatgtggtgaattgcttgtttatatgttcattgcatggatgatcacttattcgaaccaaacgatggaaagggtttccattccattccttgattcagccagacaaagtcggcattttgcttaatccatttcagtttccagtgtttctaagttccaacactacctatatgactcctgttgcacgaagaccgtaagagtgaggagatacaaaatctaagaatcacgtaatggcatttcaaagttttgtagcattgaagcatggtaggcaggaaatattctaatactatgctcatgattcatcaattgacaagcattatatgaaatgacccttcgattataggtggagtaattttactaaacaagaataactaatttgtaagtagttgggcatacagttagctgttctgactaatatctaatacatagctcaatgtttgttttcatgaaaaaagatggtgactgagatgataataattctaatagatggtccggtaataaaatattttttgaaatctagcggccattttggtttgctaccaaaatgtgccctacgaattcatttggcaactttaatagtgctttgatattgtttggattgaagccaatttatagctaaatcaatgtgatattataccaaattgttggtagtaccaaaacttgcaaagaaccaaatgttggcgatatggcatgagacccttcgaccaaacctgccgaaagcatgcgaccaatggggattaaagcccgagacgtcagggttagtcaaggcgaaccccccca

SEQ ID NO: 44705 - DNA, 333 bp, Oryza sativa
ttcctgcagcccacatatgagatacaaaatacgcaggtttactaactggaaagtttgatagcatcaataaagagtgtggaaacagatcgcagagagcattaatcccagttcagtgtacatattaactataaaaaatatgtagtttataataatataattcaagtatattgatgttgtcacggtgctctggcaaggcaccgtaagcccacagagccagggtggcatccaggtcaggccatagcaatgctacggaaataaaatataaaaaggaaaggagtagcgcaacacataaacagataaactcagctccctccctctagctctcatcctaga

SEQ ID NO: 44706 - DNA, 592 bp, Oryza sativa
gtggtgtttggttggagggactaaagtggggctaaactttagtccctctcacaaaaacataagtccctaccatagggacttaatacttttgtgagagggactaaatttagtccctagttcccaaacaccccctaaaactaaagagtacatgttatttctattttcaaatgcatatactatttaacacaaaatcctactaaaattcacgattaatacaatctacttagtcaacaatcagttcattgtaaccacctacacgtgcatttgcacgggctgttattattatgttgtaaacataaaaattctagctatgtatcaaatatattgattgttgtttgaaacagagcagcaaagaataaaaagaaatctagaaaaataataagttgagtcgaagatgtgaacaactaatatttacatgaatgacactctcagccaatgcggaattgcagatgttacatgggggtacggttttcaagacaatcaaaccaactcccactctcatccaatgcggatgttatatctgtcaaaacctctccatgacaagcagacccaactactatctcggattctcggatcccatgtgggagccaca

SEQ ID NO: 44707 - DNA, 1501 bp, Oryza sativa
ttccctaattgcttatatataatactcccttccgttttaaaatgtttgacaccgttgactttatagtacgtgcttgaccgttcgtcttatttaaaaaattttgtgaaatatataaaactatatgtgcccgattttttacatgtaagcacatgcatcagtttaattccaaatataagcacgccaaacccatatttcaatccatagacgagatgctcaagtgcagacattgctccataacataatgtccaagtgttgttccataacataatgtctaacaaattaataggccattgaattgagttttgttactttgtattaatgtttgacatatttattaagtatggttcaaaatatgttattttgattttacaaatcattgttacacattttttaagtataaactgaatatagcaagctaatagacctaagaaattgctactagtttacaaataaatgagtttacattaccaggcttctaacttgtggacgttatcgctagaaacaaggttgcaaaaggtacatttattttgttaggcattagatcgagggattgacgtggtcctgtacatgtacatgcttagaaatggaattataaatatggtgtgctcaaatacgtaataaaagggctgcatgtgtttagattaaaaaaatcggctatatgcgtacatgaaagtatatttaacaatgaatcaaatgatatgaaaagaataaatcattacttcacatctccccatctccggcgtgcaaacatctaccagaatggcaaaatgtgttttcggaagacggtggccgacgaagaaaatgcaatggttattacatcaaagaaaaaacatgtccgttaatttccgagtaatatatatatatatatatatatatatatatatgtatatatatatatatatatgtatatatatatgtatatatatgtatatatatatgtatatatatgtatatatatatgtatatatatatatatgtatatgtatatttatatatatatgtatataaatagtgtttttgaacagtgttttttgtccgaagcataagtgtggtatcagagccagtcatcatagagaaatcaaattcagaagctaatattggaaagataattactaccaaagataatctgagtataaggtgtagattaaatcacattgaagaccatagttggcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggattataagataaggcagaataagatattacaaaacagtgattatatcaaagaattattagaaataataaattctagtaaaggaaaagagatagttttggcttcaacaggcataattacctcgtctcaagctattaattcataaaaa

SEQ ID NO: 44708 - DNA, 1501 bp, Oryza sativa
gaaggcgaagtcgtcgatgccagaaacaaagcccatcgcacttagtcggcgagaacttgacgctacccctacctggcacgccaactgttgaaacaagatttcggcaataataaaaggggtggctatcaagctaggaaagtggatgggtttggagacaagggattttatacaggttcaggccttcttattcaagaagtaataccctactcctgtccggggatgattccgccgagtgtgttattgattgtataaactggaaaaagaatcgcgccccaagaggcacacggaccctccttatataggggaaggagtccgctttacaaaatacagtccatatcctaacagaatatgggattatagataaaatacaatcgtaaccgactaggatcccggatattttcttgacatacaagttaaaaaccaacccgagttctcataaagatattccatctatatttggtgccgtatatccgactaaagtataactgtcatgcagatatggggtatccataatctccacaatgaacataagtgcaagagacgaactacatgcgagcgcgagagtaatgttcgggatcatcaaccgtggtgttaaattctgtaaccgatgcgctcgctcatacgaaatcaattcccgtatttattattgtccgttacaaaacgagagagtatgtgcgagcgcgagagtaatgttcgggatcatcaaccacggtgtttaattctgtaaccgacgcgctcgctcatactaaatcaattcccatatttattattgttcgttacaaaatgtcacgaccagaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaaaaagacaaacgaaaaacagcggaagactagggcgacgaccacaggcgcttgacggcaggcacgagctagacaccaaagccttcattatccaggggctcctcttctgggtttgggaaaaaattgagcaagactgagtacaaccaccgtactcaacaagacacactcacaagtgcaggataaatccaagggagtacaagggggttataatataaagggttagggtttgcagcaaacagcattaaaagacacttagttgctcaaagctattttgtaaatacgatcctagagctatacaatattattaatcaaggccgtgaacccacacgaacctgccttaacccaaggcctacgatgattcagactgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaatagattatactctgatcagatgtgtacatctttacccacaa

SEQ ID NO: 44709 - DNA, 1501 bp, Oryza sativa
gagccttcggcacttggtgccgaagccgatgtggtaccatcgactttggcccctgcgccgcaaccaccaccttcggctcctactgcttcgacggggcaggcaccgaacacagtcgatgcggcgaaggcggtagcagcggcaagggcgctctagaccagggcggagatcctttcgacaagtcaactggtggtgccccaggctgcttcgccgcagcaggctatagcttcgaccgcgcacagcacaccggagccaacctcaaagcgcaagccgaagccaacatgggggccatgcgttagaatatggtgcgactccaggacatgcttcgtcaaatgcaagagcagcagcaggcatacgaagtggcccggcaagccaaggtcgcctcggcccccattctccagtattcggcaggctacatcccaccccaggtctacccgcaagtgccgattcaagcccttccgtcacaagtcatgcaagcaccagcgtacttcgccggacagccttcgaccgccacagtacatccgacccctcatgtacagtcacaagttcggccggtcgctgcccaagtatgccccccgccacctggtcaaatgtcgcaagcaatggcggaaggagcttcagttttgcaagcgcagcttcatgcttttcttcagcagctcaaccaaccccacaacattccagaagtaaccccttcgacccaaccggaggggaacacaagtcaaggtgcacccatttgactaccgacgaacctgcctggtccgggggcttcaccatggagtcaaggaccgcaattcgacttcagcaatgccactcaagcaccaaccatccgaccacaggcaccgacaccaggcttcggaacgaatcaggcgccaaaccaggtcgccatggcatggacctagccttcgttcgacccatccatggcggctcatcaggcatcaccgttagcggccaggcagccgaacactgtggccaaaccgcacgtgcaagccatgacttcgcccttcgccatgccatatccaaacaggcctctacagcaagttgccgtgagcaaggcggggggcgaaagggggctgccgctgagtgggggaatcaagattcatccaatcccatcccagttcaagttcccacccattccgcgatactcgggcgaaacggacccaaaagagttcctgtccatctatgagtccgcgatcgaagccgctcatggcgacgaaaataccaaggcaaaggtaatacatcttgctctagactgcctcgcccgttcttggtacttcaatttaccagctaatagcatttactcatgggagcaattgcgcgatgtctttgtccataaatttcgacgcacctatgagtagccgaagacagagcaacatctactcggcattcgccagcggccgagggattcgataaaggagtacatgtgtcgcttctcgcaagcccgatgccaagttcaggacataactgaggcgtctatcatcaatgccgcttcggccgggctgctcga

SEQ ID NO: 44710 - DNA, 1501 bp, Oryza sativa
gctgaatgtgcattaaacccctgtccaggaccagtcagggtacacaaacgataattattgacatacagatccacgtcttacaaaaatataaaagattacaaatgcagcggaaaaggtaaaacgagctaagcctgaagacttgactcctgcagtgggcgactccattccacaggcatccttgatggcatcaacaaaaccaacttcttcgacacggctccaactgggaagaacttctgctctggtgtaggggaaaagagagcaagactgagtactacccactgtggctagaggttcatttgcaataaagcagacatttaaaagcagtagttgaaagcagtaaaacagttgtagtaattaatcaatattaaccaatcactgtccaacactataccacgttgcaacaggcccaaccaaccacctgaactacaccagttcattagctaactaggggtgagactaatcacagtgaatctggtcgaccgcccataaccgcgggcacgactattcgaatagttttactctgatcagaggtgtacaactgtacccacaagaaacagccccacgacacgttaccgcacgccgacatgccaccatgacataccagaaagaggccgtgacaggacccttcgcataagcccctctaaccaatcgcaccacacctcaagtttcacccccactcctcgcaaggcagcgggcagtcccctctcgtgccacggtgaattcggaagccgatcaaccggacaccccggccgacccaactccatcacgcccacccttgcctgggtacatcggctagaggaaagctacactacaagtccagccattgcccacgctggcttgtggtaagtacgataagttcttccagggcatcccgcgaaccggtccttaatcgccatgggcacgactagcaaaaccatgcacccacagcccaccatgtagtgtattttaattaactaacaccattgcggtggcactaatccaaagctatgccaataatcaaagtatatgcattaatgtgattccccttttgtgtactagttgaactaagcatggctaagcattccctaaactaatatctaatcatgttaatacccaagttatcaatggcataaggtaaataatatatgactgagtagtaggacccatcccacatgatattgtaaaacaatgcaacatttaatagaaatgcgggacatttgtaaattgggtacaatatgatcaattgtaatgcatgaatttccttgctctcgcactgatgagaccacagcaacgtcttcgagaaaccgcggatcgacgaaacagccgaaatctacgcgacaaacaaagcacacaagcaaaacatgctataagtctactgaaataggaaacaaaaccatttttaatggattcaatgcatttttatgaatttactgagacttgaatggacttaatcggagctcggatgaattagatatgatttttagaagattatctgtgttttcactgtaaagagaaaaacctt

SEQ ID NO: 44711 - DNA, 1501 bp, Oryza sativa
tgattgttcccttcggtcctggcatcttgagcacttgatacgcgtagtgagatgcggccatgaacttcgcgagtgcagttctcccaatgatggcattatatgctgtatcgaattcagtgacatcaaaggtgatctgttccgttcggaagctatttgcttggccgaaagtcacaggcaacgtaattttgcccaatgatttggacaatgactgaggagtaattccatggaagggttgatcagtgggtgtcaactcgcttcgtgggatccccatcgcgtccaaggcactggtgaagagaaggttgattcagctgccgccgtcgatcaggactcgtgcgaccttgatattacgaatagtgggttcgaccatgatcggatatcgccctgggatgacagcaatcttggggtggtcctcttccgagaattctatcttctgctcggaccacttcatctttggcgtagccccctgccacgtcgaacagacttcacgctccactttcttgtattctcgctttgaggagtatgccgtggaacctccgaagatgtgtgagacatgaagatcggaatctgggtatgctgagtccgattcctgagtaggcgcctcagcgtccttctcaaccacgtgtactcgtttgcctttttccgatgccatgtgttttgcgagcgactttttgaaaacgaggcaatcttctagagaatgtatgtccgacttgtgtatggggcaccatgctttattcgtgtcgctgccttgtgggtctgggcgcttgggagggtccgcatattctgttgcgagaacttccgattgagctttccttttcccactcttgcgatttttcttcttgcttgactcaggtgcgtccttggctggtttcttctcttctccggtcttcggtttgtcgttcagtgcgtcatccgcatgagcgcatcgatcgacaatttcgaataatctctgagtagccatcggacatcccgaagtgaacgactgaaagctctacacctagcgctggggcggtgggttgtcggcgatcataagtccttcgtggatgtctatctgatgatgaagatgacgaggatgatgacgatgatgatgggtcgcttggttccggcgtacgattatgaggacgtcagccgggttctcgagaatcctgtcgtcgtctcccgttattgtctcggcgccgatctccatcatcgtcgttattatggcgatgtcctcgaccagtatcgcccagcaccgccgttcgcgatcatcgtggttatggtggttatcacggtctcggtcttcgcttgaatggcctcctcgatcttcgcttgaatggcccgtgaagagacatgatgccgggaacggttctcgttgtctcgtgtgtgtcgtgcctctcggcggccattcaggtgatcgaggagatcgcaggtgccgcgaggtggaggggtggctcgatgaggcgattcccgccgttcagggttttcaccattagcatcgccagttggtggctgttctgggtgtgct

SEQ ID NO: 44712 - DNA, 1501 bp, Oryza sativa
ctcccgtagcttggtgcgcgacaactcctgcgcttcctcctcctcccgggacaaattgaacacgttgaacccccgcggcgtggccatgccgtagtatagcttgccaccgcgtccgacgacgctgtccgtgagggagaagaagatggaggaggcggtgaggacggcgacgagaccagcggtgagccaccggtttgacctgtagcactggccgtggttggtgaaggacgtggacagcgcctggtaggccaacgccgtgcccgtaggcagcagctgcgccaggttcgccgtgctggccataaccttgtcagtcatctccggtggcggcctagccgccggcagcgcaggcgcagctgtcgccttacgctcgccgacaccgttgggcatcagcgtcgtggccatgcttatatctgcctcaggagctgcctcgccgtcaccattggtttcttgtggttgtggcatatcaatcagcttggtctcaagtgaggattccattacttggttttccttgtgcattaacgaaatccggttgataattatgtataatacgttacgttcttgaggatttatataggtgaatcgtttgcagttttttccacgcgtggttggtacgcgtgcattggattaagaggaaatggtcaaccagagactaagctgagctaggtagttggaaagttggaatcattcttagctttggaattggtatactagttgatcctcctcccatcctaaattattgggcgccccatttttttttaaaatcaaagtcggtaatttttaactaatgatcatactaaccacatctataataagtattatatatgttatatcactagatttatattttgaagcacttacatatgatgttaatttcatattcatcggaaactttacatagaataaattaaaagtcaaagtatgctgctcatctctacaaatggattcatgcaatccatactgaaaccaaaccttatgtttcatacagacttttcgaagtcttgaaatgtgatgtcgatgcttcgccgatgcgatccatcggcagagttttttcccatatgttcttttacgtgccaacgcatcattttaacttgagctttgtacctaaagaaatgcctcagccgtgatattatagggaaatatcgcattaccttagcagaaactctcgtcttggaaggttatccgtcaacatcaccggagtcatctcgtctaatcttatattgtaacgccatacaaactgggcatgtttctaagttctcgtaatcctcaccacaatagaggatataatcgttcgaatatgcgtgtatctgatctgtacttcaagtcctagagggcagactacctgttagcttcgtacgttgtttcgggccatttatttccctccggaagaatattctttatgagtttcaataactcacaaaatgccttgtcagtcacaccatttttttgccttccattgtaagaattccagcgtattacctaactttttatgccctgttcacagcct

SEQ ID NO: 44713 - DNA, 302 bp, Oryza sativa
ggggtgtataggagtatagttgcagagctgccgacgggtgacgggacttctagaaaataaaaaatgaattccaacgatagttatgttcaatttttagaatcccaatgacaataaagagtaggcggcggacgggccgtagaggagcatagtggcatagtttgacaagacttctaaaaattataaaaaaataaaacccaacaagacaataaactctataaactacaaggttcaatttttgaagtttcggaacttctaaaaagtaaaaaaaacaatgatagtcatattcgattttaaaatctcaa

SEQ ID NO: 44714 - DNA, 420 bp, Oryza sativa
tgcctgcaggtcgactctatatgatccccttctcaactattcctaaggaaaagcactactactttttttactaaacaaccataacttcattgggtcgcacatcactagcaggaacagagcacaccattttgaaaaacatacagacacttaaagtgccaagatctataacagtttacgcaaagcatatttccagtagaactttggatttgatttgcagctttaaggatgccaatttgtatgaatgcaaaataagagccaaaaccaacttagctattgctaattgatggcaaggaccaacgaaaattgattgcgtataactaaaagcttgactgtgtgttgctgggaacatattgaagggtcttacattctgacgaaagacgtaaatcttgcttatatattcaacggcttgatttaactaga

SEQ ID NO: 44715 - DNA, 1501 bp, Oryza sativa
tcacattgttggcaaatactagtaacgttacttgtgtaccaagtgaatacagtctcaccagtgctgatgactctttttgctgtttcgggaagattgagatgtcaaagtttggaccatttttatcgtaactgtagggcattgggatgtctttggaaacaattgtgcagcccaatggaagaatagacatgtatgtatagggatatgccaaataccagaactggcttgcgttgttagcgaggctggggcaagaggttgggccaactataccatattggtttgtgtctatggaatctcttgaacaacctactacacttgcaacttccgacgtatgaggtttgtacacagcagttgattgatttactgacacgagcttctgaagtgggcagtgaggtaaggaatctacaagtggaatggcgttcatgataacatgcctgtaatatatcatggtcactttgcaggaaccaagaacagggtgatccaggatggtgtcttgtccagagcatgataattgcataccaggtgcaccgcatgatggaggttgtgtcgaaagacggaacgggtacctgatctctggtccatgcttgctgcaccgctgggatgaacaagtcttgaagaagtcttcatcatcacttgctgtggcaacatcggattcgtatttgagaggagagagtaggaggagcaccgtgataagaaggttggtgaagtccatgcagttcaatggagatgagatggaggtggatgatgagagggctgtgctttagaaatatttggtcacctgttttctcggtgacgattgatgctgtgcttgctatgatgtctgaggctctgagcagagccaatgaaacttttgacgtgttctatttcttcaaaaggtattccttatcatttttggctcccccatgcccttgattttacactaccgatttattccggctactattccaataaccttgataacatctaaagctagtacatgagacttttttttttcttttggtgatgttgaaatcaactcgtgaagttgacatggtgaagctttatggtggtaaaggagagactggtgataatctttttttaaaggtttggtggcaggtaattgcacgctttcggtgtaacttccagcggctgcattgcctgatcttgactgagatgctgttgatgagacagaagaagacagaagagtaccattcagtcccacttcccagaccaacgaggtgcagcaaaacttgttcaggtattcggaagtgatgatgaagggagaatatatggacatgtctgttaagctatcctaaacgaacgaatctgtctcagactctcagtcaacagcatcacagtcaagggcaggcagccctgattagctaaacacgtcattgctcaggtattcggatattatttttttttctttttgcttattcaactggaacacggaagcgcttgcaatatcaaccatgtcgttcgtccatcttgttctgacctgtgcgcttttctttgaacctggcaa

SEQ ID NO: 44716 - DNA, 216 bp, Oryza sativa
tttttttgggatggagagagtacttgatttgatatacctggctcaactcaatcgtgctggatataattttttcccgggcaagttaccttatatttataacgcagtaactattaaaaacacagctatgcataggaaatctactagttagatattttctttcctgcttaatgaagtggcagacctctgcttctttaaaaaaacattttcttttacaga

SEQ ID NO: 44717 - DNA, 1501 bp, Oryza sativa; identical to SEQ ID NO: 20169

SEQ ID NO: 44718 - DNA, 1501 bp, Oryza sativa
ctgtgaaaggaaatcgaacggcaaatccagtcatcattagctttacaacatcctgatagcttacattctgcagcgccgacgtgctgttcaacttgctgccacccaaaggagtcgtggccaggtacccacaggaaggctcaaggttctgaatataagcagattgttggccagtaaacacgtaaacgaaggatctgctggtgctcaggcaagcgacgggcatgtacatccaactgctgttccttatttcctgcgaacaattgacaaagctagcccaggtaacccctactggaggtgccaattcaatgatgtggtgtgacttggcctggagcctgggatcacgaagaagggggttccagcgaggaagaaggcaactgctacgtgaatccaagaagctggcatcgacgacccacaaggtagaatcaccatagttgatgtcacttacagagtatgtctccttgtcgatctgaattgtagccttgtcgtctgcacaagttagctcgtaggattgaacaccgcactccggcgggtcacctcgccggcggaacgggaacgacacgtcactgagatggccgcatgtgaacggagggcagtcatggcgccgatgatgccgccggccacctgcagcatctggaacgagaaccccaagcacacacaagacataaattactcgcatgacagtagagcaatgcagagcaccatgaatcgcaattgccaggttcaaagaaaagcgcacaggtcagaacaagatggacgaacgacatggttgatattgcaagcgcttccgtgttccagttgaataagcaaaaagaaaaaaaaataatatccgaatacctgagcaatgacgtgtttagctaatcagggctgcctgcccttgactgtgatgctgttgactgagagtctgagacagattcgttcgtttaggatagcttaacagacatgtccatatattctcccttcatcatcacttccgaatacctgaacaagttttgctgcacctcgttggtctgggaagtgggactgaatggtactcttctgtcttcttctgtctcatcaacagcatctcagtcaagatcaggcaatgcagccgctggaagttacaccgaaagcgtgcaattacctgccaccaaacctttaaaaaaagattatcaccagtctctcctttaccaccataaagcttcaccatgtcaacttcacgagttgatttcaacatcaccaaaagaaaaaaaaaagtctcatgtactagctttagatgttatcaaggttattggaatagtagccggaataaatcggtagtgtaaaatcaagggcatgggggagccaaaaatgataaggaataccttttgaagaaatagaacacgtcaaaagtttcattggctctgctcagagcctcagacatcatagcaagcacagcatcaatcgtcaccgagaaaacaggtgaccaaatatttctaaagcacagccctctcatcatccacctccatctcatctccattgaactgca

SEQ ID NO: 44719 - DNA, 153 bp, Oryza sativa
gtgttcaatccctaacacgctcacaatttcttcttaaaaaatggttggagggacatctctccctccaaatctcctatttttttagaccttttggtggtaagaccatagtcctgattgttagaaagttgcacccatcgagtaatcaagaatgta

SEQ ID NO: 44720 - DNA, 965 bp, Oryza sativa
ttttgccaatgacagctgtactgtgatccttattttgactatccttgtctcaactcagggatgtcctattttcttcagtcatactactattctcactaatttgtataactaacctcatgaaacatgtatcttctacagaaataaactcttgtaaagttggcaagctatatcatcatataaagaagactgaggttgtggacttgtctaagtccaatgggaacttgctggcttgctgcagtcaagtcgtcttcagcaatagtcaattgaaacactacggaaatactgccggccggggtaagtagtttatatgcaaatgtgctttcggttctgcctgttgaaattcttcccgttctaatccgcagtcagtagaaatcatgggcagtctgcacttgtattctgcagtcggtgctaaaaacaaacatttttatgatctatatatttttcgctgggctggcaaaggaaacgccggccaaatctattaagattgagagaaaaccagtacaggtgtccttgttaggcaggagtttgttagtatattcggtttgtctgaagttcttatggtcgctaatcgtttgcttgctgtttgatagacaagaacatgacaacgtgtgtacccgctttgagctccgcgctgttattctggagcccatttttcttgtttacaaatattaattgcatttcctgcctcggtttcagaaaagaaaagttagcctgacattgtaggttgtctagaccaataatgcacaggtcagtgcatttgacttactggaagaagttaaagatcaaatcaaaactgtactgcgattaagaattggattactccagtcaacatctgaatgtaggtcagtgcagtacttagcaggtaatcacccgcgtcaactagctttgctaatcaacttggtaacttgggcggcagctagagctagctagtcgaacagtaactgtctgtgtctggctgtctgcca

SEQ ID NO: 44721 - DNA, 835 bp, Oryza sativa
gtttcctctagaagtagaaagtagctcgaatatgtaaacaagactgcaagggaacacttgactgggacaagatataatctaagtttttttttatttttttgccaggtcggcgaaaggaagccgaccaaaattcattaagataaaggaataattacagaggtatacacgatataatctaagttttggtttgttacctgatataacaggagctgcagttagatctttggttgctttgataatagattagtagacatgggaggtgatatgtggaagcctttataatttagcccataacccacctcaactcatcctaatcatccttatctggcatgacaaaaatacgagagttagcacacagaactgtcttatgatgatactgcaaaataagatgtaaggaaaatttcactattgcaaatatattcatatgatcatggtgcataaaaatttagagccaaaactctatcctaccccaccagggccatgttcgctgatacattttgttggattgctctgtttttattttcaagatgtaattatccattatctgttaaaaccaccaaccagaacttattatcttcgttcatacttgcaggttagcgtgtgaaagtcatttcaggtactgcagtactcaaacctacctttctattaaaaagagaaaagaaacaatgttatcagtacatataaattcttattgctagcagttctgagtcttctgactcagcattcttctgctaaaaaagacaccacctgctcttacagtacccatcaggcaatcacaatcagttgattactagccacaactttcgatcctaatgcaatgtgctaatttcccctt

SEQ ID NO: 44722 - DNA, 296 bp, Oryza sativa
tccccacctgaatttgtcattgcaattagaggtacgaagttcattacaaaagattgatagattgtaatggggaggagaagatttgtttcccaacagagattacaaatcgatcatcttccgttaagttctctgcccagagagctgcctcggtgatgcatcgttgtaggcaggctcttagtgaggggcttttcccccggaaaacaacatcgtgtcgatgattccaaatagcccacatgcaaagcaggaagaagacctgccagtgtagcgccggaacttgcgtagttggacccaaacga

SEQ ID NO: 44723 - DNA, 276 bp, Oryza sativa
ctttgttcctattgggatttgcctttgttctctactagcattatattctgatcctgaattcactgttatatagatacttagctgtccagatttagtactggcattgaaattaaatttctacaaaattatgccttctgtcatggattcagcctcaatgtaattttggatttccttgcagtggatccagtttcttactataccttgttgagctaaatcatattgctcatatgggggatatttttatgcattttaaggctacctatgacttccttgact

SEQ ID NO: 44724 - DNA, 450 bp, Oryza sativa
atcatttatcttcttaaaatatgtttgcagctagcttatagcctgctattgtatcttctctaactgtaatacattatgaatacacagacaaatatcttgaaaaagatacattatgtcattgaaacatttgaaaaatacacagacaaaaactagtgtgcaatgaaccaacattagaaaaacatgtaaaaaatatgttgataagtagagtgcaacatcaataataagtagaaaaaggcgaaaccctgttaaattcaaggtgaaacattttctggaacattaagtgccaactatcgaagcatcaaaaataacaaatctaaaaacatgaaacacagtcaatttcaagatataacatttcactattgcccgtgaaaaattgtagtccatttgttgaaacatcaagatttgcaaagcataccaatatggctttcttcctcccgcttccacaccagg

SEQ ID NO: 44725 - DNA, 1501 bp, Oryza sativa
ggggtttaatgtcagatgttagggataggtttgggcgacctcgactgtagttcctttgttggcctagcagcgtccggtttggtgctagccttcttcccaatttgtgtttggtgctgtcggtgcgtgggaggtggaaatctttgtttttttcctgattacgacctcccaaggttgtaattttgtaattttttcctactatatcaatttgaatttcacactgtctgtgcaagtcgttcaaaaaagttctgaaaaaaaatgctactcaatacattcctaattggttctctgctttggtgtggcattcggatcactgcaacgctggaggtgttgactccagaggtcagtgtggctagcggaaggaggcagcttcttgccttgactgaccgggtcgtttctttgccgtgaactagagggaagctttcgtttatcataactttgtgattgggacgccatcgttatgtgtggccattggccaaatgtgttgttggtcgttgcattttatgtggtgtactggtgtgtgtgctactgctgcatgagcacgccagagttcatcccgatagtgatggtcaagtctccgggaggttatatggacctgtttttgctgaaaagaaatgccacgatttggacagcctagtagtgcctgttgttaccgctgggagctgtaattcaaatatccaatatatttatgtctgactaacaaattccatgtacacaccctgtttatgtttgtctgaccgcaggaggaaagcatagcacgcgcagcggcacagctacagagctgcaagcctccactaatcaaatgaaccaaacaaacagtatatcagtatgctgatgccttgagatgtgatgtcaccttttgatctattttatgtatctatggtatctacaatcgctgcgttttgatgatataagttcacctgaggtccctgaacttaacaacgatattttttgaggtcttttaaccacaaaaccagaaatgtgcaccctaaactcacacaaaccatgcactcaacgttctatggcaatatatatgggtagtttcgctgacgtggcatcctagtcagaaaaaaataaaaaaaaatacatggggcccacatgtcagttgcacattcaggagcagacgggcagatgcgggcgtggtagccgacggcggagcgggtgcggcggcgcgcggggaagaagcgggagagggggagaaaggccgccgggacggcgggagcggcgggtggggcggcgagtgagagtggcaggcggagcggcaagcaagagcggcgagcgagagcagcaatagagttacgggcgagcgaagctagccatgggcggcgggcaagagcaacggcgctcgtcatgctctagatcttcaccaccggcgtcgtcgtcgtgctggtcaacctcctccatgagcgcgacaggcggagtagcggtgggcgagtacagagcggggggcctggtcgacgagcgtgagcagcccgtcaccgagctcgcccgcctccactgtcgt

SEQ ID NO: 44726 - DNA, 1501 bp, Oryza sativa
tccacgaccacgtctaccagtacgtactacttgatgtttttttttgctttatttatttttcctcgtgtgtgataggatattgagcaatctcatcgtcggtactttgcagaaataacaaggcaatatatatatacacgccgtgtcgtacccaattgctgccgaataaaatcgttggcaatatcataaatcgatagtactcgaaaatgtgtgatgtgtggttggtggcttggtgctaccgtgctaggatgatgccaagaagtacggttttctttttttggaaatctattgttctatctgacaaatcggattaaatcaagataaattatttttccgacaattatcgcatcccacgaaatttcaactattactattttacaaataacattgcaaagtgtagcacccttacattatttcttcggtataagaagttttggccctcgatatttttttgtctttctcttagctctagttaatatatatatatatatatatattttgtcttgagtggtttggggttttgtgctattgggccacaccattaacttttttttttacatataacatcaatgatactccaaatcatttgaaattcttttcattaaggttttgtgccacgccattaagctttttttatatacatatagtcaatgttagcttatctgaaattcttttgaagtgtatcaaattataccatcatttgcaccaagtaggtataatgcgacatcaacaaaaagcaccattaaaaccatccatcatccatgcgtcaaacatggtttgatggtttaaatatctcacgggtattcaaaagtttcttaaacaatgttaccatacactatgcaaaattgcaaatgaaaccaaactatatagatttcaaccatctaaattaagctggccactcgtatactcccttcgtcgtaaaacaaaccaatagatatgatatattataatactatacagatttgtggggttagatttaataagtctcagcacagcaactgaactttcatcctttcgttcctacagttcgtcagttcgtcacttgtcgccgagggagactggaatgcaaatcaaacgcacacgccttgcacgacgcactcatgcgcacctgctccccctataaatcgagcacaaaaagcctgtctctcctccccacaggtagtggaacggagccaccgcccaactcgcccccaaagttgcccatctagataagaagaagcgtcgcaactcacggtcgcagtgccacgccccacttcatatcctttcccttccccaactgaaccaaaaaaaccaccggggaaaacttcttccttcttcttcccctttgaagccatgggtggctttcccccggttggcggcttccgggttcggattttcccttttattcccgccggcgggaaggctgggacagcaggggcggcggcggcgtcgtacgcgcagcaccggcggaggttctgcgccatcgtggcgaccgcggcggcgtcaccggtgccggccgcggcgg

SEQ ID NO: 44727 - DNA, 518 bp, Oryza sativa
tcgattcacaagttatatctttttaacaggtgagcaggaagtcgagatacgattgtacaattacagaactatgctgtgttgagcagtttgtaggatcctacagcctaatttctgcatattaagtatttttggcattgtatgcagtgtaatgaactagtgactgtgcgctggactgtgaatttgtgatgtgatatgagtgatacgatgatattggcatactgtactttaggaagagcagataactgctgcacatggagttgtagttgtaattattaggaccgtccatggaagttgtgctttctgaatatcagaatatgcttcatatgccagtggtgctgcaccaccctcagtaaacttgatgatttcgctcagtcttcagtatttactttcaagaccatgactttagaactttctgtgtacatttaacctgagaacggtccttataaatgtcactcatcagttgtcatttgtgcatttgagtatttgactgaaccccctctgttctcttctactgcagg

SEQ ID NO: 44728 - DNA, 1501 bp, Oryza sativa
aatagatcaaaaggtgacatcacatctcaaggcatcagcatactgatatactgtttgtttggttcatttgattagtggaggcttgcagctctgtagctgtgccgctgcgcgtgctatgctttcctcctgcggtcagacaaacataaacagggtgtgtacatggaatttgttagtcagacataaatatattggatatttgaattacagctcccagcggtaacaacaggcactactaggctgtccaaatcgtggcatttcttttcagcaaaaacaggtccatataacctcccggagacttgaccatcactatcgggatgaactctggcgtgctcatgcagcagtagcacacacaccagtacaccacataaaatgcaacgaccaacaacacatttggccaatggccacacataacgatggcgtcccaatcacaaagttatgataaacgaaagcttccctctagttcacggcaaagaaacgacccggtcagtcaaggcaagaagctgcctccttccgctagccacactgacctctggagtcaacacctccagcgttgcagtgatccgaatgccacaccaaagcagagaaccaattaggaatgtattgagtagcattttttttcagaacttttttgaacgacttgcacagacagtgtgaaattcaaattgatatagtaggaaaaaattacaaaattacaaccttgggaggtcgtaatcaggaaaaaaacaaagatttccacctcccacgcaccgacagcaccaaacacaaattgggaagaaggctagcaccaaaccggacgctgctaggccaacaaaggaactacagtcgaggtcgcccaaacctatccctaacatctgacattaaacccctactctagccacctctttgggattgagagagaaaaagggtgagacagaaggatggaaccgctctcccccataggccctctgacatggtcaacttgcataagctagggcgctgacacgagaggacatgcatctagagagctagcttgcaccaaaagtctaggaggattcaaccagggttgcctagacgatgtctccagggagaggagcgaataaaacaccgccgccgccgtccatcgagctctcaaaaagagccaagactaggttttcacccaccgaccaccacctgcaaatccacggctgacacaccgatgctccaccaccgtcaaacctttgccgaaatgtgggaccactgcaccgacgccccccgccggctagcctccgcgtgccccacaccacaccgcacccatcggcagctcctcctcatgccgtgccgacctacgtcaccgccggccacgccttcttgcgccgtgctagcctccgaccactcctccaggcgtactagccagccgctgccacgtcggcccatccgctggccatgccggccagatgtagccatcgcccacgcctctcctccgctggccgtgccgaccatatgcagctgtcgtccatgcctcctgatgtgaccatggctacta

SEQ ID NO: 44729 - DNA, 1501 bp, Oryza sativa
acttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcagacttaagtccctgtctttagacactaatttagagtattaaatatagactaattacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaatatccgatgtgatagggacttaaaagtttttagtcccatctaaacagggccgttaaagactcaaccacgcgatacgcactccaaaaaaaaattgattggagtaaagacagaatcaaagtggaacgagagttgcagaggcccccaagtaatataatactacaaatacagagcgcgttgccctaccagagccgttgggttagacgagagcggtgggtattggcacagaagtcagagtatatggttataatatagtaggtgatggtggtagtggcatctctagtggcgagagccgcccgaagatgggaagatagcggggaagggacaccttgacactgctgcttgaggctgcattcgattcaccaggttcccaatccctctcaatcgtcttctacgcatatgtttttcgaacggttaaacggtactttttttaaaaaaaattatatacgaaagttactttaaaaaattatatacgaaagttactttaaaaaattaaattaatctatttttttaaaaaagctaatacttaattaatcgtgcgctaatggactgcttcgtttttcgtgcggaggagatggttcccaactcctagtaccgaacacagccaggttaggaaggagttgggagagggagagggagggggaaggacggaggccgacattgtgatcttgccggcgctagcaagtcaagggtgacgaaggcttattgtgaggggtgggaaggagacaaagttaaggttactatagctgcataaatctggacataatttgggtcgttaacagtcactaattctcttctaaaaaaaggggctgctatataacggtatcccgttttcgaacgggatgatcccgagtaggtatcaggtgtgatacctatcaagtatcagacgattctacataacaggatgatccc

SEQ ID NO: 44730 - DNA, 420 bp, Oryza sativa
aattcctgcagcccaatttggcgcaaatttccaaaatttctgagctatctctagttttcgaacagaaatcaaatatgccagctacagggtgcgtctctcatgcagtcacggatatcaggtagaacagtagtactaccaattaatcatatccccaaaatggcgtacatttattctcagtactaacggagctagcaacacaccaactatcgatcctccatgcccgtgtcggcgtgtcccgatcagcaacacaaggagcttttgagcccccaaaaaatggcgagatcggagatccccttttggaaccaaagctcactcttggtcctctgcaaagagacaccgaaacgaacaaacaaaggacatggagggggggtgttttgggtgactcacacggcggcgaagaaggcgagccacttgaggaag

SEQ ID NO: 44731 - DNA, 1501 bp, Oryza sativa
cggtccatctcgaacgggcacggcgcgcccgtcgccgtcgagttgcagtggcgccaggttgggcgcgcggtgatcacgccatggatgtagcgttccaggacgtcgcacagatgcctgcccttgtacagatccctcgcgcggttgccgccgtcgtcgctcgaggtgagcggcctgcacgtcccggcggccgcagcaagctcctcggggcgccggaactcgtactggcggttccaggtgggcccggacacgagcttcaccgtgtcgaagtaggcggcgtccgacatggcgcgcgtgctcctcatctcgccgaccaccgctcgggtcgtcagtgtaagctccttcgggtaacgtagcacgagcagcatgctctcgtcggtggcgaccggcggctggaagccagcacggccggagttcttggcccagccccacggatcggcaccgtcggcgccgcgcgttgggagaacgccggccccgaccatgcacaacaccctctcgccgccgccattgccggacctcgctgcctccgtgtacacgccttcaaacacaatcctgagcttggtgctgccgggcaaaagctcgaacaccggcgaggacacgaccggcacgtggtacccgatctccggtgaagcgctcgtccgggagatcgtgaggacgaggaggccactgacgttgacagcattgcgcgcacggcgctcgtcatcgtcgtcgacatgcgtgaccacgaacgtggcgagacggagcgggtccagcggcggccggcggccatcctccgccgcgtcgccgccgtcgaatggcaccagcggatccgtgccggcgtcctggcgccagtcgcccttctcgaaggatagctcacgcttcacgcgtttgacccggtacgcgttatcggcgagctcggacgccgaggtgagcacggaccggcattgccgcttgacatcggcaaagcgaagatagctgtgctctgcttcctcgcttgggttgaactggtaagcaaaacatgatgatgccatcatgcacgtatacagcaagaactctggaagaaacagcaaatttgtgcccatatcgacggctccggagatcttgttgctgcaacagcaagatgtttttttttggggtttatgagagatgaaaataacaatggataattggacaccttacaaatgaacattgacataatctgctccaaatctttcaccaagaaagattgaagctgtcttatgacttctccaggctgcagcatgttatccttggaaacgagaagagctactgatatgatcttctccgaatctttaagccgagattgaagatagttatgatcaatctctgaccacatgctgcacgatcgtctctagccaatatttaggtggtgtttacatccagggacttaacttaagtcctgatgaatcccctaatgatttttatcaaaatcattaagttaaggtagatacacatcttgtcatatgatcaaatggtttcgccaaaaatcaataatcagacaacaaaa

SEQ ID NO: 44732 - DNA, 1501 bp, Oryza sativa
agcctctctttttcaggcggtgaggaagcagccggatttggggctcaccttccagagttgttgccttgtgatgagcactgatctactccatccaccagtaacctgcatctctctctctctctctcatgtgtacagccataaaagagagaggcagtaacacacaccggcaggtacgccaggacaccaccacctccagtcttgatgaccggatcacgccttcacatttattattgtccgatcaggcgatcatcttcttcttcccttggccaggcggcagctggagttcaaagttcaaaatccaggtttttcagagcacgtcttggccttcacctgacaaagaaagatggctggatcatatggacgttggttaggagtactactttcaagacgtaaaaatttttgggtactggataaaaggaaaagaacagtcgttacctgtgcgcttgtgccgtagattccttcattcttctcgttgttagtacttaattaacctgacctgcgttcacttgggttaaagtaatggtgactttggttcatggcttcattttatcgaggtggtatccgaatcttcatactggatgttgatactctacctgataggtgaaggcttgttttgcaatgcatcctatttcctactactagaaaatttctgggaaaaaaatggttctacaaatgaaccaggtactgtagttgaattcttgtgtcagtgtcacactatacatatgatggatgatcagacagctccaagcataccagacattcttttggagttccaagcataatagagtagtaaaacatactattatgagcagtggctgtgtagaggtgaaaattttgctgttactggtaagattttggtggcaatgcgtaaaacatggttataactgtcactcctagagtagatgacaatctttcagaaagagacagtaaagcattagattaagagaaagcaagtacggatggtaggataaacaaatgggtaatggaggatacgtgcttttgaggcaagccgaacggcattcaaaaaaccaaaaacgccatcttgtcttcgtcttccccacttggaatccttcacttctcccacctaaaaccaagcatcagaatagtacgccattattgagagctccctcgtctctcgtctctccctggtgtccttccccttctctgattcccatagcgacagcaaatgagcaaacacatcacaccccttcctttctcccgagaaatgccttagctcatagcagagttttttttttcttcttcttcttttttcgccattgctgttgtctgcttcgttcttccaaaggatcacgagatgcaggggaggaagatgaagagcgcgagggagatggccagggaggagaagaatcatcatcatcatcatcatcagcagcagcagcagcagcaatcgagctccaaaggccaagcatggcaagcgactgattgagctctgtctctgtctctctgtcaccgatttgctgttctctgatccccaatctgt

SEQ ID NO: 44733 - DNA, 1501 bp, Oryza sativa
cagaggtgattaaaatgagaggtatgagagaaaataaaagagtattagaaattttaagtaaacaatgcaatggaaagtaaacggttgatgtaaatctccgaacaaacgaatacaatacacatttgagttagtttgctatatggttagcagttttccttttttttttgtatatatatttggagacatgtcgcaaatcagagtaaaaaaacacaaagtaaaattaccacaacctaatatgcgctttccaggtgccactggattgcgatgcttgcgatatactccctccgtttcaaaatgtttgacaccgacttttcagtacgtgtttgaccattcgtcttattcgaaaaatttaagtaattatttattcttttcatatcatttgattcattgttaaatatactttcatgtacacatatagttttacatatttcataaatttttttaataagacgaacggtcaaacatgtgctaaaaagtcaacggtgtcaaacattttgaaacggagggagtacatgtttgagcccagatattattattattctttcaaaaaaaatcttggacaacagttgataatgtgattacgaggttcgctgaattggccactagtttggatggcgcaaacaataagtaaaatcatctacatgcacctagcaacaccaaggcacacttgcctacttggttgatcgagaattgcatataccaaaggtctagagttcaactccctccacaagcagcacttttttaccatatatttgttcgttgtctcagcattcataacattgtgttactataggcgtcagtaacatatatgtaggtgtatatttgttcgttgtctcagcattcataatattgtgttactataggcgtcagtaacatatatgtaggtgttactgtatgcagttcatgtgtaacataactcatatgtgttaccaagaagactgtaacacatagctttgtgttgctattgaactttcttgtaacacatgtcataaagtgttacaaaattatgttacaatatgtaggtcctggcgtagtgtaaatgcaaagaagtacaatggagttatagtatagggggttagggtttgcaataaacagcatttaagaaacacttagttgctcaaagctaaatttaaaacacgatcctataactatttaatattattaaacaaggccgtgaacccacacgaacctgccttaacccaaggtctacgatgattcagaccgaactggcaacccgaccctgggccccagctcgtcccaagccaacccaggccagccattccacattttagttattaagcaggttttaagaattgaaaacactaacttgggtacattgctaggcttgcccataaccgagggcgcggttattcgaataggttttactctgatcagaggtgtacatctttacccacaagacacgtcttcctcacgtgcaaccccgtgccacataccaccgcggcatatggacggaagacatgacatagtttccaacccatcc

SEQ ID NO: 44734 - DNA, 404 bp, Oryza sativa
tcccccccccccccccccctatttagtcaaaaaaaaaaaaacttcacttaacagatctgagacaagacaagtgactcattgcagaatcgttgcaattctcacacaaaggtttgcagggaaaaaaaataaaattctaggttttaaggtaagttgattggggttgcaaaattctaggttttaaggtaagttgactcgttttaattttcctttctatgtttggcagcaatggcggctgccaaggtggtcgccaacttgcagattcttggcttgtgtttgctccatctctgcctcgccgcgtccgccgccgcgtactatccggacatgttgctggagacgtcgttcatcccacgcgactacgcccgctacgccgacgagctgtcgccgttcgatcccgtcggcgccgg

SEQ ID NO: 44735 - DNA, 1501 bp, Oryza sativa
aacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcaggacttaagttaagtccctggatgtaaacaccacctaaatattggctagagacgatcgtgcagcatgtggtcagagattgatcataactatcttcaatctcggcttaaagattcggagaagatcatatcagtagctcttctcgtttccaaggataacatgctgcagcctggagaagtcataagacagcttcaatctttcttggtgaaagatttggagcagattatgtcaatgttcatttgtaaggtgtccaattatccattgttattttcatctctcataaaccccaaaaaaaaacatcttgctgttgcagcaacaagatctccggagccgtcgatatgggcacaaatttgctgtttcttccagagttcttgctgtatacgtgc

SEQ ID NO: 44736 - DNA, 239 bp, Oryza sativa
gaacctgtatacatcgtccgtgtctcacgtttcttcctggtacgcgatctttccacacacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaa

SEQ ID NO: 44737 - DNA, 227 bp, Oryza sativa
ctgagttgctgggattttacatttttaatgaccactcattcttggtaatggtatactgatctaaacatgcttcattttcggtgagatttatatcagaattcagaaacatgcgctagctagctgcatggcgctaattttcgggataactagcaaaaccatgtttcatgtttacaagactagtgctgtgctatacatcaatgaaattgaattattgatggattgaaagt

SEQ ID NO: 44738 - DNA, 1501 bp, Oryza sativa
gcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaattttttcgagcatgcggttgtgccgcacacccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcaatgtcgaggcgggcatccggctcttcatgctgatcctcccgagtcggaggcgccgacgagggagtggtagccgaatggcgtgcagcagccgccgctcgccgcgccctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcttccccccgcttgggactttggcgtggaggaggtgggggagtacgagctcgacggcgcgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctgg

SEQ ID NO: 44739 - DNA, 203 bp, Oryza sativa
ccttaacgggcccaccggttattgtcgacccaattgacctttaggtttgatgggccagaatagcttctttggccctcccggggccaaacctgctacggcgaagtcgtccccctttggcatatgctcttcgccttgagtccttcgcccatgaggcctctagcttggctgcgattccctgcctctcgccgtccttgctccatagt

SEQ ID NO: 44740 - DNA, 190 bp, Oryza sativa
acccgcacggcgtcgcgccggctccagcgtgcggcgttgcagggggcacgcgggaagcgcgccgaagcggaggagaggagaggggaagcgggcggcggcggagggccgaggaggcgcggagcaggacgcccgctgcggctggcggtggcggcggcgcggcaggggagaggaggggaggcgagggaagcca

SEQ ID NO: 44741 - DNA, 990 bp, Oryza sativa
acccgcacggcgtcgcgccggctccagcgtgcggcgttgcagggggcacgcgggaagcgcgccgaagcggaggagaggagaggggaagcgggcggcggcggagggccgaggaggcgcggagcaggacgcccgctgcggctggcggtggcggcggcgcggcaggggagaggaggggaggcgagggaagccatggagggagagaggggggaaggggaggaggcgtggggtgcgtttgactgtcagccacccatcatcgccattgatgacgtggcaggaaggagctcctggaagacctacggatggtgtcggtgagtgacgatggaagatgagaaccgtgcgtttgttatcctatggctgcggagaggaaggtacagcccaatcatttagcttattcggggaagaagccaaacaatatatttatacaaacgaaatataatttataaataaaacttttatgtacgtgtttttagtgatgaaaaataaaattcgatgaaaaacccctaaaatcagcttcagattaaatgttgaaaaattaaattttggctaataagtataagcataagttgcgtcaaaatgagaagaaaaatataaaacttacttaaaagtgaaatttaccagaaattacatttgttttcacatattactagaaatatgatatatttacaatacaaatacaccatcgtaaagaaagtgaactgcaagttcgatatacacatttgaaagaaaaaggaaaaaaaatatagatctatttggtcgagtttgacttgaaattttgtacaacggtactttattcaatcataaatatttgatgtttaaaaaatatttactttttaagatgacattttgtattagaatttttttagagtaagtttacaaaatacaataaattttatgatattattataggagttcttatggtgaatctatgtacagtatttttttaaaaaaccaaacatttgagaaacaattgtgattggaattttaagtttg

SEQ ID NO: 44742 - DNA, 1501 bp, Oryza sativa
gggatgaaagttcatatctttttcgctgggaatatttttagatagttgaaaaactactcttgttacatattttttgctgggaatatataaactgtgttcgatctacagcatgtgacttctggatcggtccaactaaagttctgcactgtttttcacggaacatacatccgttcatctcaatgattagaaaatggtccataattgtgcatgagaataaaatcatgccatccacttcttcagtctgtcaccaacagttagttattaatcctgaaaatgcccaagttgatgtgactaaatgtatatgcatgtcgaagaaacggatattcccattgtacatccttttcaagtttctaatgtcccttgcctttcaatctacgagataagcatttctgaattttttttagcagtctacagcagcatgctgctgttcttgctccatgaatctgaatacttccattgttcaactggagagtgcagataacccagaaggccagaactgcaatccacttgctcgacacagtttcttgtcccagcaagctagctctcccctccaccacatcagcaccggaatttttcaactccgagcacacctctctgatcaggtcaggtcagcttcagcttcccctcgtgccattcgtgtgaactactaccaagtccttatctgaccaatagccatggtacggtatctatagtagaagcttagagaaatgccacatttgtcacttgtgcctatctgacccaaccaatcttgccgcgagtctgcaacaaccgcagctcatggcgcgtagtggtggttactggttgctgctaccaacgttcagtttgcagcacgtttttttctctcctgttccaatgatatggtacatcatactacagttcaggaagagtacaattgtacaacgaacctatcatactgtcatgtactcctgtctgtccacgctgacctccagctaacacacatgcatccacacaagttgaggcaggcaagaaacactaaacaacatcgccgtgttttcctcatggaagtgacgctgacatgcgtcgatgcaatattaattatagtgtgtctgcattagacttgtgtcgtgggagatggaagagccgtcaagccaagccacaccttcttaaagacggccaagctatgcgggtagggatcactagaagtgaagtcattgccatcaggcacagccgcacaggcagagctgagagcttaggagcacattggtttcttgcaagtaaccataggccagaagtagacgataagctagctagctaatccaagcctgtgactgtgaaggagtcgagtcgtctttgccaagtcgctgtgccgttgaaagggacaagggtctcctggacagagatctcgcccgttaaatttgcctctcttttgcttctttccctccgatctctatagctgtgcaagtgaaggaagaaaggaacagcctgaattatttctccggttagtccccgtcctgtgtgtgtgctatgcgaaggagcaagt

SEQ ID NO: 44743 - DNA, 1501 bp, Oryza sativa
catccgtacccgaaatgaggatatatggtaggtatctaaaatttgacggagatagataaagatatggtattactgtaatccgatggatgtggattgtttaatttttttacgcggattattcgacaaagtgctatttaagataatctgatatttgtaagggcatatcatcacaccctatgattgaaccatacaccattatagtctattcaaatgactaatctgtctttttaaaactttgagagactctttcgctaggttgagacttgagagtagcttgtttcgttgtttctaagttattgtgtacgtagtaaaaaaattttaaatttgaccaaatttatgaaaaaatatagtaacattttcaatacaaaacaaacataattaaatatatttaacgttagatttaataaaactaatttaatgtttaaatttgctaatttttttttataaatttgattgtaaaaaaattaaaacgtcttatttatacatgtatgaactatccgatctgtttgtaatccgagtccgctatgagtccataccacatcaaggcattatttggataatgtgatagggaaataattttccatccatcaaaagatatctttaaatcctaactattcattctccctcttccatttaatctaacccttcatttatttcccaatcccaatcccaccctccattttccattatccaaacacacctcaagtgtgttcaaacttcaatgtggtcttaactcttatacgattttgctatatatttatcgacaaattttctcccaaaaatttgacagatgtaattacagtacaatcgtagtgtaattacactgtaacttgcatgtaattacactgtaactatagtgtaacttgtatgtaactttcaaaaatctttctgtaatatgttatttcggtaaaatggaggttgtgggaacaaatccttatacatatgtgtgtgccgtgattttttttcttcctcaccaaaacaaatcttgtaatagatataacgattcaaaattacacaagttacactgtagttacatacaagttacagtgtaattacatataagttacagtgtaattatactacgattgtactacaattacatctgtcaaatttttaggagaaaatttgtcgccaaatgtataggtggtcccctcttataactctctggtagtagtagcatgcgtctgtacattgggccacctggtaataatagatggcccatgcacaatagagcagccgtgcgcccgtgcacgtagcccagaccaaatacgttagccgccgcatccctacggcccgcggagtgatttactgcctcggcccaaatacgtcccggcctcttggcccacgcgtccactggcgtgacggaccagcgaaaccacctgggccgcacgcacgcacacgcacgcgcgcactttttcttccgttccgtttcgcccacgcggcgaaacgccgtgcagacaagtcacgctttttctcaccgtcaccgatccctttctcttac

SEQ ID NO: 44744 - DNA, 1501 bp, Oryza sativa
atttgttttggtgaggaagaaaaaaaatcacggcacacacatatgtataaggatttgttcccacaacctccattttaccgaaataacatattacagaaagatttttgaaagttacatacaagttacactatagttacagtgtaattacatgcaagttacagtgtaattacactacgattgtactgtaattacatctgtcaaatttttgggagaaaatttgtcgataaatatatagcaaaatcgtataagagttaagaccacattgaagtttgaacacacttgaggtgtgtttggataatggaaaatggagggtgggattgggattgggaaataaatgaagggttagattaaatggaagagggagaatgaatagttaggatttaaagatatcttttgatggatggaaaattatttccctatcacattatccaaataatgccttgatgtggtatggactcatagcggactcggattacaaacagatcggatagttcatacatgtataaataagacgttttaatttttttacaatcaaatttataaaaaaaaattagcaaatttaaacattaaattagttttattaaatctaacgttaaatatatttaattatgtttgttttgtattgaaaatgttactatattttttcataaatttggtcaaatttaaaatttttttactacgtacacaataacttagaaacaacgaaacaagctactctcaagtctcaacctagcgaaagagtctctcaaagttttaaaaagacagattagtcatttgaatagactataatggtgtatggttcaatcatagggtgtgatgatatgcccttacaaatatcagattatcttaaatagcactttgtcgaataatccgcgtaaaaaaattaaacaatccacatccatcggattacagtaataccatatctttatctatctccgtcaaattttagatacctaccatatatcctcatttcgggtacggatgggatcgaaaagtatccgatttattttcgtcccttatcattgatgaggttgactgctggacctacaccaataatccaactagaaaacgagcagtggccagtggagatgtggaggtacaggcgtaagaatgacgagcaggtgagcgtgcagccgtcaggtggctgcgcactgttcgtttgactattggctagggaatctcttcgactaatctttcttcccgtctcaaacaatcactgacctgaaacaacacacgactagttcagctgaaaacgcagccacgcaagtcgcgcggaataatagaattgatcacactttgttcagagtcaaaattgtcaatcattggacattccagctcgttcatgagctggtcgtgcatcttgaacatcagaacatgcccttaatttacacgtagcttaatcaagtttggagatctcatctgacctgagcatggtgtgattcgtttgtcacactcacaatgcaactccacagcaaaacgatgctcgttgtgttcatcaata

SEQ ID NO: 44745 - DNA, 169 bp, Oryza sativa
gcgatgcaggagagggacccgagccgtcgacgggcccgccgcgggcggaagctgagagaagaagccggcgtcgagcggcggcggcggaagccggcgaggctcgcgccgaggtcggggaggagcagccccgtacacctcgatgccacgaccgccatctcccctcccaaga

SEQ ID NO: 44746 - DNA, 399 bp, Oryza sativa
ttcctgcagccccgtaatattaggatatgtcatattcagtattagattgtttttttatgggacaaagggagtatgtaagaacaagttgatatccaggtgattaaaagagtttcccgtgtttttcttggaaaagggcaaactttttctcgcaggtgaagcgaggctgggctggctcggtggtgagatgggccggcaaatatcgcgatgggcttttgttcggctctgtagcgtcccggttcttccattgcgcgattgcgggcgacgtggcggcgcgtcggccacccacatcatcatcgtctccacctccgggcttttgactcgggtagggagaggttactgactttaactctgctcgagtggttcttcctcctgcggttgccgtgccgtctcgtactctct

SEQ ID NO: 44747 - DNA, 749 bp, Oryza sativa
taaactaatattttcattttagatcggctttgtttcacttaggacaaccaatgcgccggcttctatttgtcaatgaactcccgtagctaactttagattattaccttgttaaggttggtccaaagtgccataaaaaataaatttaattggttcaaaatgaaaacatttgttaaatgacggtcaaaagcaaaacaatgataataaaagatgacccaaagtaaaatttactaggtttgacatcgttgatctacagacatacattggtcttatttaaaatttttgggcaaatatgaaaaaaaatcatatttaaaatacttgtaatgataaaacacataaaaataattactccccgtgtttcatattgtaaatcattttgaccttttctcttagtcaatttttttaagttgaaccaaatttatacaaaaagatagcaacatttttaacacaaaacaaacatattatgaaatgttagttatagtgaaattaatttgatgttgtagatgctacagatttttctatagacataatcaaatttaaaagaagtttgactatggaaaaagtcaaaacgatttataatatggaaaaaggaaatacatataaaataaatggtcaaacttatgttgagagtcaaaccgtcaaatattaaaaagagtactaaagaaggggcttgctcttgaaaacaaagaccgaatgacttcatatgaacagaacagagatttagataaaagagttcagaactctgtcgacaa

SEQ ID NO: 44748 - DNA, 1501 bp, Oryza sativa
gttgcggatgcgccgagtcttcctccgtcccgccttgtctcggagtttcgttgggtcaggaatatagattatcagatcgttaatctttgtgaactccccagctacaccgaagccaaaaatctcgccactccatgtgtgatatattgcttgcttggagaagtattgtgacacatatactgcatcttggatgccacactcagatgccgcggaaatgacatgggtgcatggcctgtggagcagcgtcggctttctacaggagcagtgacatgtgccgtcgtctttgagaacgcactcctgctttactctcttgcggtagatacccctgcctgccttgtcttggcagagtacctcaaacctgtgttgttgggtaccttgcactagagctcggatgtttcatggcctttgcacgccactccgctagttttttctccatgaaagttccaaataaaatgttgttgttcggcatagagggaaaaactgcttggaaccgctccctgaaatacttgcatgtcccatgtaaaatgaactccactataccaactagtgggagtccacggacaccgcgcatcacccagttgtaaacttccgccaaatttgttgtcattataccatatctagcaccacctgtgtcataagtcttagcccatttctcttttggctcattctcaatccactgagaaaattttcgaatttgctccccagttcttctaaccaatgttacactgtctgttgggagagctccgagtgcttgaggagggtcaggtacagcggccgctggtcttgttgcacgctggtcactacatttgcctgtcaactcatctaatctcttccaaagctcattgaattttttctcctggttctgattgcatagcctcttgaacatgttcatcaactccttgttcttaaattgcttgaagaaattagctcccatatgacgcatgcaccacctgctttgtacatcttcccactggccagggtatcctctttccatagtcccaaactttaactcttctatcgctcgaagcataccggcgtgcctgtcatgtattagacacacattgggcctcataccaacaacttctgtcttaaccagatggaggaaccagtaccagctgtcggtgttctcgctctcgacaaaagcaaatgccaacggcaatacctgattgttcccatctaccccaattgccgttagtatctggccccgatacttcccggtcaaaaatgtgccatcaatacaaagaactggacgacagtgcacgaatgccatcttgcatgcatgtagagctaagaacgctctttgcagcacagtcttgccaggatgttcaattgaggggaatgtcttgagtgcacaagaggtcccagggtttctttgttggataacagatagcagacgtggcaaattgtcatatgaggcttcataagttccaaatctcatctctattattttctgtttggccctccacgccttggcatagctaattgtatacttgaaagtctgttc

SEQ ID NO: 44749 - DNA, 1501 bp, Oryza sativa
gtcttcatccctttggagtttggatcctcgcggaggaagacgttgaggagcatgtaggtgaaccgtgaacgcttcgccaaagctgacaggagaaactggggcatcagcaggagcacggcgctgtgcgacgacgatgatgtcagccggtgccacaacggccaagcgggtgatggagagaaagaggccacaaacacgcttggagctggggcttgccaacgtcgtggctatggcggacgagcggaacaccagcggtgttttcccctcgcttggtctgcaactggacggagacgacagaggtgcatgggctggaaaacgatgctaccgtcggatgtaaaacggacgacgatccggcacggacgtccctctgacgtagaaatatttgtacgtccctctgacgtaaaaatagtttaaaacaaactttaaactatttttttcttaaattatttaccaattcacaatccaatttcaccactaaatttgttgcaattaaatctttaaaacaagactacacatggctataattcaatgaaaaaaatatttagctttattaatgaattgtttttaatgttgcacctatatcatttaaatgtttcatgtagtattcatatgatgtttcactttttaatttgtaaatgttgcacatgttgttctaggaatgtttcagcatgtactttataatgttttaataattatagttccaccaagtagtaaaatgaccaatgaagttgtttacatagtttaaatagtttgaggtgtcgatataactggttttgtgggataggaatcagatctgacatatatttgagggagacaaattatactcctccggttgataaagatccagattggtggggaattttttgtatttttagatttttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaggagaaggggaggagaagaaaagaagaggcgaagccctgccagtttcaaacttcgatttcaggtaatattcgtagattatatacgtgactaaatatatgataaatgcattgtatgaaataaagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagata

SEQ ID NO: 44750 - DNA, 1501 bp, Oryza sativa
aggtagttgtaccacaactccacaagttgccctagtatatgcatacgtaaggtcatgataatatatgaatatgcatgcatatgagtagatcatgatttacgggaggcatctcggccgatgtaccggcacatgcatcgcttctctgtcgtctcgttagcagtgtccgtcagctgtgtcaagaggtcatattaattaatatgcatctgaaactttgaggacataatttatcgccatggaaacttttttaatcttttctttcttaaccattttgagtatatctacaccggtacaatctgggctcatacagtataatcagcaatacataaatttccaatccattggttaacatgcatgttttttttttctagttagctagaacaaacccggcaaaagtgaagacaaatgaatttatctttttttcgtaacgtaaggtgatttagtttttctctaagtcaaatttcattaaatttgaccaaatctataactaatatagcaacatttttaatatcggacaaatgaattaattataaaaatatatttaacagtatatcagatgaaattagtttgatgttataggtgtcatgtttttccataaacttggttaaatatgaaatagtttaacttagtgaaaaaaaacccaaaacaccttacattcctaattaaacggagggagtagatgggtagaaaaatacatacgctagctacacggatataaatatattttagatgagatcatgagattatagatgggagctatagttgacaagaaatgacacgtgagcatgatagctcaacgacgacgacggtagtgcaccgcatgcatgtatacgaatatatcactttatattttctatatatgcgataataaatatttgaatcaagtatatactcctccagtttaattataccccggcatgccggccggtcgccgcttgggatgcaccggccggcgatcgtgttggccggcggccggccggtcgccgccttcttgtgctgcatatgatccccacgtatccggccatcagatgaacaactactagcttatatattccttggttttatactatacattattttgattttttaagtcaaatttatttagattaaataagtttttacaaaaatttgatatcatttataacaccaagttaattagccaaattaattagttttatttataacattgaatatattttgataatatgttttttttctgaaaaatagtgtcgctttactttttttaaaactactaagaaaaatcgaaatgactaataatataaaacgaaggaacaagtatatgtttattgtaatcaaatttcaacgacgaccagttgtgcaccgctttagttaattaaagctactatacgtgcgagctactagtataaatatgtatacggatatgcgtctacaatccattcatcccaaagcactcagctacaccggcatagagagagaaaacaccaagctcgatcgatcatggcggccgccgcagctcgcagca

SEQ ID NO: 44751 - DNA, 725 bp, Oryza sativa
agtacatagctcaatattagataacatttttttttccgatgcaggtgtgaccttatggagattcaatactcacccaatctcatgtcgtggccataggcaaccataaccttcgatcgttaagaaaacaaagacggcttgtgtgtggggaagaccctgctacttcacggttgcatgtgaagtggatgcagttcagttgtaaggctagcttaagttattatctatttggttcggtgatcagatcttacaggtgaaaaatgtcaagcacctcttctttccctttctcttgtttgtttggttattgtttctgttggtcaatgtaattccctagtatttttttcactttattattctctaatacttgtatgcttgcatagtcaaagcatgtccgatgtaagattgtttagtttgatgtaatgccagtggacatttctaaaaagatatttttggaaatcacattttcggtagaataacataaataagcaatcgaatggaaataatccagccgattaggaagaacggggccattgtaccacactctgtaggctgtaggcctgtagcctctgttccctaatcccagacaatctcggtcgttgattcccaatctaccggtggagacgccaccactgcacgccgagaaattcaggcgagaagcggaaaagcttatccctctcccatcgccgcggcggcctatccatctctctcccccgcacacgctctccctccca

SEQ ID NO: 44752 - DNA, 325 bp, Oryza sativa
aatattcatggtatacttatggttacagatatgatccgcaagcgcacggatataccatttttttaatccaaagtgaagatatgataagagagtactatgctaataatttatatattacttgcgtacatcaaggtcgatgtaggggttaagtaattcaaaggttaggtgacacacagaagaaagaactatgatactctcactaaatataatccaagctaagtggaggaagaataagaaaataattcattcctatacttctaatatgcaaacatctttagtctacacttgttagtatacagtcatgcaaccaataccccctaacagt

SEQ ID NO: 44753 - DNA, 1501 bp, Oryza sativa
agtgggggactcggctgccagtcggcgtgtggacgctttcggagttaactgggaccgaagccgcgatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcggtcctcagcctccttcgcgatccgctcacggtcctgctgctcacgccgtagccgttcttgttcttgtgcttggtgctcctcctccagtcggcgacgctcttcggtctcccgggcttggcgttgctcctccgtctcattattggccatgaaaacgccaaagtagagaggggtgtagtcgtcatctaggcttccgtcgaagtcgtcgaagtcgtggaagtcgttgtagcgagaactaaattcgtcgtactccacgatgtcggtggggcgcgagtcgacggtgggagggctgtagtggtcatctagctgatccgtcgaaaccgtgccgagtggttggaggataacgccgacttccctgaagctaggcgaaatcggtgttgaagccgacttccgcctaggcctgcgggatgaagacgctgtcgtggtggagacggccgctaaatcgtcggggagcttcatcaggaccggtgggtaagccccatcatcttgatctggtgtcattggagaagatgcaatctcggccgagtggtttgaagccgactcggttgagatggtcttgaagtagctttcagccgcgttcgggaatccaaacgggaccgaaatccggttctctcccgactggtttgattccgagtcgaggagagaaatcttgccgaagttgtcggtgatgaagtcgaggctgccgaaccgaaacgtctgcccgggcgggaagacgaggtcgtcgatgccggagaaaggacccattgcactgatcggcgaaaagcttgacgctacccctacctggcgcgccaactgtcgaaactagatttcggcaataatgaaagggggtggctatcaagttagaaaagtgtatgggtttggagacaaaggatttatacaggttcaggcattcttataaaagaagtaataccctactcctgtccggggatgaatccgccgagtgtattattgattgtgtgattcgggaaaaatcagcatatgcccctagaggcgcccggaccccccttatatatgggaaggagtccgggttacaaaagataatccatattcctaacggaatatgaagataaaggtaaaatacagtcgtaaccgactaagtctcagggtgtttccttgatacacaagttaagaaacaaacccaagatacagacaagatattctatctacattaggtatcctgtacccagttcgaataccatcgccgtgtagatatgggatacccataatctccacaatgag

SEQ ID NO: 44754 - DNA, 1499 bp, Oryza sativa
attcctgcagcccttgtccttctcgaaaatcatgtcgcatcttatataaatgctcaaattatttaagttatgaccacttaaatatcatgatgaacttgatgctagtgaaacacacaatactagctaataaatagtagcttaattagtgcaacaatttatcccatctacagtgacgagtctataacaaaattaccggtgtcccatatacataatattacatgtataataagcataaattggtgtttagaggtaatatgtaatggtgaacaagcttagcaacttgggtcatgcttatcagagaaggccaacgtggttttgcccctgctcatctagttatcatgttaatttagtcaaaactcactcgtccttgaaccttatctactcaagcaatcacaatacacaaggaccatgtgaaataattctttgaaacattaaccccacctttatatataagaatctagaggtctagaacacgttgaactcatgcaattttgtgagctgtcgtatcacttccataatgagattgtaattgaacaaaacatgtttatcctatctaagatgaaatgtttgcaatctagacatcatttttggtgtctccattactaatcacatcaagagtgacaggcattctaaatttcaccaccccaccattccaatttgacatgtgatgatccaaaagaagaattggtcatccctacacgactttacttactagttaaaaatatagttatattttcagtttaaagactccatatttcctgtagtgtctggaataattaaataaaatttaatttcataatttgaataaacaaatactttgagtttctcaaatttcttttctgtttttaaaaataaaggaataaacatacacaagtaatgagtaaagataaaaacaagtagtcacagaagtagcttatcccttttcccttcaaaaaacctcactcactcatgtttctttagcaacactccaaatacatggtagcaaaattccaaacatatatggtagctacatatgtctgtatactattattaaagcctatttacaaagctttgaaaaggtactttatatgtgaattgttgattaacatgtttgtaagacacaaacaaattctgttgaaaaaagtttcttgatccacctcgataaataactatactacaaattaagttttatgaagtgccaaacttttatggtatagccttatcatcataacttctttccacgtatttcttaaagcattggcaaaagatagccttttgaatatatctacaacgtcatcttagtatctaccatgtattcttccaaaatattagttgaacaattgtccaaataaatgtcatgcctcatgatttatagcttatctagcctccattaggtagtttttgcaaaggccaaaatattacttacctcgcacgacttttagtatgtataaatagtgttcctcagcaaccacgataccatcaccctcaacaatatcatagtagcactgtagtgccaacaa

SEQ ID NO: 44755 - DNA, 1501 bp, Oryza sativa
atgggaccaaagaactggagaacttgtccaataatcttagagaatgagtgtcgaaactagatttcggcaataatgaaagggggtggctatcaagctagaaaagtgtatgggtttggagacaaaggatttatacaggttcaggccttcttataaaagaagtaataccctactcctgtccggggatgaatccgccgagtgtattattgattgtgtgattcgggaaaaatcagcatatgcccctagaggcgcccggaccccccttatatatgggaaggagtccgggttacaaaagataatccatattcctaacggaatatgaagataaaggtaaaatacagtcgtaaccgactaagtctcagggtgtttccttgatacacaagttaagaaacaaacccaagatacagacaagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaatataataacacaattgtgcattacatgacaaaagcgtacgcggcgcctaaataggcatgctagccgactgctttttagccacaataaaagaaatccgagtggtttacactctaaaaggttcacgaatgaacatacttgacaggtatccgaataaaaactctaaagattacccatcaagtattatgaagattatggtaataaataagtcgaatagcctaggccttgactatttaccataatgaaaataggtatataacataccaaggaagtgactataataaaaacaagtcattcctagttaacccaaacagcttttgttagcctaaaaaagcttgcaaaaacagcataacgcctttctgtcgggcacctttttaattcgcattgcaataattccaaagaattatatgaccgcataaaaaggatttgatcagcattgggcaacactgttgtgcgcataatattgccaaagcaaaatatgcctaagtccctaaggaacacaatgggccacactgttaaaagtattgggctgaaatactgttcaggcctaggcccattagcacctccgatacccttaactgaaaaatccgatatccaagcgacgcttcgtcttccccgccggaactctcgccattttccccactccttgctacagtgaaaagctgcgccggcgaactagggttcacaactccggccaaatccacctccgaaaagtgcatcaaaatccttcccgtgatccaccgcctcaattcctcacctcttccaagccatccctcgaatcaaatcagcacatttgagaaaaatcga

SEQ ID NO: 44756 - DNA, 1079 bp, Oryza sativa
  unsure (1)..(1079): unsure at all n locations
agttttctcttagtttgtccatctttgtctgtttgcgccgtaaaccgtccgccgccgctgcgagagtgcgacatctctttgtaggtttgtcctgaaaaccttccgttttgcccacgagacgggtagctatctagaaatcggttccactagccgatttagttatcaaattccatctaggtttagctctttgctagatcgaggtggttggcgactctaggattaccgcaaagcttaagatgctgtgatcgtgcttgtcaacttgttaaaaaagttgccaacacgcagcacttgagttttaggccgccagacctggggaaatgatgcccaggagcaggagaaaggaagcctcgaaacaggagctcatcgaagcagcgctcaccggcctcttccatgctagtatcatcttcatctagcccatcatgttggtccttggacactaggccttcgacgagccatcgcctgaccaagcatgtcctgctgacgctttcttcctctnnnnnnnnnnnnnnnnnnnncaggcagctcttgtagtgcacggacagcttgctgtagcagaaaagcatcactttcttggccacatccgctcattgtggagattatgggtatcccatatctacacggcgatggtattcgaactgggtacaggatacctaatgtagatagaatatcttgtctgtatcttgggtttgtttcttaacttgtgtatcaaggaaacaccctgagacttagtcggttacgactgtattttacctttatcttcatattccgttaggaatatggattatcttttgtaacccggactccttcccatatataaggggggtccgggcgcctctaggggcatatgctgatttttcccgaatcacacaatcaataatacactcggcggattcatccccggacaggagtagggtattacttcttttataagaatgcctgaacctgtataaatcctttgtctccaaacccatacacttttctaacttgatagccaccccctttcattattgccgaaatctagtttcgacagttggcgcgccaggtaggggtagcgtcaagcttttcgccgatcagtgcaa

SEQ ID NO: 44757 - DNA, 507 bp, Oryza sativa
caatcaaccaaacagctgcatgtgtatctcctcaaccaggctatactcagcctggataagagagatggaccaggctagagggatgcgagcaaccaaacacacccttaagtttagcattatatacatgtaaactttttaatagacaagatgaacagatagaaaatgcaattaaaaaacaggaaaaaaacaatcattagtttcaaaaggtgtgcgcattgcacagcatcgatgcacagcatgtactcatgaatagacgaaaaaaatgaaaagaaaaaaaaaagaaaagagaaagaaagagcgccgtgttgatgagctttctccgcccacatcgccgacatccacagtgccgcgccgccgtccccaacacctgcagctcagctcacttgcagcgtcgcccctggctcgcttgcgctgccgctcaccatggagcttgctgcgcgcactccccgcggtcctagcatccaaatctggtggccgctcgtcgttcgcggcctcacccccaaacca

SEQ ID NO: 44758 - DNA, 1501 bp, Oryza sativa
tacatccgtcatctgacaaaaatgaagctctggccaatcaagcgcgagcacaaggactaaagggcccatctgactaatcaagcgcgagcacaagaactaaagggcccacctgactgtcaaaaccgatttgagatagggccaaaccatctttaaccgtcataagagtccacgtatcagtaactgtccaaaatcggtggccagaaggcggaggcctagttcggctgaacaagccgtggtgcccctggctacccctttcaatgtggcagctccccattggattgactatggctgttatgtgtgcaccaacctcactaatcaccattacaaccatcatttggcactatgaaaggaggagctcaacacacttcacaacacacaacaaagtaaagtttttttttacttagtttacttgagtgataaatattctcatcgatgcgggttcgttgcttagttgcaactgctctagtactaggactctataaagaaggaagtttctgtggaaggttagagattgtgtgctccacgcaaagtgaggtgggtagcaggtggtgacagccctgcccgtactttgcatccctccacgttcgggcatatcatatagctcaaggccagactcaacctaacagattaagggatagccggtgcgaaacatacgatagagttctatctttaacttaagtcaactagtgaagtccatatgaatcctctcttgccaatcttatcatcaattgttgtccttgggggaattctgtttgtagatagtacacacacgtctttatttttgatacccttaaaatactctaagagaaaatgctacatcattatttgtgcgcttacggatttatcagtatgcgtagcaaataccaacagccaccaccatagagtatagatgagaaaagtattactctattgtttgtctatttctagaagagtatagatgagaaaagtattactctattgttgtggatatatatatatataatgtgattcagttaggaaaatttacaaatagctgttgaccatttccatctacaacgatgtaaggcccaatgttttttttttataattcctgtttcatctaacacgtacaaatgtcggtcttatgagcgagatctttaatttttagcattttctttgggttccctgtgccttcaagagaataggttcgtttgtctcttccattcctgacgtggcaagccttcgttggctggaagtaggatcttcacagcgccagccccacaaatgaaagagcccaccaccacacgccggggaaggagtggcacctgggcgtgccacgtcgacgtccagctcagcatcaccatagccccaagccaccaatgggaggccacgccttatccaatcctcttatcctcctctgccccccttgctctgcgatagataacactgtcccgccctcacaaaacgcccttcacgatacaacccacacggacacggccacaccacccaccaactgagagctgagcaggcgagcgagcggaca

SEQ ID NO: 44759 - DNA, 714 bp, Oryza sativa
aaatataaatattttttcatcataatataatcatgtaagatcttgttgtgaagatttaattgtaatgaacataatggtataatcggattatagatcggataagtaatttgagagaaaactttatttgaagaggaaaaagacatacatatctattaaaaaaaaggcagcaggcactacgttgatccttctcattgagccattagagcgcgaccacgcggatgtacgtcaggacgacaggcatgatcgaacggctgtgaggcgtgtcgcgtgatacgactaaagcgggaaggatggagcctacattggggtagagccgtttcttgacctcttcctcttttactatgagttacgctggatggaacctaaaaaggtgtccgggtgtgttggtttccgacttcgggatggcctgaagtcgcgacacatccccttccagttcccctcatctcgcagcaaatggcgggggaggtggttctatcttcagatagaggattcggatccggtcttcgttgttcctgaggagcaaccagacaagattccacttgggccaccaaacccgccttgaccctatccctccaatctttcatcgatatcgttgacgacctccgagaacgggggttgtcggggtatgaagtcgctgccgacttcatcggtaggcggatccagccacttcaggctcgagcccatccagcctttgattattctgagccagaggac

SEQ ID NO: 44760 - DNA, 1501 bp, Oryza sativa
ctgtggcagcaattcgtcaccaacttccaaggaacttacaagcgccacgcgatcgaagacgacctacatgcgttgacatagaacccgggtgaatccttgagggattatgttcgacactttaatgagtgcagaaatacaatccccgaaatcaccgacgcttctgtaattcgcgctttcaagtccggtgtcagagattgctatactactcaggagttggcaatgaggcacgtcacgactacttggagattattcgaaattgtcgatcgatgcgctcatgctgacgacgcactgagacgcaagaacgacaaaccgaagaccagaggagagaagaaaccagccaaggacgcacctgagtcaagtaagaagaaaaatcgcaagagtgggaaaaggaaggctcaagcggaagttctcgcaacagaatacgtggaccctcccaagcgcccagacccacaaggcagcgacgcgaagaaaatatggtgccctatacacaagtcagatagacactctctagaagattgcctcgtcttcaaaaagtcgctcgcaaaacacatggcattggaaaaaggcaagcgagtacgtgtggtcgagaaggacgctgaggcggttactcaggaatcagactcagcatatccagactccgatcagcatatccagactccgatctccatgtttcgcacatcttcggaggttccacggcatactcctcaaagcgagaatacaagaaggtggaacgtgaagtctgttcgatgtggcaggaggctgcgcccaagatgaagtggtccgaacagaagatagtattctcagaagaggaccaccccaagactgctatcatcccagggcgatatctgatcgtggtagaacccactattcggaatatcaaggtcgcacgagttctgatcgacggcggcagctcaatcaaccttctcttcgccagtgccttggacgcgatggggatcccacgaagcaagttgacacccaccgatcaacccttccatggaatcactcctcagtcatcgtccaaaccattgggcaaaattacgttgcctgtgactttcggccaagcaaataacttccgaacggaacagatcacctttgatgtcgctgaattcgatacagcatacaatgccatcattgggagaattgcacttgcgaagttcatggccgcatctcactacacgtatcaagtgctcaagatgccaggaccgaagggaacaatcactattctagggaatactaagctggcaatacaatgcgacaagcggagccttgacatggtcgagcacacgcccagcccacccgccacagctgagccacccaagaaagtgagcaaaacaaacaagacgccgaaaccggacggcgcaatcaagatcgttccactctccagtgccaaccccgacaagaccgtcaagatcggggcatcactaggcgagaaataggaactcgcgcttatcaccttcctccgcgacaaatgctgacgtgttcgcttggcagccgtccgaca

SEQ ID NO: 44761 - DNA, 1501 bp, Oryza sativa
taggagattttcaccgtttcaggatttttcggttaatcctcacaagaaagagatcggacaagatcgaggggattaagtccacgtcttttctcttaattcttttcaagtttcttaggggattaactgaacaaggtttcaaggtttcggtggagctggacccatgataatcacagaaaaaaagtcaccgtcaatgcttagacatgcatggcagataaaatatacggagtatatatcagcacggtattattggacaataagaaactggttacccgattgtagcgttgaaaatgcatagtacatatacagacagatccacaaggttcatgcaagatattcccaggtacacctgatgatggatacatatgcgctgtgttggcaccagataaaattcccgcaagaaagaaaatatctcaaagatagctttgttcatgaagttgtgttgagctcacagttcgccagctgtgatccgtggcactagaaaatctgcaatactagaatacaaaatgaatcatgaccacaataaacttcaagttgtaatagcacgagccgactaaatctgaacccatgggacaagagatctgacaattttcttaattagagggatacatatgtgttccttttttgggctatttcaccggattattttacttcacaactctaaaaaggtaaaaagtgtgttttcttaaaaaattgtattatttatgagcaactctaacagagtggtcaaatgactctccaagccaaattatatccaacataggcaaaaaatgccatctggttatgcaacgaggtcagcttgctcccagttgggctagccagttgatgtatgtgacatagatagcctagcgaaggtggtatttgcctgggagtagtgggccaccggagccagcccaagaagaccagccgaggggcgctaggccggttgcttggctagccaagggttaaaacaaaggaataagttcatctaaggtcccttaacttgtcaacaaatccgattttcgtccttcaaccgcaaaaccagatataacaggtacctcaactatcaaaaccggtgcagattaggtccctcggcggtttagatggcggttttgcctgatgtggcgcctatgtggctaatttgactcggtctcgatctgacgtggtaccgatgtggcgtttacgtggcaattcaatcaaaaataataataaaccttgtgggacccacatgtcagttttacaaagaaattaataaaaaatggtggggcccacgcgggccccacatgtcattctcaacccccttcttcctctctccccatcccctctcatcaactctctctcccctctcctctctcgcgacggaggcatggctctggcgactgcgggggccggtgaagaggagttgggcgtcggtgctcatgccaccgtcctcctccattgacctcgccgaaccggcgacctctcgcccaatccgccgccatgcctccggtggtgacccactagccctgctcgctcccatccccca

SEQ ID NO: 44762 - DNA, 1501 bp, Oryza sativa
tgctagatgatggatggttgctaatgcacatcgccaagctcatctctataccacgccgctacatccttctatgattttatcgctgactgtcgctcgccacccggttgccctctccaccatctgtcataagacacagatcaacctctacatccttatcacaagatctagcaaagccatcaggaccccaacttcatgatggtttttttttgctagaccattttgttcttttctagtttgattcacctgtgagtaattttatcactcgtgtgtgattgagcctgtaaattttttacttatttgttcattttgttattcatattaacaatactcttactatcagtttttactcctatattattactacatggtggctactagaccataggctaaattaagaggaaggtggtaattattttacgtgcagactataaagtctaaatatttatagagataatcccttttatgccattgaaaatctgtctgatcccttatatgccactgaaaattggctcttcccttatatgcaattggtccgaatttgcgcactctctcatgccactcccgtcggttgaccgtgtgttgaccgttaactcttaagtaaaaaagacatatttgccctctctgagttgttagccatgcccggcctatactcagtggcatataagggattctctcttatttataacactggtaaaagaattactagcgttgtaagctggtagtattttttttatgaccatctaggaatagtgccgaacgatgcgggggcattcatgcaagtaaatttgttacttttgaagggggcatttatgtgagtaaatttgttacttttgaaggtgcagaggtgggatactgggaataaatggaaaactcagtagagtaaattgttagatttaattgggtaattgatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttccaaagctgttgctgctacggtaatcccatcccga

SEQ ID NO: 44763 - DNA, 981 bp, Oryza sativa
caagaattgcaatattacttatatatgtgatacgaaagtatatatagttgagaataaagacttttggatatgaattttataaatttaattttatgtaaaaaatagaaaggcaaaacaaaaagaaagaaacacattagccaatggctatctctcgatcggcatggatgatgggactgggcgattggatgtctcgcgctagaaagtgatccgcccctgcgcgccacaaggttgcctctttcggaaccagctgaccatacccttcccatagtttgactttttaagattttatcatagttaactagaaagtgtcttttcgctacggtgtattaaaactaaaaatattttatttttaaccgaagttactttcacactgctttggtacttttgctcgttagaaaaagtctcaaatgatagagagtaatatagtagctaataataaattattattcaatagtgcgttgcaacatgaaaaactaatgttattaacttagtaaagtaacagaaaaagaagcatccacgttatctcttatggtctagatttctcatattagttggagtaaaatataaaaaatgaggagaactcattgtagacaatgtgatgaggacacaaactagcttggatataaccatgattaacttatgtattaattaatcaaaggtgcatatgttctatattagatttacttgttatatatttgaacaagcgttgctacataatgtgtttcgtgtgttttcgtttgcagaggtacttgcttgggtgaaagaaaagagaccgagcgtaatgaatgcatggatgattaaagaagttgattggggaccaaaccaagattttctcaagtccacttccatctcaccacatcacttttggtccatagaagacaagagataaagttctacacgttttggattcggattcgggcctcctgacagcatcaacttcaaacggacctagtctctgatctagaaggaatttcggggcca

SEQ ID NO: 44764 - DNA, 482 bp, Oryza sativa
taccaaatgttatcaatttatattacagcaaggacatatttctagctactgacctttactagtgctgttccaagataaacaacagccgcttttacacaagtgccaattgtgtcatactctgacctgcagaaaatgactgggcataagaaagcgaagaacaaaaatcctttgatatacaacattatttttatctatagattgatagacatctaactagtaaccactacccactaataagattcttaaaaacaaagccctccattcatcaatgatcgtctgcaaccctccatcaaaagtaaaaggccaagatctatgtgaccatccaaaaactctctgtcattagaacatacacagcagctctgtttccaactcttatcttcacaaacctccgccacttattatccattatgccagaagtacactgttaccacttatcaccaatacattttgaaacaaccacaacattgatcaaatagggatat

SEQ ID NO: 44765 - DNA, 478 bp, Oryza sativa
atgtaagtcgtgacttatgtaacacgctcttaaaattggacaaattatatatatgcttataatcaaaatactacttcacccatctaaaagaatattgttagaatacaaatttagtttaacatagtgccgagccaatatggtatatctttatcatcagaatttgtttccacgcaattctcaataaagcaccaatgcaccattgatcaaacacctttatatctacagcatcatctcgccacgttcttccaaaatattggttgaacaaatgtccaaatacacctcatgactcattgtttctagcttacttgacctccaccaggtagttttgcaaaaatcaaatcctttttggcgtgtaatattgctattacctataaataatcccctagagcaattgttatctcatcaccctcaacatataatcttctacatttacaccatctagtaatcttgttaagcatctcccatacgctgtcaacaa

SEQ ID NO: 44766 - DNA, 977 bp, Oryza sativa
  unsure (1)..(977): unsure at all n locations
ccgacctcgcacgcctccgccgagcccgcgcgccgccgctagcccgcacgccgccgccgagcccgtgctccgccgccgccagcctgcccgccgccggttgccgccgaatcttgccggagaagatgggagaggagagagaggatgggaggaggaggaggagtttaggggtagttcaatggcatttctgtgtaaatacatcaaaatttaaaagggtagtgggtcttttgaagtggagtggagctgtggagcagcaaaaacccagctccatccccgtagtacaaatttgtggagctgctctgccaactccgctccaaaaaacaaagaatttgtaccgtttggcacagctccanctctaggtaagtaggagttgggagctggagctgtgccaaacggggcctacgttcatgaagagttccatcatgtaataggagcatgtgcctttaaggtgtaaataaaccagctcacgaatgtatttagtgtcaatgtgtcatgacctggtcaccagatcttgtgaagtctcaagaacagtaacctacccaactcacccttgaacagctacagtatcaaggggagacagaagtgctgaaaaatatgaatgcatttgtcatctgagtatgctgtcattaatgctaaccggtttctcgacgcagaaaaaacagtacagtacttggttttcaagcaagctgcaccaatgaacatctcatccccaaatattttactgtacataagcagttactgtactccaaagtaaaaaaaaccgtgtcagaaggaagatttgacgcagaaaaccatacgctttgatgacagaaagcctccaaacccatcacaattaccaacacaaacacacgtcgctttgctttaaagtgaccaaaccgccagcataatctactcctgcctgcgactgcgagaagaacacggcgtatctcacacacgcacaccggccgcgaatcctgggcttgcttcgcttctcccgtagc

SEQ ID NO: 44767 - DNA, 1501 bp, Oryza sativa
tttgaccttgcaataaagaacacaacaacacccgggctcgctggccaagaccaagagagcagaagcagagaccttgggttttggagagacccaaaaaaatgagatggacggacggatggataccgatggatttgatagaaagaaagagctgtctctgcagtgcacacacacatgcatcttttgggatctcaagaagatccatgcatgcaatgcaacgatgcagcaaatgagatgcatttgcatgtgccagtggcaagcaagcaaaggggcaaagcatagtctactccatctccatgtgacatttgacattggaaatcaagattccaagctccatcacacacgccctgtgactacgagcatgtctgtctggactgccagtcttgttcttgtcggtaaagcaaaaatgaatcttttttttcaacactctcaatcttgctgtttgcacagtgatttaacttaatcactgatgagagtagtagaagtactagtagtactccctccgtctactaatataagggattttgacattttgcttgtactgtttgagcattcgtcttatttcaaaaaaaattggaattattatttatttttttgacttactttattattcaaagtattttaagcacaacttttcgttttttatatttgcacaaattttttgagtaaaacgagtggtcaaacagtgtaagtaaattgttaaaatttcttatattatagaacggagggagtatcaaaatctcttatattatgggatagagggagtactatagtgggaatagggtgaacagtaatgtaacatgaaaatgcttactcaggattttggtgcagggtgagatgtgattaatactttaatcatcatgtgatgcagtggccaatcatggatggattgacttggacatgccatgtggtggcttgtgaaaagatggcaggagcaccaatccatcaattcacaacccaaggaagagcaagaggagcagtgagtgatgtacactctgcaatagctgaccctggagaagctgggccttcttccatggtggcagccattgccggatggggagcaaagcaatgctggttttgtcctcgtgtacattagggatgggcagtttgtaataacgtgatggtactgtgtccaaagctgcagattggccatggtattggcatggcatggcatggcattgtgtgtgcctaatttaagaagcgcatggaaatcaaaccaaaatttggcacggttcaattgttcaaaacttgtctgccgtctggatgtcatataaaacagggcacaccagtattttcattcaagtggtaggcaacaagaacatggcatgtaaagggagttagtagagcgttctctattttatatatatggccggacacaatgagatgatctcgtggccatctgttatagtactaaccatttgttagatactctgcgagatgaaagttattggttctcatgtgtagcaatcataagacattctgcacactattcctctttgcatta

SEQ ID NO: 44768 - DNA, 1501 bp, Oryza sativa
tggcccacttaatctggggtgcccacatccgagagccgaggtccggagtatgaaactccgaaccccctacgccgtctgttgaattgcttgatgcccgtctgatcctacctacgcttatactccctccgtccaaaaaaaaaagacaaaccctgatttccgtgtccaacgtttgaccgttcgtcttatttaaaaaaattatgaaaaaaattaaaaagataagtcacacataaagtattaatcatattttatcatctaacaacaatgaaaatactaattataaaaaattttcatataagacggacagtaaaatgttagcacgcaaacctacgtttttttttttaaagacagagtgagtaattatcaatcaacaaattaagcatgtactcgtatgatgattgatgcgtgtgcccgtgcagaatgatagccgcgccggcgacggcgatgcgtgcgtgtctggctgaagcaagcaagcggtgagcaatggctggaattaattaagcctggaacatggcggccatgtgatgtgactgtctatttctgttaatttctgcaactgatggaacgtaactcaccagcaatttgtctttgtcaacttatattaaactctactaactccaggaagctgccacaagaaccaaacaaaaggaaaagtaagcaaaacagtaagcacttcctctgtctcaaattataaaattataaggtctatatttttctagcacggcctttaatgacatactttaaccattattttattttatgttatgttttcaacaaatattaaattactataacataaaagtactttgaaatattaatatagtgatataacccgtataatacttagtatatatgattatcagttaaaagttatcgagtttgatttttctttaaaagagggagtactccttagttataagttatgaagtatactaataagcagtccgtcctgttggtgcttaatttgcttggtgataaactggtaataatatgcacagtttcagcactagagtatctgaatgtttgtcatagacagagaacaacaagatcatatgaccaaaacggagtgcttcagtgcaacagcaggtgactgtcaataccaatgaaattcagcaaacgagacaaagacaacatatattctctggacagttatatctttgcttcttaaattccagatttccactctaattaacaaaaataaaactacaaaatatgcatgtctttgctgctgagtttattataagttgacaacaactgaacagaggacaacaggatcatcagatgatcaaaatggagtgtttcactgaatgcgcagcagcaggtgactgttaataccaatgagactcagcaaacgagacaagacaaaaattctctggacagttacatatttgcttcttgaattccaggcttacacttcaacaagaacaagattaaagaatgtgtagggataacatgatgagttccagcactagacttgctgatctgttatgatagacaagaagta

SEQ ID NO: 44769 - DNA, 889 bp, Oryza sativa
atatatatatatatatatatatatatatatatatatatatatatatatatatatatatatatatatatatatatatatatatgttactttgcatttatcctaatacatctttttgtatctttcataaaagacgtgttgtcggagtcgaccgtcaagccggagtggaagagctagccctagaaggaattggagcaggcaagtgacgtaataatataaatgattgttatatttgtaatgcaattaattaagattattagacctgtaattagacttatcatataagattgtgtagtggtctaatattatttgagttttaatataagattattttattgcaaattagacttagtatgacattattaactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgaattttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 44770 - DNA, 704 bp, Oryza sativa
taggataaggtagcggcgagacgagccgtttaaataggtgtcaagtgaaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggg

SEQ ID NO: 44771 - DNA, 1501 bp, Oryza sativa
ggacaaattcttgcagctggctgcagtttgacagtgaagtggaaattcccagcccttggtgttatctgcctcaagttgatttcctaccaaatacaaatactgaagatattgcaacctccccaagttgggaggcacaaatccggtgaatttgttgtctgagaggtacagatccgtgagtgttgaaagattggagagagaatgagggatgactcctgtaaaccggttaacatccaatccaaacacttgtataccgggaagcatgcgaccaatgtcagaagggatgctgccatgcagcatgttattgccaacctggagcatcatcagcgacgacaaattgtacagagatagcggaagttcgccggaaaggttgtttgcattgagaaaaagataacgcagacctgcgatatcgccgaggcctggagggatgagaccctcaagcttgttgtaactcagagacaagtgctgcaacgacgaaaggttggctagcgaggccgggatcttccctgttaagctgttcttcctgagctgaagcttcttgagccgtggcagcgtgttaccgagctccggaggaattcgcccgccaagctgcgggttggactggatccgcaggattgtcaagctgatgcaggagctcagattagcagggatcacacctgagatggagttgtggtccatatcgaggaccaggagacgccggagccggccgacggccggaggtatctcgccgtgcagctggttggagctcaggttgagccgccgtaggaaggtgaggttcccgacggccggcgggagcgtgccggtgaggttgctcgacggcaggtccagcgccgccaccctcgtcggccaccggtggctgcatgtcacgccctcccagccgcagaagctggcgctggtgttccatgaggcgagcgcgcttgagctgctcccgctgagccctgccttgagagcaagcagcgccggctcatcgcttgccgtgccggtgccgatcgtcatcaggacgcagaggagggacaatgcaagcctcatccgacgtatcgccatgtggattcttggttcggtttgagggagcgttcttggagcagagtttagttaacacgactagctattttagttaaatggagatactagcatatctctgtttcctgctgatcaccagtaccagtacatttttctttttcttcttttggaagatttcacctgactttgttgacctggttgggactggttctcagttgcactagggcccgcccggtttagttctcaaaataaaaattttaactctgtcactttgaacattcggataaatatatgaagtattaaatataaaaaaaatactaattatatagattatgtgtaaattatgagacgaatcttttaagtctaattacagtaaatatttgcttgttaatgataaattaattatgtttaataaatttatctcatagcttactatcggattttgtaataagtatttttatcagtgccggacatttgctaatgc

SEQ ID NO: 44772 - DNA, 338 bp, Oryza sativa
ctatagcatttgaaacaatcatcaattattttcggccaatgaaactccactctcctaagcaaccaatttatcttacggccgattgatgaatttcacgaatcccttcatgtactactctcctagcaacttagattgaacattatctaagtaatactccatctatttttcggcgatataatatttgaacacttgccaccgaatctttcgatcaaccataaatgtaggatctttcaaatatctaatctaaggaattctccaagctatttctaactcatgggcacaaatgtccgaattcacaattaattcggccttttaatcaattgtaacgtgcccctagc

SEQ ID NO: 44773 - DNA, 302 bp, Oryza sativa
ttcaatattcgcgtcttatgttctttttttttttaagaatacacacacattgagacatgagtactatatatataaatatgtaggcaccggataggcggtaaaaaactactactcgtacgtagatgttacatattgcgaagcttttccttcacttcattgcgcatagacgacagaatgaagagggcaatacaatatgctgaaacagcacccgttatcaccgtcctgttgaagcttatccgttcttcatatcgtttaaccaattcatcaaaattctgaggtggatcgtattcaaaataattgcc

SEQ ID NO: 44774 - DNA, 1501 bp, Oryza sativa
acaatggagcatatcggccgatttattgatcaatgtggtaaggccggtagcgatgatttgcttaagttgaagttgtttcccctttctttgtcaaactttgcatctacatggtatagtttgcttgctcctaattcaatttctacatggtcataaatggagcatgagtttcatgattatttcaaagatgcaagcttgatggagaaagaccgattgatacttcatcggtcacttgtgaaacgatttcggttacacctatgcttaagaccggaattgttagtgatcctctccctattagtcctactgatgttgacaaaaagaaagggaaaagtgttgttattggggatcttcggcccaagaataggatcaataatgcaaaggccgaatatcgtaaggttacaaaagatgagtcatttagttcccaaaagaccaaaaagccgaagctcgcttttgagatgcttatggctaagtacaagaaaggattagccggtcaacgatttgataaccaaactagtgattcaaaaagaccaagatcatctcgtaggaagagatttggtcaaacaccaaagcaatcagagccatcaactataccaactccatacaaacctccggttgtgatgccatggtatccatatccaatgtcactatatggttatccctttatgtattacatgtcgtggatgcctcaaccatctatgccgtgtcatcaggaatggaagcaatcacctaggtcagtaccaagtcattctaacccaagacaagaccgttttccacaaaagaatcggtccggtggatcaaaggtgaaagaggtaaagaaggtgtgggtgaggaaagaagccaaagctccggaggtcgttatcaataaggagtctcaagttgttcatgtacctactggagatgtggtggaaaccatacaagcaaaggggatcgaagccgacaccgtgattgtcaaaagtggaggtttgatcgaggcatctagctggtctgaccgccaacctgtggccggtctgttcgaacctcttggccggtttgaccgacggcttgtggccggtttgaccgggcccagaggtcggtctgactggggggcattggagaagagtgggaaaattgagagcaacataggagcttccactccgaccaaaaatatgaagaatcattgcttagctcctgaaaaacaaccacagccaaagtggataccttttggcttatctcgctctcaaaagaggaggctacaacgtcttcgagccataggtcaaaaagaaaaggaggccgaagctgtagagaacaaaacatgtaataatttagagcctcgaacgactcctaagagagtgtggagacctaaagaagtaaaagttaagagaccggtgatttcccatagtagagataaatccaatttgatgagagaagaatcatcgatcattagagataagtctccttcgcatggtgctatgaatgttggtgcggtgtttgtcttgccttcgaaatcgtgcagtcaagaaagccg

SEQ ID NO: 44775 - DNA, 1501 bp, Oryza sativa
tactggttctccagacgcctatgcaagatgcaggctaaaaacgagaacaaccgagaggtttctcctatagggtccctagcataaacgcttatctagagcaaacaaacagggaaacttaaagaaaattacttcatattaagcaaataggcttacatacggttttccctttcgggaaccccgaaggtagatacaaacaagtttttctcactttacaaacctttatattacaactccttgcttcaatatatattatgcaaggtaggctagaggaactactactaagaaagatggaatggagggtgagagcgcgcttggaagctttgctctgaatggtgtcttcgtggttgtgtgtccccggagtgaaggccaacgtctccttttatagaggccagggatggcgtcgcctgtgcctcctgcttatctcttcgctactgtatcttcatgagagctggctaaagttgaggcctttccaccgaaagttttattcttcacagggatatgtcattcaccgcaccctatattgtccccttatactttatagggtgtccttctggattctttcttgggtagtcttctgaatttcttttattctttctgaatttcttttattcttttattcttcttccacgcccaaattgttgatattctattatcaatatatattgaaaaacatatttagcttatatcaatttattcatctggttgcccatggtcaccaagatccattgtgtccaaatcagaaaaagaaacttctaatttctcatctactgccttttttatttgctcaaatttctgatccatttcttgttttaattctttaagtatttcttccttcaattccttctttaattgtggggaggcttcttcaaatttttctattatcttccaatcaatatattccccatctaatggatccactccttttgttaagcattccttgtatgtgggttttttaaaaaacccttcttcttttatagtcatcttaatgggtatttctgaagtcttctttcctttagcttttttgcatttttgaatatattcttttgcagcaggctctagataataatttattcctaatatttttctagcttggcttaatgcttcatcaatatccttatatttctggtaatgccttaatattatagttaatttttaggttctctagttctacttctagtttatttattctgttttgtaaaactcgtactctactagataatatcctttcatctgattctaattctatctcttttctccatttttgtttatttgcttttatacattcagcacaagcttgttttaagcatatactacaggttactctattatcttggcttgggtaatagatgcaaaaagcacatttaatgttataatctccttttcctctaatccaatcatgttcacaatttaactgatccatcatttctatttttaaaccggctagttcgtcaattaaatctaactcttcatcggttgattcatacccttcatatatatatat

SEQ ID NO: 44776 - DNA, 1501 bp, Oryza sativa
tctggagtgagccgttcaacgcattaaaaacgttgttcaatatatgatcattttacatatttatgtttgcacatttatcaaaacatttaatattccacaatttttacatggtgtattcaaactgtacgttgtgcataaaatatttgttcacctcagatttcaaatctcattcatctcatgtttgattgattggacatgaactttcatctcaggcccaaactattatcatattgggtattatatatccaaccaaacattcacagcatgaactcaaacaatttgaaatatttcaccagatgttcatgcacatcaaccaaacattggcacattgcttataaatggaaaaaaaacatgacaaaaaaaattgaaaaatctgagatgcaccaagacacaaacatgaacgggaatctaggggcagaaatcagaagggagggaagatgattacaaaaatgtcggcgacatttcactactacagagaactcatcttttaccaaatgtcctaagccataaatattctggatgtattaaaaaccggtacagatctctttagtaccagttctaaaagccccgagtcccctaaatatctttagtccagatttatgttatcatccggtactaaatatgcctatagagttagttcaaaaggaaagcatatctactcaagtcggatatgtagagtaggtgggatggtaacgcgcgtgagggctaagatgaaagatcttgagtttaaatcccacatcccatattttttttttgacttggtatgcattttagtatcggttctttcaaccgatactcttgatttgttggttcctgttgctatagccaaaattaaagggggtttatagaaatatacgtctctttgcaaaaaaaataaaataaataaactactctgggcacatgaattaatcaaggataaatagaatagatcaagaaagtacagatcaaatgtcatgttaacatgttggtattaaatgttatatatgttaacttgttttcatccaactcatttggactggttatgtttgtgcaattgtgttgttttaacatatgcagtgactgttcatgaagttgatagctagtcgtctcaacttctagattacctgccctcagtagattccatctccccgctggttcaagttttttttttctttctaggactagcgttctagcgtgttcgataaaaccgtatgcttttcccctttaattgatcttggaatatttgcacacacggggccattggcagtggattgatcttgaagcttgttgccatgaatctgtttggttaagctgtagtgtgaacattattcaccaaaaagaataagaaaagaagctgttgtgctacacagtagaacaacatatatatgtgtgtgtgtgtgaccaatatattcattgacataccaacactcccacatactccaagcaagagagcaagcttgcttccaacctagagaggtagctagctagacatatatgtagagaaatatatcatcataagtta

SEQ ID NO: 44777 - DNA, 1501 bp, Oryza sativa
ctactggtcagcaacaggccttgccaaatgaaattctcgacccaggtaaacttgagctcatcagctgtgtaccttgcgaatcgacaacgtaacagcttgaacaatgcaaatgaaagacaaacatctttcagctgtttgtgtcctgcaggtgtccagcttgtcagagaataattcgtgtactcgtcatccatttgctgccaaacttcatctaagttcaccaagccagcagctcctctctgctgtagattattatcaactacactagtgtaactattgggccctttttgtacattaacagtgtcctctcccataactaaaagtggcggaggaggcacatcatcgccagttacatgcattactgatggtaggacgacgtccttctccttctccttcatgtatccaagcacaagccgaggattccgtccaagagcaaacgattgtcgggccatgaaaaatgcaaccaacttgaaaaccaatttgacaaacataagacacgctgaaaccagcacaaatattctacgaaaatcactcatatcctgtgagatggttttgactgaaaaatcattgccactaccaaggtccgtccccaggaagtagatgaccaggtagcaagtccagattgcatgaataatcaataatgcagatggtgcaatgcttcgtcctaattctctagcatcagttgccactagtgttatggtgttgatagcggcaatctgaacaagcactgtccactgtaagatacaaaacgtgtgtaggagccatctgcaggtcgctgtggttgtaatgggttggatgagaaaggtaacaaaagtactatcagagacaacataggacactataggcatgaagagtgcagcggcaccctggaagaggaagcgagtcaaggggtggtgtcggtagcgcggggcataggctccaatccccacaaccactcccatcaacatggcgttcaccattgacagagagttcactcgccatatctcccatttcgcccgcttctccagcaacctcacctcagcatcagtacagtttctgataagtgaacttgcgcggtccatcgtcgacctccaattccagaggtatgtgtgtgtgtgtgtctatatatatatatatatatatatatatatatatatgaagggtatgaatcaaccgatgaagagttagatttaattgacgaactagccggtttaaaaatagaaatgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttacaaaacagaataaataaactagaagtagaactagagaacctaaaaattaactataatattaaggcattaccaga

SEQ ID NO: 44778 - DNA, 339 bp, Oryza sativa
agaaaaacgtaagaatcatgtgagagagatagactcaaaggaaatttccaagaggttggagctcttgctaaatttcctccaaaatccacatgcaatatatcattctattggaatttcataggatttggaaagcttcaatcttttgaatcaaagggacaaatagaaaaattttctataggatttgaatcctatgaaattcctataaaaatcctttgattcaaatggcccctaaaggtgcgttgttttttattaagatttgggctaattagctgtacgagagatgcaattatcatataattaattaaatattaattattaaaaacttaaaaaatagtttta

SEQ ID NO: 44779 - DNA, 1501 bp, Oryza sativa
atcactgtcgcctccgccgaactctacatccccaagcagctctagctctaccggcgagctcgatcgatttcatggagaagatagagctcctggaggcggcaggagaggcagaccttgagctcgggctcgccggcggtctgcgtggaagggaaggctggggatgtgcttgagcttcgtcgccgcaacgagtcccctgctccaccgccaccgatctcttgctctacgagctcaagaatgccaccgccgcttctctcctgctctgagaggaagaaggatagagagagaaagtgaagaggagatgagggaagaagaagaggtggctccgtggttatagactgacatatggtcctaatttttatttttatttgctaactggacttccacatcaatgccacgtagataaaaaccagctgaaaaaccactcgagggtgtaaagtgaacggtattgaaagttgaagggtgtgaaatatcctgttttagagattttggtgtattttatacaaaataaaaagttagagggtgtaaatggacttatccctatttgtaacttgggacagcatacataagagtgcaggaggaggaagctaagggtgttacccaagttaatcagtatcgagatatgaggatcttctgttttgcagtatgataggatcgggatactactatattttgggatactactatattttagaaagtacatatttttatataaaatataatatgttgtataaattaaagcatataaattggttttgataaatttaattggttttaatgtaaacttaaacatatttattcatattattttcaatccaccttattttaaataatattttgtaaaatcgtagaatcgaaatactatctaagataggatcgtatgtaaatgaatagtaagatcaggatactacgtgggattagtatcgcggcttggtaggattgtagtattgtaagatactagaatacaaatcgggatatcagtgttaccaccttcgacaaagaataacatctagtaataacaagtagtgtggcctatcaatgacacgtcgccaaaccacctttaaaattggttaggggtgatattgagtatctagaaaatcaggttaactcaagtgtttgggtgaatactttacggcgtagggtggacattttcttcacactctgtttatatagatgtgttatattttaaacaccattagcatatatagtttgccttgcaagtgactgcacaactaggatagaaagtattcaacaaggtttatataaaatcatgtattattaaagacttaaagcggccaatatttgcgagtaaacgcggttgtgaaaaataagagatttgaacgatactcaatctgttaaaaaaaatgtaacaccctagcatccaaatttgtattagtctgctctacgcgttgagtgggcccataattatgtaacacctcacttatatctttatttttgtttcgtgtaaaagagttaatccagagaaaatatgtttggagggaga

SEQ ID NO: 44780 - DNA, 155 bp, Oryza sativa
ttgggccaaggtatgcgcccctaaagagtacggtggattgggtgttcccgacttagagcgaatgggcatcgctttaagatctcgctgggcttggctgcagagaacaagcttggataagccttggcaaggtctgaacatcccaatctcacccaagg

SEQ ID NO: 44781 - DNA, 303 bp, Oryza sativa
atatatatatatatatatatatatatatattaggtgataccccgcgtgttgctgtggaagtgtggatatagttgagaaattttaagcaggcgacagtaccataggcatttgagcagaaaggataagattgatttctagttaaaaagagcacattccaattagcatagctgaccaagaatgtgcatgcagtgccattcagctaaccttttcttttgtttttgtttgcttgagggtcattcagctagccttttctttttctttttttgtttgagggtcattcagctaacctttgctcaaggaaga

SEQ ID NO: 44782 - DNA, 1501 bp, Oryza sativa
aaaataatatgtttggaattagagagtgtcatacaaatttcctgatatgtgataattaacgacaattacaatcaaattagtgcgcgatgttgtatgaccggccaacttaggcggttaggccaacgaaattgcctctcgaatttttaatacattgtctatttgtgcactttaccattgcccgtaacgcattgtcgatgattattatctccggttttactttaaatagataataccgttaactcttaaacaaacgtttaaacattcagcttaaaaagaaaatactaattttgttttaaagtatataaattatattttattatatttagtacggagggaggtagtattatctattttattgtgttttaatttattattaaagttacttctagcatgaagtgcgtaagtaatacggatatatatttttaaaagtgatatgtattaaaaacggagtgaatacatcctaccgaagtttctacgaattgtcaaggtaagtacataaaggtcaagtggagcaccacaaattctgggtacagctaccagatagagtagctttgattgatgaatttatgagctgttcaatgctatttttaaccttaccaaattttggtaaagttactaaaaaaatggctacatttagttttctgctaaattttagtacctatataaaaaattctgccaatattttgataactatataagaaaacctatataaggtttttttttaatagtccctcagtcaggttgaaaaacgaaaatatattagtcagttatcagttgcgatcagtcaggttgaaaaacgaaaatatatatactagtcaaaatactcggtcggagaaatgaaatgccactaataataaaactccggcaggtgggccccacatccagcatccatttaccaaccaaagctcctcatttgcgtcttctctctctactacttctcctcctcctccttcctcgccgatcctcgccgccgccgccgcgcatcgccggagcaatctccattgacaagagcggtaagtagagtatctctagcttctgcttgggttggattctcctcccaattcccatatattcgcttattatgtggaaaaggctttgggaagaagaagaagaagtagtagtagtatcaagtacaagtaggcaatcttggcatctcagtgagatcgattccttggagataaattcggcaacttttatggaggtggtggagagcgtgtgctttccctcctttgcagccatgagagcataaagtctccagctttcttgccttctttgttttttttttccctcctattggcattcattcaagggtgatgggagccttttttgtggggagaaaaaggaataatcgttgggggattgattgcgtggtttcctatcttggggttttttctttgctcttggagagaaaaaggtctcatcttataccttttatatggctttgggtgaatgaaggtataggttggtgaggaggggagctagagcttgatggtggcggcca

SEQ ID NO: 44783 - DNA, 1501 bp, Oryza sativa
tttggatccaaactttggatctaaacacagcctaaataattgttgcaaatctggatgagattcttcctcagtgatcatcccctcgagctcgagctcgttgcttaggctgtatttgggagtgctggcacgcaaaacggagcaacgtttaatgcgtgattaattaagtattagctatttttttttcaaaaattgatcaatatgatttttttaagcaactttcgtatagaaactttttgaaaaaaacattagttggaaaagcgtgcacgcagaaaacgagggagaggggttgggaacttcctataccgaacgcagccttagggattaccagtactccattttaagtgaggttgtaggtttctgtttcaaacgtttgaacgtccgtcttgtttaaaaaaaattaaaaaacttaaaaaaagtaagcattaaatactattcatgttttaattattatcgaataacaataaaaatactaatgataaaaaaatattaaataagacgaaaggttaaacgatggacaccggagcacacaactgaaataggatggtgggagtatataggagtactgtatcaatacactaataaactacgatcccgaagaagcatcttcccaagtcatcctcgttgcatggggattaacatagaaaatctgaattttccaaaacagttcggccacacacctaaaccaaaacaagaaggtcagatcgtgctagctagctagatcctgctggagtagtgctatacttcgatcctttgaagttaggggatcgtttttcggcacacaagggcggagctacatatgcaagggagagggtgtctaggaatttggttttaaaaatttagcaatagtttatctttttttattatatgtgtattcctctcactacgagtttatatatattcacatttgcctaaacttaatcaaagatgagtaaagtaaatgaggggtcctctagctactcatgaagctaagtactactccctccatttctaaatatttaactccattgactatttagcatatctttgaccattcgtcttatttaaaaacttttatgaaatatgtaaaactatatgtatacataaaagtatatttaacaatgaatcaaatgataggaaaaaattaataattacttaactttttttaaataagacgaacggtcaaacatgttatagcgtcgaatatttagaaacggagggagtattcaggaacatgaactgaacatgcctactctcatgaatcgtaatatacgtacattagcttataatttctgtgagggtgatctatcgatcgatccccgatcggatcggcctgcaggttaactataaccactttcgcattctctatcgttttgaccacaatgtatattactgtttattagttaattactaccagtaataagtaattaattaatcaatcaattaatcaattattatccgtgaaacacgcttgcatgcatgtgcgctggccacactcagctgctaccttggcgcgagacgcacg

SEQ ID NO: 44784 - DNA, 1501 bp, Oryza sativa
cttctaccttctgtcactgttgcttaaacatacaccatataatttattattcaatgatcaaacgatttatacacgctgatacatcaagggatgatctaggcagagaccccaaggaattttttgcatctaatacaagttttattctactcactgccaatagacattcaattaattaatgccagacacttaatctcaatccatttatttagaataatacataaaagctactcttcaacctatgaatcaaataacttatccctatttttccctgttgcttttctttttctttcctttggcatgtgtggattatctgcaaatatttgaatgtccaaaagttgtactctcatcagcatgtattggtagaattacgcatttgtggacacttcgatgaattggaattatgttaccatgctaaagacaaagtgttgtgtgcaaaaagacttcgtaactggtacttacaatggagctcaccatgccaatgtgaaggatgtaccacctgtcagtgatattgtgtggagcttttatgagagtgtttatccaccaaacaaataaaacgtaagcatcttgatatgtacaacccttacttccttctatataaggtgcctatcacttctatcgatcaaaggagcacatttttgctcgacacagatctctataaaactatttgcagtagtaatcatttaatagtatctattatccgactgaggatacctttgttgctaaacgtagatctctataaaactatttgcagtaatcacttaatactaatagtagtccatctattatccaattgttgaggatacctgctaaacggagatctctgcaaagctatttgcagttatagcttagtggatttcattctccattccaggacatttatgagacagaatttaggcatcaatttccaaggattgaaacttctttttcaatcattggagcacatttcctggtaaatgtgatctataggaagttttctatagcattcacatagtagtatccaatctcattggagtatggttttctcatagattttagcaagctatttgcagcaataaaattgcaattctcgttctcccttgcgaatgtcttcccctcatacatctccactaagctatttgcaaacatagcaatttccattctccactggagtatggttttctcaaaataggtctccaacaagctataatcgattagtagttcccatcctccattggaaaatggctttctcgctgtagatttgtaggaactatttgcaacttacacgcggtagttcccattatccattggaggatgcatttcataccatataaatcaacctagctacatggtatgtagttaatcgctttcgtttttaggccattcaacatccaaaaatgtctctcaccataaaactataattagatattgttggtatcgtattaatttgatttctatttgaggatgcccttctcgctatatatatgtagccagcaagctacaccgtatactatacagtattctc

SEQ ID NO: 44785 - DNA, 1501 bp, Oryza sativa
tagtaattaatcctgatcgacctgactggcgattaggatgcagggattaggacaagatgatcgatcgagcttgtagtcaagcctggttagtgattgtactttgaccaaattattcaaatactaaggagaaagcaaatgtttaattggggcaacttgtttctctcctatatttgcagggaatcttgcattgcattgttcttgttaccatttttttaataagaaacacagaacaaacctctcatgcgctcataacacgcgtaaactcatccttataaacgtacactaatttactattcgataagtgcgctaattggctaaggaagtagccaacactaattttttttcgatgaactacatataagagtactacaaagctataaaaatctagataacattagtactcctatatacttcctccatttcacaatgtaagtaattctattctacattcatatcgatgttaatatgaatgtagaaaatgctagaataacttacattgtgaaacggagggagtagtaaaattttggaagagaaaaaacatataaaagagagaagaaatgggctaattgggccttatcagcccagcccagcccaagcgacgcatgaggcagcagcaagcaaagcctatctccttctcgcggctacgcgacgccacacgccggcgccatcgccttcctcctcctccgactccgacgagctccggcgactccgatggacttggtgcgcgcgctcgccgccatcccggctcgtcaccctctccctccctcctcgctgacaaaggctcgccgccatgggcctcaaccatcgacgaccgttctggcgccggtgccaggtaaactcgcgtcgcgtgtagaggtctagggttcttcaaggccgcagctcgcagtctgggggaaaaagaaaagaattcttcatttgaaagtgtgaaatactgctgcagaaatttgttgggaatttgtagtcctgtggtgctgccaatacactcaatagcttataggaactcatttccaagcattttctcatgttatacttgtcttgaaaccatgaatgattaggattgaagaagccattggttattgtgatagtgccactttaggcctcgggatgcattttaatttcccttgtccaattaaactatgtgttatactacaattctgaattgggactagtaaaaaaaaatggccaaacatttggagcatcaacataatagtacatccccaagtcccaagtacatgcaatatgagaactcaatgtagtcttgaggagttatgagaagataaatttcttgggattaacaatgatgttaagcatgatatgcatgtttactggatgaagaaaaataataagcgaagagaatctgttgcaagaataattatattgcatcgatggattttttttttttgaagagcaggcaaaagcatcaatggattattttgactccaaaattaaatgcttattacaagacactgttaattacttctgtacaggtggaatgttggat

SEQ ID NO: 44786 - DNA, 1501 bp, Oryza sativa
tacgcacgcacgggttccttttttttttcttttttcccttttttttctcatcatgtgttgtttggtactggtacgttctgcctctatcccgtgccctgctgtctgcactgcacgacagcaagattatcaaaaagggcaaaagaaaaaaacagagatagcgtactctgatcctttttgtgcaggtcaaatcgacaggctgtttaggtttcgtgattcgtcgagcaggaatttaaaccgcactttccgtatcagccactggcattctgtactccccggtaaaaaaaaacatcagtaacctccgtctaaaaaaagataaaccctgattttcgtgtccaatatttgaccgtccgtcgtatttaaaaaaattataaaaaaaattaaaaagataagtcacgcataaaatattaataatgttttatcatctaacaacaataaaaatacaaattataaaaaaatttcatataagaccgaccgttaaagttagacacagaaactcagggtttgtcttttttttttttttgagacggagagagtatgagtaaaaaatgcagtaaaagaactttctttttttctattgcaactaggagtaatccgttcgtcctataatataataacttttaatacttagaatttgcttaaaatataataatatcttcaccaacattcccttcttaaccaatcataatcctgcactattcatttttcccatataccttcacttctcaataattttatattttacatatttaattttacatattttcttaataatcgtctctaactttaaaattttttatattttgggatcgagggtagaattatttttgtagatggggttccgttatttttacccacgaccgttaacgacttgactccacttcaaatcgcaactaaccacccgagccccgcgggcgcgggagttccacgtactgaggctgacagtggggcccacgaggagacccccgatcccactccacgcacaaatcatcactcaccgacaccgtgggtcccaccgaactcccgccttccctttcctcctcccacgcaaaccctctcctttcttttttccttttccatccacttcacccacggtaaaaactgcaaaaggttgaaaaaaaagaaaaaaattaccgcggagttcgagttatttccggccacagcgatggccccgccgcaaaagcggcccgcaacccggatccggtgcgaccgcgccacacgcatccccacgccaccctaaccacacccacacgcacgaaacctaatagccactgacaggtggggtcacgaaacaccggggcccacatggaagtgagttgggtatgagctggatcgcgtgaaatagtagtagcctcgcgcgggagggggatccaggctggccacggcaatggcgcgcgagtcttataccctatgatccctcgtcaccactccttccacctcccccaccgccatcgccattgccgccgacgaggaagaggagaagcttcgagtggagcgatctcga

SEQ ID NO: 44787 - DNA, 1501 bp, Oryza sativa
ttgcgtaggtaatcaaccatcatattttttttcttttctgacttgattatgtgcaacgcgactgatgcgaatgggatgagttcctttcgatgttttctctaagctctgaaacttggactttgcaacaaatggttggggcgcagatgagctgtttgacgaaatgcccagtagattcctgcgtgcggttgcatgcccagcaccggccagcacctgtttgactctattttttccttcggtctgctgtctgcactctggtgatctaatgtatcattttctctgaaccttgttttacccaaccttaatgccaatataaatatattttttttgttgcatattcctgaaaaaaagagaactctgctccagtgcttccaggcttcttaggtggtaaacaggaaaagaaagtaaagcaccaagtggctcctttgctgcaataaaatcaaattattattgtcaaggggatgaaaggaaaagaatacacagcctggaagagctttcaacttgaatcgccttgcaattttgtaacactacttgccctttttcacattgcatcatcgttgaaacatttagatttgaatacaaaaatctttatgggcagattctgcctcaaaaagtactttcatactattttaatttttttttcaggtttttcagacgttttgcaatagagaatgtcaatgtctgttgggacaaaggcagttggtggcaagaaagggaggagaatctataacagctctcctctgcaatctgcattgccctctccgttctcatcaggctttagccacactgcttcaatatctctttccatcttccgtatttaagtgatctgcagctctgtgagatatctgttctgggatctgcagtttcaagcatctcccattggagagatccagcgggaatcccggttctagcactatgggcacagttttggatgctctcgcttggaaattcttggaaaagctgggtcagcttattgaggatgaggttatcatgacattaagtgtgaaaaggggtattgagagcctgaagaaaaatctggaattcttcaacgctgttcgtgaggatgctgaggctctggccatggaggatccagggatagattcatggtggaagaacatgagaaatgttatgtttgatgtcgatgacatcgtagatcttttcatggttcattcacagaagctcttgctgccaccaaggccggtatgttgcaatcagcccttgttctctagctttgcaaagttttcatttgatcacatgattgccaaaagaattgataatataaatgaaaagtttgaagaaattaaaatgaacaaagagatgtttggcttggagagaaccaacgggcaacaaatccagataacaattgttgacagaagtcagacatctcctgtagatgaacttgaggtggttggagaagatatcagaagggctattgatgacatcgtcaaaatgattgttagtagtaactacaatgaaagcaggtcaactgtttttgggatccagg

SEQ ID NO: 44788 - DNA, 1501 bp, Oryza sativa
agaccgagtttaaggatgatgcatcatggcaagttatctattaattagaaagagtctgttagtttccttttatctttagaaaaatgtgtttagtgtccgataaggacattatgttttccttttatctttaggaatgtttttttcttgtccaacaaggactagtatctacccatgggtataaatatgtacacccagagacattgtaaactatctctcgatcaatacaattactttcggcgcatcgccaccctctttaccaaggtttttacttatcatccgacggggtaagtactacgttctgctagctctggcaattgtattggctacattggcgtggttcaaggctgcatagctttgacctcttggattgctctggttcggttgatatgtttgcctacctatttatcatatatcttagttaatctaatttagcatcttaatttgatcatatcggctgagattcgttttaggttttatactggtatcggctaaagtatcttgctagattagattaactaagatatccaccaccctgaaaattagtcaaaggcttgattgtttagactttatgtttctttgcatactttgcgatgcatcatccctagtcgtgcttagaatcctaaacgctaacctgtctttgattataataagggtttcatcgaggattcagccaatgagttatctagacgttgtatcggcttacaaagattgcatacaagttgtttttagcagattgtaacaaagatttcactgtttatctaatcatttggatttaattaatgacatcataccactagccgatgtatgctttaaccatcgggtcacttattctatcatatcattgttagccgattggtttttattggattatattgttgttttattacattatcatcagccaattatctttatatcattatttactcaagtatcagactctacattggacatatagtcgattgctcaaaactctatcgacatcggttgctatcggcatcggctagtatcgctcgatcgactcgtcagccgatcagctctttggtgatcaacatatttatatatctagttagttgcaggatcaaactgactggcatgcccgcatctctacaagctttggacctgcactagagctaaacagatctcctagggccgttatgttcgtcgacttagttcgcgccaatacaattctggcaccattagcaaagcgcggatttttcgttaacacccacttacacccctatgcctgatctttattattttatcaatgcatcgctaaacataaagcactcaaggtacattcctaaacttgatcaaacatatgaactgcttttaggttggccaaaatttttgcctcaagcttttagatgtccacaatgcttttattggctcagatcccgatcaagctcttgatggtcttcaaagtcacataactgttaatttcttatgcatcatatgaatgaatgattgttcctgtacttaaaaattgatatggtgcgtagca

SEQ ID NO: 44789 - DNA, 177 bp, Oryza sativa
aaatgatcttcgggatctcctctaccttttctcttttggaatccccggctaaaatcgtttggaaagtgttggattcgaggtcgattcggattggtctctctctctccgagccctaactttccttctcgtcgccggtcgccgtgggccctcgccgccgcctcttgcccctataaaagg

SEQ ID NO: 44790 - DNA, 986 bp, Oryza sativa
tctgttacccagatcaatagtatccctgcaggtgacagtgaaaatgtggttcttaatgagatataaacttctcgtccatgcctgattaggggtgtaagtggctagcccacaaaacccacttataggctaaaataagccacgaacctgcttattttgacctataagtgggttcacggttgacccactgtaaacagtgaaatttggcaagccccgaagtcatcatcggcctagagtcagtatcggtttcagagtcctataatcggccgatggaaactatcaagtcgccaatagtcggaatcttgctatattcgattaagaaaattaatatattcaattaagcttatccagaaaagaccgagtttaaggatgatgcatcatggcaagttatctattaattagaaagagtctgttagtttccttttatctttagaaaaatgtgtttagtgtccgataaggacattatgttttccttttatctttaggaatgtttttttcttgtccaacaaggactagtatctacccatgggtataaatatgtacacccagagacattgtaaactatctctcgatcaatacaattactttcggcgcatcgccaccctctttaccaaggtttttacttatcatccgacggggtaagtactacgttctgctagctctggcaattgtattggctacattggcgtggttcaaggctgcatagctttgacctcttggattgctctggttcggttgatatgtttgcctacctatttatcatatatcttagttaatctaatttagcatcttaatttgatcatatcggctgagattcgttttaggttttatactggtatcggctaaagtatcttgctagattagattaactaagatatccaccaccctgaaaattagtcaaaggcttgattgtttagactttatgtttctttgcatactttgcgatgcatcatccctagtcgtgcttagaatcctaaacgctaacctgt

SEQ ID NO: 44791 - DNA, 258 bp, Oryza sativa
ccgagctaagatgaattagttatgaatttttaaagattaaatcggattaaaacacttatatggattttaattgaattatgacgcaataatgaattatttttgaaaaggaaaaagggatttattgcgtcagcggctagggttttcggtggaccgggcgcatggcgacggttcacggaaacgaacggctgagatcgatccatccaaaacggacggccgagatcgatcgggtctacagcggctcacggcagacggccccga

SEQ ID NO: 44792 - DNA, 1501 bp, Oryza sativa
tacatacatatagagagagtgagaaacgtactccctccatctcaaaataagtgcagttctgcattgttcgtattcaacgtttggccgttcatcttaattgattttttttaatgattagcatttttgttgttattagatgataaaacatgaacaatactttatgtgtgacttttttttattttctcataaattttttaaataagacggatagtcaaacgttggatacgtatattcacggctgcacttattttggaacggaggtagtattcattcttttgcatatcctcaaatatggcgttaataaagaaattactgacctgaatcctaagaatcatcagcgatttgacggacaagaccgtaagtgccatcattttgcttttgacggttaaactatatgaataaaattctttgtctatagttttttttccaatgtctttgtctagttttttttgatgtgaaaatgaaaatgatgacagataaatgtttcaaaatttgtctctatatccaaaagtaattaagctgtagaggttttttcgcacaaattttgatctctagcctaggatttgccttccataggtcctgggcggtgactcattttgagtcttctttttttcttttccttttttttgaaaaaaaatcatcgtagaattaaaagtttctcatttttattttttacttaaaaaataccatgcattacaaagatgaaaataaaatatattgaatattaatatgcgtttgatgccattccctgtataaccatatcaatgacaataactattaattacaattgagcagacaaaaatttacaaccaacatttttatatccattgttgtaactaagaaataatgaaaattataacacactactccctccttcccaaattgatcatcatatacgtttatacaccaagattaaggataatttcaatcacatcaattaagacaccgtacacacattctcccacaatgcatgcatcgattaaaacatcataacaattacacattagcatgcacacattctgtcatgctgtattaattgtattctgatgaaatccgtgtctatacggttatatgatgatcaatttgataaattttaaatttcattatatgatgataaatttgggaaggagggagtatctcgattggcaatctctactaaaaaacttttttttagcgacgttgtccttttatttttccagacggatatgaccctcggagtcaaatattggcctacgaaaatataaaccgaggtggatttttgtcatccgcttgggaaaatcaatttttccaggcggatcactgaagaggtccgcctgcgaaaatcaccttaaaaaatgatttttgcatgcggaaccttatgcggtccgcctgcaaaaatcatacctacctaaaataaatcttaagtcatccttatcttctccaccaccactccccaccgaccaccactgattttcctctcaactctctatctctccctcaacacttctcttctcctctccac

SEQ ID NO: 44793 - DNA, 327 bp, Oryza sativa
cttctgaaactgtcttgtcaatcgcaagaagattctctatttggagaggcaggttctgtcgcttcaagctactacctagagcctcctggtcatcattcattgtccgccccaactcacgcactatgcttgttcctcgtatccaagtgggactcctttgtacaagcattgcctccataatcaggcaatctcatgggacatccgcgcaactgtctagttcattccctcacacctgaccacaacttccattacgtgtcgtgatcagtaagaacatcgtcggcaccacatcgttcctcaccattgacctcagctagatatcgccggacatca

SEQ ID NO: 44794 - DNA, 261 bp, Oryza sativa
caatggtggccacagtggtcactctttaaaatcctagtctttctcaactccctccgtagatgctgcatccgtcagtcggcccctcatcatcgacaggtcgtggcaaccacattcatcttccgctatgtggtccatattcgcaggtgagtatccccctttctccctgttcccgtgtttatagtttgtgccgcctctgtccaggcgatggccgttgcctttggttgacgccgcagtcctgtacgcagtctgccgtcgtttctt

SEQ ID NO: 44795 - DNA, 731 bp, Oryza sativa
cgcagaaagtaggaacgcggccaccacatgcctcacctcatggccgcctcgacgcgtgccctcaccatcgcagccacctcgctgcttgccgtgccagtgctacatggtaaaaacgccagcctgctcctcctcccttctggcttgggagctcaaccgcgccagccgccaatcccgcaggtcctaggagccgagccccatgtctatgaagccattgcagagcgacaactggtgcagcggccatgaaagtggctgcctgatccggcgacgaggctcccgtcgacgttgacctcggctggttccttctactttctcaccgggttcgtccgaccgtgggggatcgggagcagaagggcatttgagaactggagaggggtagagagatgattgaagaacaggggcgtccacactccacaatttccccatggagatgaaggggtcagtggatgaagggcattttgggaaagacacggtacaaagtcaccatccatcagcaattccgcagcgcctaaagggaggaaagcaggcatggtacatcctattatcatcagtcccaagattcgtgcaggggaattgagggtgtagattgcgagtgcatgtgcactcgggtgcaaataatccaattcctatatatatatatatatatatatatatatatatatatatatagacataataatccaattgtgagtaataactaaaacactccccctcacaccctacccccacctagg

SEQ ID NO: 44796 - DNA, 1501 bp, Oryza sativa
ttttccacaaattgtgtatatgagtagcgaccactcctggcaaggctgttgaagaagccacgctgcacagcaccgctacacgccatctcgccaattttcttgaaagcattttttttactattaatgttaaaggcaatctcgagcgcatatataaacatgcggacacccatcataaaaataggcatacgcacacctacactgagagaaaaaatatttgtcaaaaaaagaggaaaaaaatatgtacttaatatttgccaggaaaaacatagatatatagcatcgaaaatgtcgcatgtaaccacattatatctttttaattatatcattcccatctatataatgatatgctaattattaacattatagattattccatcgtatattacccatgaacatgcataggtgaaaaaacaaaacaaaaaatatattaactcatatgttagcgaatgatggtgatagacgagtttagatataaccggaacaattcgcatccgcactttcattatagtttaagggtgtaattcagactattaccttttaaaatagtcacttccacataataaggattcataatacaaatttaaccaatactaatttagtaaagtgcccgcgcatgtgcgcgggccaccttcctagtttatgaattaaataaacataaaaaaattctaattataaatttaaggtcctgaagatttgcatgctctgaaaccttttcaaattataccatcatataattttgaggaacttttaagccatgcacctaaatatctcttttgtagatcaggcttacaatgaatcctaatccttcgtattagtacatatatttacattgtttctcatccagatgcatacttcttaatagtaaagtttgcgttagtaaatttgatgggaataatcaacaaatccagaaatttatagctggtgagtaagtcattgaatcaagtccttttttttttttggtttactgattgaaggctagcataactgaaacgcacacaaaacatcgatgtttgacggaaatatcaatctttgtggaactccgcttcagaagaattgatcaggcaataaaaacaatattgagcatacagtgaacagagaattggaaactattcatagacttaattatcctctacttcggacttttgtaagagtttgtggttggcctctgagtggtgtcctgcactctgccgttaaatcaaaagaatcctagagagtttttgtagtgtttattgttcatacctagggcaggttagctaatgggtaacttccatttggttctgcaaaccaactaatgccgttgctgcagccaaaatacaactgtctgttacataatgacagcaaagaagtaacgttgtatatatatacagtagtttatttttcatattccagtttagcatctttttcttgacaaccgaaactttattatattgccattggcagggaatgagcaatacagtttgactcggtacagtctagcccagtagacacattgctacacaag

SEQ ID NO: 44797 - DNA, 1501 bp, Oryza sativa
taaaactctgcagtgctgaggcggttcattgtgaaggagagctgcttaactgaagaaataccttgtgatccttccaaagttgtttcacctcctcataataactagcaccagaccatgaagtaaagtgcttccgagctcttggaacagactgcaggctttgaggcaagtcattcacaatgctgacatccccttccagagctttaataaaacgaggctcattgaagatgtccttaaatgtactgtaaaaagcagagtaaattgttaacacactaaacatggagggaacagtatatgacaactaaccaaggcaccaagcacattctaatggtaggcacctggtatcttgccaaaaggatcgcttatctaattgaggaataacaagtgttgcattcaccaaacgggccactgcaaccatatcacagatctgcagagggaagaacaatcctcaaattaaccatgttacagtaaatttattgaggatgatcacaaagaaaagatgaataaatgacaataattgcaaatataacataagaaattttctgcaggatgaaccttgcaaaagcaatgccgaatttttatttttagaatgaataaaataacatagacaaatgaaggtattgggcagctacaaaattattgatgcaaaactgtataaaagtaagacagatataagcctaaggcctaagcttttgtgtcacaaacttactccagtacgcatttggttgagtcctccattactcctaactgtcatgtagcgctctgacccttttggagctgacaatacaaatgatggtgttaggactgtatacagtggaaccatatcaaggaagggattattacatatgcatgtatgttcactgaattcgcttgagcactatactagagtatgtagataataaacatggataggccaatagagacaccctaaagaaagacagcaagaataatctataacttaacgctgacgccattacggacaaatggtagacttggaggattgtcgggcttggcacgccaatcacatagccatagccatacctccccattgttatattcgatattcgtgctggttttgaccagaaatgctctggttcgtgtcttttcggcttttgactgtgctttatagtatcttagcaccttggtactgagattatcttttcagcgactgtgctgctgttcactgtaaccaaacttttcttcagccttaataaatcttggccggcttctcatcgtcggcccggcaataaaataataatctataacttaaccattgttgtgccaaccctattgcagtaaaacacgtgtttttttaaaaccaaaagtaacgtactgaacgaacattccatttactatcttacagggagatcaaaggtagttaaaccaagttatagattattactacaagcatattagtgaagtcaatatcagaacagacaacgagaaactttccaccaaattctgacttcaaattaacaacagctagtactttcaagttgcaaag

SEQ ID NO: 44798 - DNA, 479 bp, Oryza sativa
tagcaggaaaggtattatgaagaagatgatggtggttttgatcctcattgggactgtgagtttttcagattctgctggaatgaaggtatgaggctgccatcgatcgagaattgtcctggatgcagtgacactgcagggagttcaagccgatcctgtaatagaggtaatcggctgattcaaaagaggatacctgttcatcagagattgggacatgtaaatcaagattatcaccatgatgaagatgaagataggaaaacacaatggtgtcctacaggcattttcaccaagaatcaaaagagaatggttcaaagaataaggaacatggagcgctttcaagaagtagaacaagaaatcaatcatcggctgaggaaaacaaagaccaagcaggtgtggcgtgttaagagctcggtcacaacagccgatgaagttgaagctgataaagccaaaagggttgctcaagggcaaggctactgcgtctg

SEQ ID NO: 44799 - DNA, 1501 bp, Oryza sativa
ataattaaaatttaattaatcatatactaatgatttttttatgtgcgtcaattttatttttatctttatgagtttcaacacacaaccacactccctctggttatataatccttaacatttaagataacgacgtgatctccaaaatatatatatttaaccatatttttctatgataacatccctaataattaaatacatatttacttttactaccttatagcaagaacacacacatccacatctgttcctctactcaatgcatgcgctctggtcgggtctccacctaatcgttgccacgtcgcaccgagctcttctgcgagcaccagcattgcgtcaggcccggattagttcccaaacaaaaaatttccacccagtcttatcgaatatttagacagatatatacagtattaaatatagaaaaaaactaattacttgtaaattacgatatgaatcttttaaatctgattgctccatgatttgataatgtggtgttacagtaaacatttaccaatgacgaattaattaggcttaataaattcgtctcgcagtttccaagctgaatctgtaatttgttttattattagtctatgtttaatactcgtgtgtccgtatatctaacgtgacacgctaaaaaatttcgttttgcttatcaaaatacatatatgtgtttgagtccgtttttaagctcgttcgctctttaaaatataaaaggagtcgtataagaaattattttaaaggaactcacattctaacttggggcgcttttagaaacacaacagttatcgtataagaaatcattttaaaaaactcgcatgctaatatgagataagagtcggactcctaattacaactcatgattttctaaaaatagtatccaaacaaattctcacaatgattttcactttagctaaattgtataattaataataataataataataataataataataataataataataataataaaataatattcacccattacaacgaacgtgtatttttcatagggtagtatcaagatttcagccgatcttacctgatttagccttatattttatgtgcttaattgatatgctagatccgccttttatattgagatcttcttgctttcaggtatattaagcttctcgtttgatatatattacttgctttaatatctttacatagagtggtatcggagtattagccgatacatgctaaatctatctaatcggctatgctatgagcgcttataatttcattgttaatatatatttcgatctaagtgatttatactgtctcgacatggcgatcaatctatcccaatcacttgacttaaatatatatcgacttagggattatgtaccgttaatatctacagccgattgaatagatttagttctttcttgtttattcatgactgccaatcgatgcaaagatgacatcggctcaaggataaatgatatgtcatcggcgactggccgatcggctatcgtttatgaatttaactgctatt

SEQ ID NO: 44800 - DNA, 1501 bp, Oryza sativa
agttttatgaaaaaaatatcggtacggttgagaactttccgtaccgttttcatagtactattttatatgcatggtattagtttatgatatcgtctgtagtatctctatagtatacacactcagaatcgtaagagccaagagtttattattccagccacaaaaccaccgtaaagagactattggttttacatttttttatgctgatctcacttggtttatactaccatttcaactagctagtagtagaggaataatttttcttttggtaatacaacttataaatcaaatgatttcgatccaatactagtataatacagtaatacgtactaggtcaccgtacaaacatactccgaaaaaattgtatccctttatataggaatacatatccgttatcaaccataaaaatgttaaaataattaaatatttaaaataactatatggagcttgactcattagggatgcaaacgcttgactgataagcaagcctatcgatcagaggaaaactatctatactcccatatgtcctaaaatataagaaataagaaccggataggacatttttactatgaatttggaaagacagtctgttcagattcgtagtattagaaaatattctatctggttctagattattatattttgggatggacggagtatatagacttctttattctcatcactacaaagagcatcagtcactgttaattcattcattattccaagcacagaccagctgccaaaaaatatgaacagattgccaaattttgatgatataaaatacggggaaacaaattaaactatgttttcttgatctgatatggcacaaaacactagctaggatcggatgaaagatctcctatatggagtatcaaagtatagtcaactctgccttttctttttggccaatgattgttgaaaattaagctaggctgttggtccttttgacaaaatgccaagagagcgaatagtttgcactgtgaacataacacgcacggtccatacacacacacacacacacacacacagttgtttataggacttgatctttagttctttaatcagtagaatactttaatgtgtgcacataaagaatcttgatccaaaacttccatgagaataatatataagagagcaagcacgcacattctctccatgtcaaaactacgtacaagtatagatgacttctcttttcttttgtttttttatttacacggaggatataaacgtaaacactgctgcgtgcgcgcaccatactcttacaacacaaatgcatcttcaaacgcaggctcaaattaaatagatggagatatggacaaatccctgaaagtgtactcatgtatgtgttatgtttgtggacagaaggatttgcacctgggcccccatcgtttggcttattcatggaataagccaaatatttgcaaatgaaaaagtaatttgctaataaaacttttatataccactggtggagaaaggggctttactcccggttaggaacccccct

SEQ ID NO: 44801 - DNA, 1501 bp, Oryza sativa
ttctctcccctttgcctcctctctttctctctctcgcctccggccatggcgaaccctcgcggcggcggcggaggaggagcgcgccaccacctcccactccggccgcggcggctgctccggtcgccgatctcgcgctgcgcggtcctcctcgccgcctccgccgcgctcctcctcgtcctctccctccgccaggtccaccgcgtcggcctcccaccccgcgaccacccgcccgcccaggcccgtctctccatctctccctctgttgcattgcagcgtctcctcctcgccctaggcggccgcaagtgcaaccacggaagttgccttcgcgagtgtggttgaaattttacctcatttctttggatctttggacttgggaggtgtccatgaaactgatgatagtagtagtggtagaccatgatgaagttatctttagtagtgttattagttataaactttctaggaaaattacctcaagatcattgggagttttgagccggcgaaactcgagcatcgcgcatggccgtaaacttagatgcgtgtgtttttttgctttacttttagttagttggcattgcgatagtcctatgggcaccattgtgatgctcagtaatttttgactcgagctgtgtaactgatctgcaggaaccaaatgagcagctgtggggttctgatggttacggttctcatgcttgtgtcacaccaacatctagatatatgggtaaattcctttcttatgaagcaatttttcatcgtatatgcgatgactccgttttagtttactgagctggatatatatggctctttgcaacttgaaagtactagctgttgttaatttgaagtcagaatttggtggaaagtttctcgttgtctgttctgatattgacttcactaatatgcttgtagtaataatctataacttggtttaactacctttgatctccctgtaagatagtaaatggaatgttcgttcagtacgttacttttggttttaaaaaaacacgtgttttactgcaatagggttggcacaacaatggttaagttatagattattattttattgccgggccgacgatgagaagccggccaagatttattaaggctgaagaaaagtttggttacagtgaacagcagcacagtcgctgaaaagataatctcagtaccaaggtgctaagatactataaagcacagtcaaaagccgaaaagacacgaaccagagcatttctggtcaaaaccagcacgaatatcgaatataacaatggggaggtatggctatggctatgtgattggcgtgccaagcccgacaatcctccaagtctaccatttgtccgtaatggcgtcagcgttaagttatagattattcttgctgtctttctttagggtgtctctattggcctatccatgtttattatctacatactctagtatagtgctcaagcgaattcagtgaacatacatgcatatgtaataatcccttccttgatatggttccactgtatacagt

SEQ ID NO: 44802 - DNA, 1501 bp, Oryza sativa
acaggaataaaaaaaattaaagggacaccgtaccaatgttgattgcagaattgcaatcacatcgagatgacatactaattactcctattaccacatgccatatatctctcgagcatttagttgaaagtgttctcctcctgtaactacattaatccagctagctggttaccttcatatgttgaaaactactttgccaaaggtatgtgcagtgtgcatatatattacatccgtgacacttattttcctgttaaaaatttctagctagtcttttagtaattatttttcttcctacaaattttttttctgaagcatttaatttgcaccttgctctcggctaaatcatagcaatctgcaagcatttcatgagaactgaatttttttatttgattttttttcttgatctgataagaattgatcagccttaaatttatttgattgatcaaaaatgtttttatttgatttttatttcatgagcaactcctgaaatcatatttctgaaacttactttttagtttgcttgaacttttctctagtcaaaggtacgcgcgcagtatctgataagaatatagttagttcatcgttctgattatactttccatgaaactctccagagaattccggactattctgaaaaatcaagtacgcatgatgtgatactgatctatattgtggaataataattttaaaaagggatctcttgataattgagaaaaaaaagagctccatcacactggcacatggaataaaaatcaggtgtcgtaatcatgtcacgcctgtattttgacttgctgcaaccgtccctggttcggattcagaatcgagacagtgaaatcagctgtagttgaggcgattagtcaagtcactctatatgattgctataaatttagttatcatgcacaacattctgtttgtctcttgaattgttcgaccttttttttgtggacgcgactctccgtcgggtgcccgatgagaagttaaaatcgggcgctcttaaattatttattcaaatcatgatccgattgtaccattaaattcgttacaattaaaccttcaaaacaagaccacatatggatatattccgacgaaaaatttttttagcttattattgaattatttttaaatgttgcatgatgttccatcagatatatcggaattgtttcactaagtagatcgaaaatgtttcactcgtttaaatcgagtgttgtttcaccttatataaaaaaaatgtttaagcaaatagctctgcgcaataagtagatcgagaggtcgttccgccccttgtccccgaagatgggtaatatgttctcatacaatgttgctccaactttttcctagagggcctagctggtgagcgatcccagtccgcggcagagaacagccagaagcaactagtcgcctcctttcctccgccgaaagatgcttagccagaagcgacgaaggaggggagctggggaaggctgacgatggcaatgaggggggaagctgtcgtagaagctttgcc

SEQ ID NO: 44803 - DNA, 193 bp, Oryza sativa
tagaatttaatatgttttaatttaattttctcgttttttttctttccgttgcaacgcacatacaattttgctaatttatataacgttacgtgaaaaaaaaaaccgcctggaggcagtatatttgctatgtttgacttctataaaatcctttggtttgacttctataaaatcctttggttcgtccgttccaaga

SEQ ID NO: 44804 - DNA, 1501 bp, Oryza sativa
aaattgatcatcatataaccgtatagacacggatttcatcagaatacaattaatacagcatgacagaatgtgtgcatgctaatgtgtaattgttatgatgttttaatcgatgcatgcattgtgggagaatgtgtgtacggtgtcttaattgatgtgattgaaattatccttaatcttggtgtataaacgtatatgatgatcaatttgggaaggagggagtagtgtgttataattttcattatttcttagttacaacaatggatataaaaatgttggttgtaaatttttgtctgctcaattgtaattaatagttattgtcattgatatggttatacagggaatggcatcaaacgcatattaatattcaatatattttattttcatctttgtaatgcatggtattttttaagtaaaaaataaaaatgagaaacttttaattctacgatgattttttttcaaaaaaaaggaaaagaaaaaaagaagactcaaaatgagtcaccgcccaggacctatggaaggcaaatcctaggctagagatcaaaatttgtgcgaaaaaacctctacagcttaattacttttggatatagagacaaattttgaaacatttatctgtcatcattttcattttcacatcaaaaaaaactagacaaagacattggaaaaaaaactatagacaaagaattttattcatatagtttaaccgtcaaaagcaaaatgatggcacttacggtcttgtccgtcaaatcgctgatgattcttaggattcaggtcagtaatttctttattaacgccatatttgaggatatgcaaaagaatgaatactacctccgttccaaaataagtgcagccgtgaatatacgtatccaacgtttgactatccgtcttatttaaaaaatttatgagaaaataaaaaaaagtcacacataaagtattgttcatgttttatcatctaataacaacaaaaatgctaatcattaaaaaaaatcaattaagatgaacggccaaacgttgaatacgaacaatgcagaactgcacttattttgagatggagggagtacgtttctcactctctctatatgtatgtagtactccctccgtttcaggttacaagacgttttgactttagtcaaagtcaaactgttttaagtttgatcaaagtctgtagaaaaaaaatactccatccgttttagattataagatgttttgactttggttaaagtcaaattgttttaagtttgactaagtttatagacaaatacaataatatttataataataaattagtttcatcaaataaattcttgaatatattttcataataaatttgtcatgggttaaaaatgttactactttttctacaaacttcaaacttaaagcaatttttgacttataacctgaaacagagagagtagtaacattttcaaccctatacaaatttattattgccagggttacggataaggtataccctttacccttgggtatatgtcatgcatcgata

SEQ ID NO: 44805 - DNA, 787 bp, Oryza sativa
gagttctacagtgaagctgttggtgtggaggattaggtgtaaccctggtcaagctgcctgtagagtggagtcgtctgcgccgtttatcttatttttccgctgcatagatctttattgattgagaggaactatctacctctgtaatgacattttattcgcttattatttagagtaataattgaactctattatcaatttgttattgtgtgcctcggctgattcctggacgagggttcacacagatgtaagcgtttggaattttggatagaaattccgggcgtgacaagttggtatcagagccaggttgaccctaggttatgccaaatggttacccatagaagccctctaaaaatattggaaaagtagaactgttctcctccccttctcttttaattaaaccaaactaatagcacatgcacttcataatctcttttagtggttttcattcgaaagttattccagtgttattagtactgtacatctattactgtactaatgactcatttaccagcaaaagttttacaatattattttatttaaccttgctgcaatgaaataaatttagcatgttgattttataactttcttttatttcttttgaaacttgttgttcaaaagtacaaaatttgtgaccttgtttccaactgtttcaacttatcttgcaagtttggtttactttatttacttaccttttactttgattttctaactttattcaaattaatccaaaaacttgtgctattaatttgataaatgtcttaactccctcctttcacttgtctttaga

SEQ ID NO: 44806 - DNA, 1501 bp, Oryza sativa
acctcgtgcgggctcagccccacgcccccgccgccgccgccggacaccaccctgctccgatcaccgccttgctccgctccccccgagctcaggagcagcagcacgacgcacgccacggcgagcagcgccacggcgatggcgagcgcggtccacgggcggcggcgccgactgccctgagaagaaaccgggccgccgccgaggagggggttctccaggccgccgcgcgcggccatggctgggtagctgccgccggatagccggagatcctggtggggattccaaggtaggacagagaggggagggatttcttggatagcgacttggcgagagcttgtcgcactgtggtgttgggtggcttgtgtgcttgagacacttggatatttatatttagtgactgtctgtccagctggccaatgattctatagagcttgttctaacttggattgtttctagtactatatttttaacgactcaaagctggagtagtaattacttatcagatggaaattcagaagttgaatgcttgacgcaactgtactgattggatggcaagagtaattctaacacattagagtgaatctggacataccttacgttcagattggtttattttagaacggagggactatggataaaaaaaaatttgaactctgaccattaatctgcttgagtgtcaaaacatcaagttctcaaatgtgtactactagtattatttttgttgcaaggaagaaacagagaaaagaatatgcagatgcaaagaatattgtggcgtggtgtgtgtgagatggtgcagcaaccattggcagaatcaggaaaacagattctttcagagttgtgacggactgatatttattacgtttatttatgcttagaaaacccagcatctgaatatctgataagcaccttggatctccgtctggctatcactattttagcctttaatttcatttccctattttttaataaatgaaacttttattgatctcaaacagttctccgcaaaaaaatattaaaggctaaaatatactacccattacaaaatatagcaacttttagctataaatatacctcatcccacaatataataatttttagctacgaattagacatgccatttgagcggagcgaccaaccaacttggcgaggcgagtgagacgaccagagtcggtgtaatcgcgtctcagcaatttgtcgctgtcaagtgtcaactactccggtccaggggcatgacttgttggtaatccatgcgtctcagcttctctttgctgcaccttctgtcattttctaattaaacggttgatatgtgttattccttaatttatgggttagttattactaacatagtacggagtactccgtaagtagtactagtatttatggtttttgcgaattgcaagcagatttctggatttttcacattttggtccttttaaaaaacttatttcgcaaatagacccctaaaaaaacttattctaaaaatggtcctttttaggcgccagaa

SEQ ID NO: 44807 - DNA, 1501 bp, Oryza sativa
gaaagacctgtgaatctgtgggcttgaataacttttcgctcggtggggcgagtgcggactaaagtttcatgctgctttctccattttcatgaatctgtgggcctcgtcactggtttttttttgtgtgtttgtcacacttctagtttcttttctttcggttttagtttcaatttctaacagtttctatatttgaaaataaaggaattttagaaatttatctaaactctttccactcctccagccacattgtttcgcttattcatatgcttatccaaatagcttattattaaataaaaaattatttatgagtaaaacttatacatatgtgtccttagcgactaaaaaataaatgctataaaatacactacgatgaaagaaccaaaaattcaaattcaaaaataagttctataattcaaatttaactaataatcataataataaacgaaataattattactcactccttccaatatactccataaaaagacttttggggtcttttcggaggaattaaggttaaaagaaaagtgatataatgtcactaaatgaggggatggggagtggaagcctggaagggtgcattgcggataacattaggtaaaaataaacaagtgatttatgagaagtagcacactagaagtttttatattttagatcaaattcttcgtcaataatttcataccaaatttcaaacacgaagaaggcacattttaagaaagggaatagttttttctccccctttcctttttcatcctccccttttttctttttttttaattcctccactcaataagttattataggcttatggcattccttcatttctatattgggaaaattggttatatagtagcatctaaagttcacgtttttggttttatagcaccgaaagataccggttcactttaatagtacccgagtagaatacatggcaatgaggggtagagacatcataccgtgtgcgtggctgagtcaatagcaatcaagacggacggaaaacaatgtggactttagatgctattaaagtgaaccggtatctttcgatactataaaataaaaaaacgtgaacattgatgctatataaccaattttgtcttctttattctacaggctgaaggccagcccaattttctctcctcttagcccagcacgctggcccatctccttgcccacccatgggcctgaaagccgagtccccagacccacctacccgcgccgccggcgaacgccgcgctcaaaccttgaatcgccgccgttgttagacatggcggccgctctgcgcagaaccgcggctcccatggcggcggcggcggtgttccggctctccgcaccaccgcgccacgccgctcgcctcgcgcggttcctcggcggcgcctccgctgcttcctccggtagcaatcaacttatattctcctatatatgcttcccgtcttgatcttgagttagcttagcttagcttcttcttggatgtttccagatgcggcggttgcttcgggggagt

SEQ ID NO: 44808 - DNA, 162 bp, Oryza sativa
cttaccgataaaattatggttcaggctcatcttgaggagcacgactatatcacgggaatttagagaattctctagccattgattttcattaaattaatggaccaattatttaccaccattagatttataaaaaaaattcctaaccccaaaccgggtccacca

SEQ ID NO: 44809 - DNA, 1501 bp, Oryza sativa
aggcacttgctcgtcccgtacactaggaacaaaggaggaggaactcgaagtgcaagagtcgggaagttcttccttggtactgcagagtatatatatgaaacttgagtatatatatgaaacaagtgcaatgcggagtatatatatgaaacttgagtatatatatgaatcaagtgcaagagtcgggaagttcttcctttggtactacagagtatatatatatatatatatatatatatatatatatatatatatatatatatatatatgaaacttgatcgcccgcctacccgtgcaggttctcaagcgcggacggagttccagaggcacttgcttgtcccgtacaccatcttaaccgttcaacagagactctccactagctctgtatttaagttgagacctcttcacttagattttcaaggtggtttattacccatagctcttaatgtgggacaatggaatttattatgatttaattgggcctagctcattaatctaacacaaacgacgcacggcggagggggaagcagccgacggcaacgatgcaccgacgggaaataggcggcggtgcacgggcttccccttccagtatagcaaatccgtcattagcaaatgtttactgtagcaccacattactaaattatggagcaattagatttaaaaatttcgtctcgtaaattagtcgcaatctgtacaattagttattttttagtctatatttaatattttatatttaatattttatgtaggtgctcaaatattctatttaacatgttaaaaaattttgaagtgagatgtaaccagacctgaacatccatcccagttgaaatctgaaattgaccatgattgcatgtgacagctcgtcagttatactataggagtaggagtgcatgcgtgctgcagtgtctctgcacgggatcactgtgcttcacggtacgcaacgacccaaggctaatgctgctgcttttgcactgctgctgcagctagtcacgcgctgcgccatgccatgtgaacaaaaacgacctgatgatccagcgaggagtgatgcgtgttttctttttttgagaacgtacagcggtgctttcgttgatacaccaggaacatactctcggttaaaaaaaaattcaatctaatacaggattaaacgttttttatatagctttaaaggccccgtttagttcccaaatttttttctaaaaacatcacattgaatatttggacacatgcatagagcattaaatatagataaatgaaaaaactaattgcatagttatgggggaaatcgcgagacgaatcttttgagtctaattagtccatgattagctataagtgctacaataacccacatgtgctaatgacgaattaattatgctcaaaaaattcgtctcgcggtttccaggcgagatgaaattagttttttcattcatatcggaaaaacccttccgacatccggtcaaacatccgatgtgcaatccaaattttttttttcgcgaagtatacaggc

SEQ ID NO: 44810 - DNA, 367 bp, Oryza sativa
gctaataaatactatgtttgcatgtgtttagtgggtattatctttataaaacccactaagcacacaaagttcaacatgcaagcatatagtaattatatctataatttatttcattctaaagctaaacatacacatgctaaatcatcaatcttaaatcattttcaaaatatttcaattcaaatcatttaatcatttctacaatatctaacatatattgtaggaacgaatcacaagaactaagccaaccagaggggggtgaatggttggtatacccaaaaaccaaaaacttttagcgaaaataaaagttaccctcgaaatcgatggatcgcggtctgaccgaagtagttgcgccggtctgaccgcctga

SEQ ID NO: 44811 - DNA, 1501 bp, Oryza sativa
gacatttaaatagatggactggacttcaatccacaacaataaatgtaattgggcaaaagtagtgaaattctgaagacagttcacaagttgagaattttttttcctagtttgacatgtgtgcaggtagcagaaagaatccaagattgcagcaatcttgctagttactagtaccctcactggcagaaagagtccaagattgcaacagtcttacttatccctcactgcatcgttgatatcatgtaatcgtttgagaactgaatacatagatgtatgctcaccatcttgaccaatgcaggcgccattgtggagagtgcagaactcgcccaccgaacaattgctcaaaacaacattgtacctgcacacacatcaacatcaagcacactcagctcactaccagcaaaatcaaatcaccaaatcaaacagaattcccccctttgtattcagatcgaatcgtagattagaaacaccattaccagatcctggttgactgaccgatggacacggagggcccgaccacggctcccgagccgacgacgacatccttgccaagaacggcgccggagtgcacgacggcgccggcctccaccaccgcggtggggtcaacggacgcggccctgtgcaagacgcccccgccgttgtgccacgggacgaactcccccgaagcaaccgccgcatctggaaacatccaagaagaagctaagctaagctaactcaagatcaagacgggaagcatatataggagaatataagttgattgctaccggaggaagcagcggaggcgccgccgaggaaccgcgcgaggcgagcggcgtggcgcggtggtgcggagagccggaacaccgccgccgccgccatgggagccgcggttctgcgcagagcggccgccatgtctaacaacggcggcgattcaaggtttgagcgcggcgttcgccggcggcgcgggtaggtgggtctggggactcggctttcaggcccatgggtgggcaaggagatgggccagcgtgctgggctaagaggagagaaaattgggctggccttcagcctgtagaataaagaagacaaaattggttatatagcatcaatgttcacgtttttttattttatagtatcgaaagataccggttcactttaatagcatctaaagtccacattgttttccgtccgtcttgattgctattgactcagccacgcacacggtatgatgtctctacccctcattgccatgtattctactcgggtactattaaagtgaaccggtatctttcggtgctataaaaccaaaaacgtgaactttagatgctactatataaccaattttcccaatatagaaatgaaggaatgccataagcctataataacttattgagtggaggaattaaaaaaaaagaaaaaaggggaggatgaaaaaggaaagggggagaaaaaactattccctttcttaaaatgtgccttcttcgtgtttgaaatttggtatgaaattattgacgaagaatttgatcta

SEQ ID NO: 44812 - DNA, 1501 bp, Oryza sativa
aataaatatggtgtcttggtgtcattatcgtgtttgtatcttctatagtgtttcttatgtgctcggttaccaatgatgattttggaccggttttataagaaggaaccgcatgagcacgaagctgtgtgacaaaaagcgatggacctggccgtacctcatccatagtatatattttttagtttaccttttcctccctcggtcaaataattatggccaacacgggctctcaaggaagcaatatgtagtacatacttatgatttctgtaaattaattttagatttcacttaatttacttcctaaagaaaagtagtacttttagtactgactcaaaagttacttctattgccctgtacgtttcaaattacttcgtcaggctttgcacattatactttttaaaatcctattagagagctttgtgttttaactccataccataaagctacttcttctaatactagaacaaagagttacttttgttatcgtatttagttacttctacaatttatttgaattacttttagatttcacgctgaacttacttcatgtagcttcatgttttacctctgcactatgtagctaaccacctgtattgtttacataaaaacattataatattatgactcactctaaacatctaaatatgatccgtatatatgaaacataattattttcttcgggtattgatatagggtgcatgcatgtgtaatcacgaacttcaagaaaatgtttatgtaactatcccatctaatctacttttaatccgctagattgttacatttacgttttgaagaactacaatcaaatgaagttgaaaaaaagtactatgaaaaagacaacaattacagaattactactcaaatggaattgacaaaaaaaagggtgatcacagtgtacatgcgacacgcaaggagcggaacaagaggccaattaatggtggaaaatggaaatggcatctactaatctcatggtttttggtgtgatcttcaagctagtgcacactcttctcatatggcaccgatgattggattagctagatgcaattgacaagcatatagactttcgttcaataaaggccatcaacaaacccaacttctaagaaatataatcgtataaactattttatcttggaaatgtctttgccatcacttttattctgttagacgtcgttaattttgtcaaaatgaccaaattaccctcctgaagacctcccatgacaaattctcttcccttccaccgccagccattcctcttcaatttctcccctccacttgaactgccggccactccctcttccacctcttctcgattaatgctaacatctagttgtaacaaaaaaaaaaagtagcccggccgtcatcatcgacaatgcctatatatatcaggccgagctttggtagctgcagagatctcaaagctatagcggctatttcatttcctcttagagtatagttgccgtccatactccaaatacgtactgcctgatgggatcgtcaggggcac

SEQ ID NO: 44813 - DNA, 1501 bp, Oryza sativa
cttacgtcggagcctcgcagtccatgtgttataatgtggagatgactggggcagttggaatgttgacttgacttaatcatatattttttttttgaggcagacttgacttaaccagttgatcagctagcgaggcattaatagcttggattttgccatacactacagatctggccctgtttagttgtaaagttttctttttcaaacttccaacttaccatcacatcaaaccttttatatacacaacttttctatcacatcgtaccaatttcaaccaaacttctaaacttcggtgtgaactaaacacaactagatctggatataacaatggggcttcatttctggcgtttcattttcttttgagctcgttcgttcgctccatgtggagaggaatttcgagcgcacgcgagatgtgaaaattcatataacaatttttaataataaatttatttgttttttaaacaacttctatatatataatcatttttagacatacctttaatagtttaaaaacgtgctaatgaaaaatggggaaaatgaagatgttgaagcggaaagttgagtaaaagaacgagtcctaaagtctggcatgtccttgatccactatgaccaagttagatttttttttttggatttgctaaacaaaactaaatcaatgtcgattttacgttgtatttttattttcctttcgccaagctaactgaagatgcatggcagacaaaattttttaagaagaaaagaagcaaacactactgcaaaacaacacattggggacagttccaatatgtgccagttccaatgtgtgatcgttacacactagatatgggttttaaaatatcggacgcgtcagtcgcgcgcgtagtctctggttccatgcttccagcgttgtctctgcctctctggttcggtggatgcgcttgagctccagtttgcccatatgccatatgttgttctatgcctccccagatttcgatgtgttcaaatccagtgaaaagggaacgtattaagggcatgttcagattatagctaaaataaactttatcaaattttagcaatgttaaaattttgacaatttaacaatattgccaagttttgacgggatttctcatgtatttaccagagtttggtaaagaaatctttgttgccatcggctaaatccaacttatatgtatatgcaatccttatgagccgatgcaacgtccatataactcaccggctgaaaccctgatgaaacccttattggcaatcaagaagcaggctatagattatggttctaagcacgacttagtagatcaaactcaacggatgcagcactaagtatgaaaagaaatataatatctagacaatcaagccgttgactgagtttttagggtggtagatgtctaagctaatctaatctagcaacgcgatgtagccgataccggcagaatccctaaaacgagaagcagccgatagagctaaattgatatgctaagactatattaacagagacatatgataaata

SEQ ID NO: 44814 - DNA, 1169 bp, Oryza sativa
gagggtcaacgtatagaaaatatatacgtggaaaaaaaaatacttgcacctccttgcctgtgtgtgatggtcaacgtacggttgattgtgaaatcgagtatgtcccatgtttctaggaggcatacatgaacaatggaaaaaattaaaataaatgtgtacaatatgaacaatatgagtatatagttaattcgtcaatgcatgcatggttcacattaatatagtttggccttggggagacctatgtccccgtctatccaacagtaatgaaaactatatgtccttaggacggcacggtagaaaaaaaaatacaaccttaattagttgtgtatatgtaaaagaaatgaaatatgatatgggttctctataaagtcgtcaatgtgtggtttgatagtttggccttgtagaccgtgcgagtgtccccttgctccctaagaagttactccatccgttctagaaaccttgtactagatgggacatatgatccagatttattgtactaggatgtgtcccatccagtacaagactaatatattttgggacggatggagtataaatcttagagagcaatttataaatgatatttgtttaaatatatagtgttgataaaagaaatacatgaaaacaagttacacggtactcaaactaagtatcacgtactgaagagttacatgaatgatgtttgtttaaaaccgccttgctgacaaaaagtatatacgtgaaaaatatcacgtaaaaccatcgacatacatgcaaattaaataaaatcactgcctccaaatccactctagctagggtgaatgatcaggtgtaataaatttaaggaagttaattagttatccggttttaatttatagtttaagatgcagctaaatggatttttattcaaagaatattagggagtataacatgactcttctcaactcaaacacatcttcatcaagaacctgatagtggtaaaaaaaaaactcagctagatcttgttttttttcttcttttttcattaatttcaaccgaaattaatacatgtcaaactccggtttctgttgaccctcgattgggcttaatttctttctgccttaccaacaatttgctgaatggagcatgtgctagcttagccagcgcggcgccgacagattgaccggccggtatttctttggtttactattagg

SEQ ID NO: 44815 - DNA, 1501 bp, Oryza sativa
cgacaaagatacaaaatctaagccaacatgaacatagaattaacaaataacacatgtaagaaataaataattgtgagcaataaataattacgactactgcttaaatttaagattaccgttttctcctctatatataatcaggtgcgacctaacctagaggcaaggtatggaccggcctatgataaaattttcaccatctcgagccactatgatgaaaagaagtcctggcctataggctttcaaccccatgccctaggctaacgcctggggtgtctggattcttggtttgtccttgtatagattattattgggtatttacttcctttatctaaaagaaaaattaaaatagttttatagtaactcaaataaatatgagaacgactgatcgagtgaatacaattaattcactcaattggatcaaaatcacgatgtagatatcctaaaataactataatgacttagtaaactgcagcatgggccactcaacttgccaaggttggtttaaaggtgtcaccaatcttccaagctagcatatatagtattagatattggtcaacacactcatatatattattagataattacaatatgccttataatgcaatgaggacgagcatgggttactgcagagagagatgatcgatgtttcttcttggcttgttccatgcatggcaacatgcagacatgggtcatgggggtacacaagtgtcacacgatgatatcccaattagtgaccatgcatgtctactgtattgttgttaacgttgtgaaagccagtatttaaatttagcccttaaaggtgttatatggtgagtgaaaattgttacatagatatagtagtgggagtatgttgtttgagccatatatacttggcccatggcctaatataagctacctgaggcctagctagcttggccactgattattagatgtttgaaacacaccattgtggtatatagtataaaatgtagaataaatttcacaaaacaacgtatactttaaccaaactataaaacaatatagatttaagtcgatatatcacaaaactacagagatttaacaaatttatcacataacttcatatttaattaagaaaaagtatcatagaactatagatttaataacaaaattattacaaaactacaagttagcaccaatttaatagcaaaactgtagcatttataacttgaagacaacattagtgctaaagatttaaacactaaaaactttagttttatgacaacatcaatattaaatatgtagttttatcatacttggtattaaatctatagttttgtgaaaaaaattaatgctaaatctacaaatttgcgatacaataaaagtatatttagttttgtaagatatacccaaaaattacatgctattgtccttatttataataataaggttggcattcaaatgaaatagagtgtcccacttaaagaaagtttagtcagataattatactgttacggtgtttgatgacttgcttcaagtcttc

SEQ ID NO: 44816 - DNA, 1501 bp, Oryza sativa
ttctaacaaattgttgtggaagccgccagtaagtcattaccagaaaaactatttttacatgcggccaaaatgcattttcgcagatggccaaatactccgcccgtaacaaaaggcctacgaaaataaacacggtcataagtccgcctgcaaaagttaattttcacaggtagacccattaagaggagaacctgcaaaaataattatgtgtcaaaaaaaaaaggaaaaccaatctattattcacagcatgcaaattcacattgaaacacatatccgtggtggaagttctcaaaaacaaatgtggaagttcacgttcaaaatcatattcaaatccacatctgtatttttcacagcaatttggaagtttttttttaaaaaaagaaacatcagttggacgccgtggtggtggtcattgtcgcagggaggatgccgccatcttcgccgaggatctgatccggaagccgactttctccaccatgacgacgaggaagacgaccacgagcagcgcgaggagggtacattgtcaccttgccctcgtcagatccatcgcccatgcgcgttgctgtcgtcagatccgccacccggcacatcgtcgtctccggatcccaccaccgaactccgccgaaccaccatggagcgccactgctactcccttcctcctcaccaccaccaccctcgtcacctcccctgtagaccccgccgccgaactgaggagagggagctgggacttaaaagaaatatctgaatgtttcaattttctttagcgtctatgtaaatgctaatgccaattttcgcagacggatggcttaagaagttcactaaaaaataaaggtatttttataggcgtgcctctaaagctgtgcccgcgaaaatagattttcccagacggccggtcattagacctctctctacacaactacacatgcggacaatcatagtaaaaaataaggtccgcgtggaaaaattatgtgttccgttgtagagagattttttttacatatattttgttaattcttgtggcaaccataggagcctccttgtaggtgaaattagttaattagttgctggagagttatttattactagtaaaaatagagaatggaccaaatcaaatagtattagatttccaaaaggacacaacttgtactagcagtagaaggtcagataaatacgctagctaaacggtcaaaatggatagacaattaaagcagtaaaatttgagactagttctatattcatgcatgcatgcatttcgtccagtcagattagggtgcactagttctatattcatgcatgctttacacccagtctgtcctacacctaccttaattttcttgtagttctggatatcattgaaattaatggccacaattaggactaactaaagctgcccggctgaatccctgaaataaaaactacagttatagcgcacagttttgcggcctgatctgattagaagtcagagctgccttttcttgaattccagtatatatactatatagta

SEQ ID NO: 44817 - DNA, 1501 bp, Oryza sativa
cagcccaagaaggcccagttggagaggcaacaaaagcagcagcagcaggaaggttgggggcatcgattgatcacttggacttggtggagctgaagctctcgacggcggcggcgacctgggcagccggtgggcacccttgtcgatctctctcccctacctctcctcctacttacagccttctctctcagctctagaagcttccagaatttgtattacttagtttcttcttctcttttcatcccaaaacaattgttccttgtatggtggatgcttgctattaagttggaagaagtgggttgttaacaatctggtatcagagccgttcggttcattgggattcttgtcatggaggtgttggggaggcagccatgcaagagggagcaggaattgggttggggaagttttcatccaagcagcgcccaccaactgttcgatggaacgccaagccaacctgcgatgtccaagaaagatcagagcatatctgagcccattcccatcaattccaccatgaaaaaagaggagaaatggctagatgaagctttggatcggatattggagaagtttgaacaaatggaggccaagcgtaggtgtgatgagaagattgatcgaattttgaagaagttggacgagatagatgctaataggaacaagttcttcgaggagatgggtgcctctatcaaggcgaccactgccgtactcaatgctggatcatctctaccacccatggcaccgtctcctctagcgcctaccaagtgtttgacggaatgctccaacaacaacatcacttgggtggctgcgaattcaagtcacattggtgaggtgcttgctccgatagctgcctgggagctaggagacagaaaggacatggaccaagctccctacattgtcaccaaggacctcctcaaggtcacgcccaccaagtgttcgacgatatgctctagctctgacaccaagcccgatctcactgtagttgctccggttacttgcaccaccctcgctgtgtcatcaatggtgttgttagcttctgacggcaccactggcaacactaacattgacgcccctgtttgtttcaaggagacgcatgccatgtgctcgatggtcggcctcgacgtcaatggtggcaatgaccaagctgtggttgcattccaaaccaagacagtggtgtccaaggacgtttcagcatccgtccaccccatgggcaacctagcaaccagattattcgttgacaagatgatggtacaatgtgagctgcagccagtaccttgtgaaacgttcaactcctatgacacaagagtacatatcttgcaaccttggccgccgacaattaaagtaagttggcttgcactgatatttattgaaattggagtagctcacactgatatgatggataaagtgttgcattgggctgatctaaaaccatggcctccaccttcgggaaatggcagtgtgcatttcctgatcagtgcacatgcaagtgttgaattacaggaattagatttgg

SEQ ID NO: 44818 - DNA, 535 bp, Oryza sativa
gcctatgggataacgagatgattttttacaagtaatgggtcaccaaatttaataaaaaatcaacggttccatgttgtgccattttaagaatttctctaattttttagagtaccccgtgacggcttaggagcgtttgtaaaaaatttaatgaacttttagtatataatagatagattaaagatgatttcatgcttaccttaattgtgtaaggattcgaactcaagttcatctagccaccaaagcaacattgctatcgtgtgttattgggatatactttgctttatttgactgtttaactagcaactgaaccggacaacagtcaaaccgctcaacctgtgaattggatttggtatatacaacaataatagttgaatttggtaaagggctttgtgagcgttatggtcgcttcgacggatggcggcacaagagcaacttcaacagaatctctatttggctctccaagttaaaatttagctaacatagagaaaaaacgagctccaatagcctctgcatccggatagccaagccatccgga

SEQ ID NO: 44819 - DNA, 241 bp, Oryza sativa
tcttatatggttggtataagtttattttgcatccctcttctctttaggcgataagtttatatggcaactaagtttattttgggtccctctactatttttcttgctactcattggaccgtgtgccatgctgggccggcccgccaccgtgccaagtcatctgcacaggcatggctcaactgtcgggctgggccggcacgaacccgtcaccagtcatgccatgccatgtttgggtcgggccaga

SEQ ID NO: 44820 - DNA, 1501 bp, Oryza sativa
ttactgggccttggtttcatcaagattattctaaaatttgttgcatacgggagggcacggcgctccttcgctatgggacaaaatcctagtcttattgctggatatatggaagaattgtacagactacaggtatcagaagttgcagaggtgacaatacaaaggcttttagcactcgtggtaatgggagaagacaaacaacagattgagaaaggacctcatggttatcacttcaaacgtagcacttttagccagaacgggacaagtgcgatgacaagcaatggtaacttggtaaccattgacaaagtttggcatttggcagaaatgaatgatgctcttttggggccaaggccagcactgaaacatctctgcatgtcattctcattgtttaagcttctgcgaaggcgatttgctaggtacccactggttgaggcaggttctgagaaggcctttcactttgttcgtggtatattgctcacggatggggcagacgcagatcctgaagctgtgttcagggttatcacagatgagctatcatttgcttgggatttctattactcgtcccacccgatctcccatttgggtaagtggttgcccattatgagcatcatgacctcactctttaccatggcattttgcatcttcatcgtgattacactggcttggaaaattcttccagagtataaggactacagggtaatgtcctgcgaattaacatgcggtgaacaagataatgatagatttcatgatattggaagcatcttgttcgtgttggtgccaacgatctcccttcttctggtagttttgcttggtgaggtatgggagatcatatcttacgtttgctctaactggaccaaagttaccctggtttgcgcctacacagcaaagccatcatggcaaaagtctcgaatcatgagacgattgattgcttgttttctgtggtgcagatgcaagctcatgaattactggggtgacaaaatgggcatgacctctctattagatccttgcaagaggaaaggtcatattaggcacctattcaggctgtctaaagcaatgaagcctaccaagataccaaagccggtgaaggctgctctcatcaactcacttaaaggtagcaatgggcagctgagcaatggcatagcatctttgcagaagtgccatctgcgtgacgatattcgttgggcttgcaatggtgaagggacatctgacattattcttgtttggcacattgcaacttgcatctttgagatcaggcacatgcatgatccttcagaacgtcatagctctcctgatgagaatgatgatatgatcactgccattcacttgtcaaagtactgtgcatatttgctagcatcgtgcccagagctactgccagatgacactccatggtcaaaagaattgtataaatctgccaagaagatcaccgactctgttttgggcagcactgatatgaggtgtttcgaatttgaccgcatgatgcaattactgagtgaaaaatcaaaga

SEQ ID NO: 44821 - DNA, 1501 bp, Oryza sativa
ctcacgagatgaaccgagttaattacctttggcttgttaaaacaatccgatcgaaccaagcctaattaagtcgaaccttaacgatcagggctgactcgttatccaccacgctaatcatctttttaagatggtttgtgtcagaagtagtagtcaggaccgaggattcgaaagatgatcctctctagttgtactctttcttttcgaatcttcactagtgaaatgagacaagaatgtgccacatcatcttagaaatatagccgttggattagctaaggaaaaaacgtgaaatcaattttaacggttcgatcgaacttaaatactagaggtaaaaagcagagggttctagacccttcaagcaggggatgcacgaatgagaaaggaaataaagtgtggaaaagaatgatgaggtgtcattagcaagagaaggtgacgtgtatactgatagagttaaaagtagtaattcatgtgcccattcaaatattcaatcacattatcacactgttcacgcattctcataacaacaatttattctaccctgacacacctaacctctctttgtcacagtggaaaatttctcagagagatcacacaaacagagtggagtggcgtggatgttttgtttcttataagctgatacattttggaggtttataaaccacaaaatgccaaccaattgtatttgaaaaatatattgtgaaggaatatatttttacgcacagctaaattctataactttgggttttacgctaaatttcagaaatttatcataatgataaccaattatttattgttatgataatatttagttgttaatgataatacttagttattaacgaaagggcatctagcctagtggttacagtgaccgaagtagtacccaaggtcctgagttcaaatctcctatggagcgaatttcagattgggttgtttgggtctaagtttcatatttcaatggccgtatatatccggttggatatagaggccgggtaaaaaaatacccttctcaaaaaaaatatttgcgttggaactagatttcatctatgaacacctattctattacataatacatatatgtacgaagtagagaataagcaaaatatgagaggagtacaagactcgtgcaccagcggagatgacaagaagacggcaactcaagcaacaacgaataaggcggaacggaacacatggaaaggggaaatggtaatacagaagatgaatagaaatcctaaccctaagcactgcactcaccattttgttcaacaaatcatgaattgggcatttcagattacaagtctatttacaatattcaatacagagagacaattgttgtggtaattattgtatggaagctatttgatgttattaattgcaaatcatgataaaaaaatgttaattttcaagcaacacgtactttctgtcaagtatgttacgcttgcattgtatgatggtagtacaaatttaagcttattattataattaacatgtagacacatctaatgga

SEQ ID NO: 44822 - DNA, 1013 bp, Oryza sativa
ggcccaccacccatttaccccttaaatttagtttttattttttattttcagcagcaatttcactttagtccctatattttatgtaatttagtcgaaacagttcatcagttgtacaaacaattatgtaatggtcctatagaccactgatgttatgtgtttattaacataggtgtttatttaaataccttgtttcactaaatttatttgttgtcttaataacatgccttttgcatattatttcaagacacgctctactttctctataaattttgtattttgatttagcaaattctcttaattatgtccaacataattaatggaggatttaatgcatgttccacttcacactttaacttggaaattaatcacatgtcgatggagtcctatactttggtcatatcgaccataacttaggcagcgagtatctcgcccatcataaagtggtctatattttgagatgattacccgatggagccctagaaattggccgcactggtcataacttaggcagcgagcacctcgcccatctcacagaggtctacatctcacgatgattacccacatgtgttcttttccaagaatatgttttgagaaatgagattatttgaaatttggttgaacacaaggtagtggagttctaaacattggctacggtatattcaccataatatatttgcctggagaccgtattttaggcagcaagtataccttgcccactattaagagatctactccactgtttaattacttgaagattatccacattgtgccacctaatttcgaattctaactaaaaattgtcaggtccataacctacatctttcgaaacattacagaatatgaagttttacatttcgcattgagattacaaccttaatatcatgtttttattaatttacctctgtaaattgataatgttaaccatgattgtagggacatggaaacaaaagagttcgacgaactcgccctcgatgggactaactatcccatatgggtttctgatatcaaaatca

SEQ ID NO: 44823 - DNA, 1501 bp, Oryza sativa
acatgttaagagacacccaaataaaataaatctgacgtgtgtctctctttcttcttgttgcttcttgcaagttaaaccaaaccaacccaaaccaaagcagcagcagccagcaggaacagcaaattaaatttgtccaattaatgccatgtttagtttcaagatttttctttaaactctaacttttccatccaaactttactacgtataaacttttaactttttactacacacaaacttccaatttttctatcacatcgtttcactttcaaccaaactatcaattttgggtgaactaaacacagctttttttttcctggtttctttctgcttctgtgttcttacccacctttttttttcctttccaatttccatttcgtagtttactttacttgtttgttcctcctcttcttccctgacacgacacgaacccgaccacacgagccttctccgctcgcgccgccgccgtccacgcccatcgctcgccgtcgccccccccgcaattctcgtcgccttcgaggcgcgcgctggtccgccgccacgccggctgtgtgggggtctcgcttgcccagatcgcttcggctcgcctcttcttccccgacatcgcgtctccgcctttcctccccgccgccgcccacaggtgagctcctcgtatgaattctgagccacagcaattattttgcaaatgtgccaaggtagaaagcatcctgtagtacagagcaacaagctttttttttttttgcatgtgtgttcttcccccatgaagagacaagtgaacaattgctgccagaacttttgtttttcgtatgtgtgttcctccttcctgaaggaagagataattgaacaattgtaggagtcttggtaccagaactttttttttttatgtgtgttctcttcccctgaagagttaagggaacaattgtaggaagacctagtactagaaccactgcagtaaaataggggctttactatacagctaatgaaataaatataccttgtaggataccatgctaatgtgtttaaattgtgttatcttctgcctgtgggagtagcaaacaatccacgcattttttttaggatccttccttttaagttgaattcagggcaatgcattgaataaattcgtttgatctgttaatttatgagcagcaaggcacattctagtttcgtgtgaaaaaagatggatttttcttgcgtccacttcatgtttctgtttatcttagtatgtttcatttttgtcttatgcctctgaatatcttttagaaatgatttctgatgttgacgtttgagttcactactcgcttgaatgagtttatacatcagcatttttttttatttatgcagctctgaccacaagtctggaacatttctccagtgaccaagtgctcacactttctgcttcggtttcaattatgaattctcagtgactcagggagccatatttctatgggaagagaaaagctgcgcaagcaacgttctggtcgtctgattgaaaccctcaaaa

SEQ ID NO: 44824 - DNA, 280 bp, Oryza sativa
accaggagtaaagtttatggcgatctttttttccggttaatgttatcaaccgggactacaaatagatctttagtcccggttggtaacaccaaccggtactaaagattggaaagtacccctggagctttaaaaccgggactaaagatgtttttagtcttggtttttaatacaaccgggactattgtgaaatttagtcgaccgaccaaagatggtttctccaccagtgcatgtattatattaacactggtggagaaagggttattactaccggttcgtaacc

SEQ ID NO: 44825 - DNA, 1501 bp, Oryza sativa
cagatacacacgatcgaccaaccctaattattacatggtttcatcatttaactggatagaaatgactagaaatgcaggttaaactagaagacatagagaaaagatctgaatttctgcaggtactattgtctgcagaccaccctgtggtgctttttggaggcagtaatcaactcacctcagctgtttctgcactgaagtttactgcgtgcatagtcaaagtaggactctgaaaatgtttagtgacacatgtatagtaagcatcatctcagttacagtagatgatctgaacaatactgtttctctctaatgaaatgatgtttggttgctgaaaatggtttaatttgtacttccctgcactgacttaaccaacaaatctcaatgacttgtccaaagactcaagctttggattcttcttgaatgcagtgaattcagagcaaacatgtctgtactcaaccttcagaaatgggaatggcacaggaagaaaactaaatgcaagtcaacatgttagaattcatgatcagagaattcttgcagagccaatggtgttaattagtgtgctctggaatacattgaatccatgctaagatggaccacccaaacttgattgaattcggttcagtagctcatacaagcctggcaccatgggaagcacatgcaagttcaggtgtgtttctgacaacttggaattgatcaattaacaccttacttttttttggtaagtttcaagatgctccaaacggtacactgttaaaattgttactttcatactttgatctcttgtgtgtttaaaataaaaatttgatctctgtagaggtgcatttgagacccaaaactgttgaaggttcacaagattcaggaatagcatgttcatagcagaggcccagtgacttgcagtgatgggccttcagaatcatggtacttgtgctacttccatggcataatttgggcccattaacatagacataatccaagtcatgcaaatgcaatagcaaagaacataagctcatacagaattgtcaaaggataaaaagcaacaaattaaacctgcaaaatgtatcaaagtgaagagcttgaaaccggaaagaatatgtacacgatattgtatagtaactaatcaagaaaccagataaaccatgaaaaaaatgatcacctcttaggtgaccaccttttgtcatcttcaacaggtttcccacctctttggaaaactaggaagtaggaattatcaagtttcattgttcttcctcagtagtcaactcagtttcaaaaaaaaaaaaaaaaaccgatcgcgaaaagaacagttgctgttcttcctttatattctaaaaccgatcatttagccctgaccaaagtatgtgcagcctgtattgtatgaacagacaccgatttcgcgctttcatctccacacatttcagattgacaagatccaattccactaatatttgactacaaggttagtcaatctatattcaaaaggcaacaccactaattgagctgatctgag

SEQ ID NO: 44826 - DNA, 572 bp, Oryza sativa
atttcagtacaaagacagccactccagatattaggtggtggtagtacttgtcagtactgatagctaaatacagtgacatatattaactatttctttatgtcttattcactcggctctaggcatcattggtattctgatctagacatattgtaaaaggaaaaaaggaaaaagaagcattgctaaggcctagttcgcgaaaagaaaatatttgagtgtcacatcggacgtttgaccgaatgtcagaaggtaatacacgaatgaaaaaaaataatttcataactcgtctgaaaaccgcgagacgaatctgttaagcctaatttagtgcagcacttatagctaatcatggactaattatgctcaaaagatttgtctcgcaattttcatgcaaactgtacaattaattaattagattttgtttttatctatatttaatgcttcatgtatatatctaaagattggatgtaatgttttttttgttaaccaggcctaatactgatattctggccttgaaatgtactagcccatgctgcacagtgcacagctagcacgataaaatataatcttgacacagc

SEQ ID NO: 44827 - DNA, 1501 bp, Oryza sativa
accgtcgacccgaagaccgccgccgcttcttcctcgtcgccgccgccgtccgttgctcttccgccgtggttttggtcaccggtgagttcgccgcgtcgccctctacccgttggtgccttccgttcgcgtcgtcgagccgtcgttcgccggtgagcttgcgttgccgagccgccgccagtgctgacgtcatcgctgacgtctcgttgccgttccccgtgagccggtcgtggaccgtttgatctcggctgtccgttttggataggatcgatctcggccgtccattcccgtgaaccgctgccgtgcacccggtccaccgcaaaccctagtcgctgacgcaataatcctccttttccttttcaaaaataattcattattgcgtcataattcaattaaaatccatataaaggttttaatccgatttaatctttgaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacctgtttgtttactttttatgtattgtttatttggtttttattagtctttttcttcgttttgcgtgttagcttgtcgtttccgtcgttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaatctattcctttgttatggcctgtttgtattgattactttattccttgatatcttgggttattataacttaactagttgagctatatatattggttcagctagatattagatatgattgcttagccatgcttagaaacattagcacactattgggataacttattattcactattatttaatgatggattaatgatagttcacgatggtcaatcgtgattggttaaataattacttgccaactaaaatatggtaaaggtgggttgtgagcacatggttttgaaagtcgtgctcatgacgattaaggaccggttcgcgagctactattgtgaaacattaaccgtgccaaccacaagccagtgtgggcaacggctttaccttttgtatagcatggttcattgtggggcaccagactgagaagtggctggggagtccatgcctctggtttttgagggggtgattatgattcaggaatggtgcgctgcggtggattgtgttatgcgaggggtaatgtcacagctcctttccgaggtaccgtggtggtactgaggcacatggtgacatgttgtggggctgtgtcttgtg

SEQ ID NO: 44828 - DNA, 1501 bp, Oryza sativa
caatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctctctctctctcccccggcccagccggcccagtccgcagccgcgcgcgcgccctcgccgtcgctgacaggtgggtcccacctgtcggatccgtcgtcctcctcgcgtcggccgccgcccgaaaccctagcgccgccgccgtcgtcgctttccaaattcggtcgatcctttccttctccggccgaatgatagaggggaaatgatcctcgggatctcctctaccttttctcttttggaatcatcgtctatctcgctttggaagttcgtggattcgagatcgaatcggattcctctctctctcccgaacccgaagtttccttctcgtcgccggtcgccgtgggccttcgccgccgcctccttgcacctataaaaggatccccaagtccgccgctacccgccgccaccctcgcctttgctcgctgtcgtctgtagcgccctagcctcgtgcagcctagcgtcgccgtcgtcgccgccgcttcagccgtgcgccgccgtcgtttcggtcgtcgtcatcactcgggaaggccaccgtcgggatcgccaagtcgtcgccgtcctcgtccgccccttcgccgtcgttgaagaccgtcggagcaccgtcgtcaccgtcgacccgaagaccgccgccgcttcttcctcgtcgccgccgccgtccgttgctcttccgccgtggttttggtcaccggtgagttcgccgcgtcgccctctacccgttggtgccttccgttcgcgtcgtcgagccgtcgttcgccggtgagcttgcgttgccgagccgccgccagtgctgacgtcatcgctgacgtctcgttgccgttccccgtgagccggtcgtggaccgtttgatctcggctgtccgttttggataggatcgatctcggccgtccattcccgtgaaccgctgccgtgcacccggtccaccgcaaaccctagtcgctgacgcaataatcctccttttccttttcaaaaataattcattattgcgtcataattcaattaaaatccatataaaggttttaatccgatttaatctttgaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacctgtttgtttactttttatgtattgtttatttggtttttattagtctttt

SEQ ID NO: 44829 - DNA, 515 bp, Oryza sativa
gcagccctgtgagtgatatcagtgatcatcagagtgtaagatcccctcatccagccacaatatccgtttcctacattattgagcattgtgccgcactgtaacaattcatctagagagtatttggcacacatgacggaccaattgactacctcaacatgtagcaatttgcgtggttagacttggtcaaaaccaacggggcatgggtacagaaaaaaggatattaccaatggtcccgatcagaccccttaacttagctgtctatagctagctagtctctttccaagactttcttcttcttttttcttttttttttgaggggctttccaagactttctgcattgcctagagtatgtactttctcttgttctttaatttgctcttcttttcaaaatatgatggagaacactagcacatagtttagtccgccagtgcttgactactccacaaatgtcttcaaatggtgccaccatctgctagtccaaattccctgtggaccttggtatttccgtcttagt

SEQ ID NO: 44830 - DNA, 1501 bp, Oryza sativa
taatctccaaaccaggagctaagcaaattattaccaggtataacatctataattattgtgagaggtgtgagactaatcacgaaaaacattgctcaacccgcccataaccgcgggcacggctattcgaatagttttactctggccagaggtgtaccactgtacccacaagacacgatttcacacatgttgccatgccccgaagtaccaccacggcactgcaaagggggaaatcgtgacaatacccttcgcacaacacaactcaccacagtgcaccattcctggatcataatcacccccttataaaacaaggcatggactccccagcgacccccgtgggcttatctccgccacttctcagtctggtgctccgcaatgaaccatgttatataaaaggtaaagccgttgcccacgctggcttgtggttggcacgattaatgtttcacaacagtagctcgcgaaccggtccttaattgtcatgagcacgactctcaaaaccatgtgctcacaacccaccgttatcaagttttagttggcaagtaattaattaaccaatcacgattaaccatcgtgaactatcattaagccatcattaaataataatgagtcataagttatcccaatagtgtgctaatgtttctaagcatggctaagcaatcataactaatatctagctgaaccaatatatataaagcccaactagtcaagttataataacccaaggtatcaagaaataaagtaatcaatgcaaacgggccataacaaaggaatagatttacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaacaaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataacttttgcaacttgaaccaccttaaactgagttataatgaattagttatgaatttttaaagattaaatcggattaaaacacttatatggattttaattgaattatgacgcaataatgaattatttttgaaaaggaaaaggaggattattgcgtcagcggctagggtttgcggtggaccgggtgcacggcgacggttcacgggaacggacggccgagatcaaccctatccaaaacggacggccgagatcaatcggtccacgaccggctcacggggaacggcaacgatgacgtcagcga

SEQ ID NO: 44831 - DNA, 1501 bp, Oryza sativa
attgatgattaaaatagctcatactcccttctttcacacaagttagacatataacttttgtgaccaagatcatgtagacattaacttatcttacatgtaacaaagatatacacgcatgcaaccaatgagtattaagattactcctcgggttttaatcatcaaacatttaatttacctctccatttaagttttggattcatacatagaataacttttttggaaaaactaaataaaatatgaaatatatctaactcttgtggacggagagagtactataatacggttttatttttgttgttttataggtagtacatgcaagatacaaaccgtgtagacattattttatttcatacttcattaattttttaccacactatgaaaatattgatacgacaccctatttaatgagaatgaaacttccactaaaaatggcctaaaaagaagtggtaaaagcataaccactcttaaaaataggaaacataggagttgaggtcctctgcattgaaaaagaaaatgcagagatgctacagtacctttcattgacgcatggtttaatctgttggatcttcatcgaatggtacaaaccatcttgctataatacctcactacagtaaaaaatacccaacagtatggattactgttagaatactgtctctagtgtgctaatagaaatcactgtagcgcgagactcggatcactgtgcaaacagtgtcctcttccgttactgtaaaggacctgcatccgtaacatagttgcccacgccaccggaccgctgtaatccccagctgccttaaaagttaaaattagcagcttgaggcctggagtgtatgctctcctgcgtgatgcttgcaacttgtgcatgaccgagatcgaccgatcgaggccctttggaactgaataagttatcccatccaaatgaactaagtcaagtcaactaagtcaagtcaacgatccaacttgtacttgccaaataatgggcatctcatctcgatcggccaatgcaaagccgtcgatcgtatcagtcacggtgcgcagtagggccaactgataattaaaccgacggacgatgactcagtcacacaagaaccagtccacccgaggatttaagttctaaatcggacagcaagatgtctgatgaatttattaatcttaagatataatggtcgctgatgactttattaatcttaagatgtaatggttcaatgtctcatatgtgcttataatggtaggttgtacgtacgtgcgtttgtgggcacatgtgttcctactgtgtttttaaaagggaaaaaaaatattggtcttactaaaactgaatatgacatatcttaatacaataaatttgaatagcaattggtatatgtcatatctggttttagatttattttttgtgacatagggagtacttttttttttgcgggggacatagggagtacttaacaagagctgcatggctgcatatccgcttgcttccacagttccacttgcatcttggagccattca

SEQ ID NO: 44832 - DNA, 1501 bp, Oryza sativa
ttcaagcgctaatataatagacgagtttccagattgggtctctacagcattttcaaaggccatatatttggacatgtctaataacaaaatcagcggtaacctgccaaaaaatatgaaaatcatgtctctggaagaactctatctaaattcaaacagaataatcggtgaagtaccaacgttgccgacaaacctcacctatttggacatctcaaataacatactatcagggcttgtcgcatcaaacttcggagcgccaagactagatactatgaatctatcctcaaacagcatccaaggccagattccaagttcgatttgcaggttgaaatatttgagcaccttggatttatccaacaatcttttgaacgggaaacttcctcgatgcattgggatgagaaatcttcagaagcttctactaagtaataataacttatctggcacattcccatctttactgcaaggctgcacactgctacgttatatagacctatcatggaataggttttatggaagattaccgagttggattggagacttccaagaattagtttctctacaactgaggaacaatactttttcttggtaatgttctttcactgaacatagcaagaattactctatgtatatgttaggtgcctcaaggaaagtagtcgtattcagaggtacagcagcgttgatgagaatgccgtgccatgttcaatgatgaggatcaaactgcttatctggtttgggcctcctgaaaatacttgcatcaaagcaactatataataaagttagaggtctgtcagtaaccttctgcaatggagctcaagcttggtataatatttgctattgtcttccttattcgttgatgtccgttgttagtttctattgtaagttagctgttaatacatgtacaccttttgtctggtggtggtgtgaaaggagaaagaacaagatgttgagccactgaagagatttgctctggtcaagcgaaaagtatctcacggtacctcaatgcactttgagaccaaagatagtatcgtctctcctacctctgcagttcggctgccagcgcagttggaataatttctcgtttactagagttattcttcctcttctaaggaaatattagaaactaaattatatatctaaccttttctagttagcacatggcccatacttttaagtacctttccgtaggtatcttttattatagttttttaaaaaaaaataaaacatttttattgaatttgaataaattataaccaaattcacaaatatttgaaaaaaatccaaaaattttgctcgaaatatttgcttgccagaggaggggggtgaaatttccatccctgcacctcccttgcgcactgctctcctcacaagagctagctctgtgaggctttcggctaaggggacgaaaactggagattgccaggaagagaagaagcaagaagagaacatgaaggaggaggagagggaagaaggggtgctgaatgccatgccactatggatgggaggc

SEQ ID NO: 44833 - DNA, 1501 bp, Oryza sativa
actcagcaagccatgggaaataggtgtttattgcaggcttcaaggaaaggctgttgtttttgcaattgatttcatttgaactctttctgaagtcaactaagtgagtgcttctcaaacgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctagctaattccatcagctacagatttttcaatcatcgaacccttttccacaacagcaatttcacaagcagtagtcaatcaaaactacgctaggaatcacctcacctccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccaacaaaggtttaccatatgccgacgagaggggtcccagaccaacaacaggttaggtcccagaccatactatgccaggaagcccaggagtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagaagttactcagaattttaagtttgaaggcgtccgtcgatactcgcacagggtgcacgaataccgagacgcaactagatggttacaaggggacatggtatatcaattagcaaaggaaggatcaaatgcaacaaattaggtaagtccgccgatctgccttgcagacgggactacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgtgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagaaaagaggaagggaatatagacttttctcgggcggctagggcgcggcccaagagaaa

SEQ ID NO: 44834 - DNA, 1501 bp, Oryza sativa
tggattcgccggggtggtgtcggggaggactcctgggcttcctggcatagtatggtctgggacctaacctgttgttggtctgggacccctctcgtcggcatatggtaaacctttgttggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggaggtgaggtgattcctagcgtagttttgattgactactgcttgtgaaattgctgttgtggaaaagggttcgatgattgaaaaatctgtagctgatggaattagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgacttcagaaagagttcaaatgaaatcaattgcaaaaacaacagcctttccttgaagcctgcaataaacacctatttcccatggcttgctgagtactcctgtactcacccttgctctatataaataaatcccccccagttgctgaagaagatgaagcggatcccgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctcggttgctgtgataatctgtcttcctgtgataccagcactgttttctgggactggtatcgatttacaggttaatttggagcgtcacgggctagttccggtcggtactagttcggggcgtgacagtcaataacagggagttatggcaaatgatgattttgttgatctcaacatatgttgacagttttctagagatgctcatatatatgaataggatgtgtgtgtagtcatagagatgagtaaggtggtgtttgaagtgtttcatgcaaaacgaggtggtaataacatgtgattaattgagttttaattgatacaaacttgaaaatggattgatctgatattttagaacaacttttatatagaaagttttcgcatgaaacgcattgattaacagtttggaaagtgtgccacgaatatctaaaactttatccactctctgtagtagaaacaacgaagccaagcgtctgcatttatattatgtttctaaaaaataatttgaaaccttgactataaatttttaaataacaaattgtttgcatagatcaatttgtcttaaaagtattatcacaatatcataaatgtagtatatttcatatacttat

SEQ ID NO: 44835 - DNA, 1501 bp, Oryza sativa
aaaccttgactataaatttttaaataacaaattgtttgcatagatcaatttgtcttaaaagtattatcacaatatcataaatgtagtatatttcatatacttattttcatataaaatagatctaagtttgacaaaacaaatcactactacaaaaccatctttcgtggcggccattttaggttttcgctagcagaatttggtaccgccataaaccaaaagccagtgaagatcaagatcttaagccagctgccagcaaagatccattttcgctggcggttggattaagacggccgccagcgaaaataaattatcgctagcggctgtgttaaatcggccgccagtgaaaatctattttgggccaaaaaaaaatacccatgcagctgcccagccgcaagcgtagatgatttggagaaaagcccattgattcattttcaaaattcaaatccacatctagagatctagattcgatgctcatttccaaattcaaacatgaaatacaaaatcatcatttacacagatcaaacatcatttacacagattaaaacatgtgcatcatctggaacaacatgcaaaaaaaaaattcaaatcgaagaggagggagctgggagcatggtcaggacggcgtcatggtcggagaggagggagccgggagcatagtcgacggcgtcgaggtcagtgccgccctccccgtggtccggcggtggcggatccggcctccccgcggcctggtggcggcggatccgtcctccccgaggcctggcggtggtggatccggcctccccgcccgcgcccaagcgctgccgcccgcgcccgaactcgtcgccaccttcgctgcgcagtcctccgtcacccggcgctggaggattggaggaagagagggttggagggagagagggagtggagaaaggaggaggagagatagcataaggacaaggctggtgtgggggcggtcattttatagcgttaaattttatttcgctgacggtgttgttacatgccgccagcgaaaatcggacgccagcgaaaacccgatttttttatgacgggcctcttagcgccgccaccataaaatagagctgttttttgtgacgggcctcttagcgtggctgccagcgaaaaccgattttcgctggcggtccgtaacccctcacctctcgttacatttttcgtgacggtttttgcctataaccgccagcgaaaattatagggcaacaccataaaaaatctttttttatagtgaattaacccaatcttatcctaaacggcaaatatttatgaactgattttttggatggttctactaagatgcaaatcgaccatacaaaaccacaaaaaagcacgtccatcttgcatttcatgtttagcatttaacttaacaaattttctacaacaacacacggggatttaacaattatcttgtaaaattgatccaaccaagtgtagttgttgatatttcctttttttttataatacagaaccacttatattgaattaattattc

SEQ ID NO: 44836 - DNA, 1501 bp, Oryza sativa
gtcggcatccatcaccacaagttgccgctcatcttcaccaagatattggcactcaccatcatcgagaagttgttgctcgtcatgacgaagatgacgcctctcatccttgccaagaagtcgttgtctcatcaccatctaatcttttaccacatgctctatggtatgcctctctcccttaaaaataacttgttgtcttaaccttatttgtgttgcgttatcaatgaaaaattaggctatgggaaatatggaagttgatccgaaaaaaaagggttagggcaggcttttgagtagctttgttgctcggttcttgcattctcgatgtcggagttgtagtctcatcggagattagtggtgttgcaattcctactcatgagtaaggattagttgagattagattaaaaaatagaaaaaagggatttgttgggattagataaaaaaaataatgcatacacggagttgcaaatgagctatagtgttgatatgttcgttgccaaaataaattataagttgcctaaactagcctccattacctgcaattctaaaatcttcctcttacaagaaaaaaagttgagaaaggaaacaaaccaaatacaacttacacatttcaattttaccaaatattgacaattaggcatcaaaattaagcaaccacctaatgaccttgtaatggcaatttttgaaatcaacggcaagaaatcatcttaaaccaaaggttgtcctagctgtcaacacacacagaaatgcatcaatgcgatttcaaaaaccaaatatcctagtagtttccaaagtttatcgattccaacggtacaaaaccgagatacaattggcaactggtaaacaatttcccaaaattcacaccatcgcctgtactttacaagtccactgtaggtctactactttagtacaggtaggttgcctcttcggccacccgcgcgcgcacacctttccattcccgccaccccgaacacacgaaggtaggttccccacctccactgacagatgggccccacagttaacgcgccgctaacctgaccccacctgtcagcgagcgccacacaacccacccccgcacgtgaaccccaccctactcccccctctccactcaccccactacgcacgggcgacacagcgtgcgcgcacgcacaaatgtacccacccacatcacctcacctactggtgggacccacccaatccagggcccatacgtcagtgagcgtagccgagtgggctgggtaaccgaacgcgtgcaaaagagggcgagcggggtcgggtcaccgccccggtgagcccccgcctataaaatccgcgtggagaggcagcgagaaaatctgaccgttgcaatcgcggcttttctcctcctcctccgccgctaaaaccctcggctcaccgccgccgacgacttcgccgccggcgagcgagaaggcttcgacccaccaaccaagacaagttgtattagctagctagcaagccatggtgagcacccggggggccgcggcgaatg

SEQ ID NO: 44837 - DNA, 246 bp, Oryza sativa
aaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcattacggaaaactgtgcga

SEQ ID NO: 44838 - DNA, 1501 bp, Oryza sativa
aatgagatgaagaaaattagtagtatatttctttgtttccctcgtgtgttttgtcattttccagtaaggtgatgtgtgatactatctggatattcctaccctcatggtaaaactgattttgcattgccatctcaaggtttgattcttcttgtttcggtcaatcctacatcacatttatcacactgaaccttgcttagacagcctgtaagtaagcaatcatccactggatctatgattatgcatgcatctagctatctttaggccaactcccttagttgtttgagtttgaccattcacattatctcttcggttctataattctccaccttttggacaaggttaagatcaaacttttgtaactttaactattaacaactttaaagctatttagtttagaggcattagaataatatatgtagatttatcttataaaatactacaatgaaagtgaaatttatcaattcattgtatatattataatagaaaaacatagtcaaagatatattttaaacaccgtgttattattcaaaacgttaagaattatgaaagaagagcgagtagctgcaagaggcactagctaagctataaaccaaacagtgcacgcttccattgccatctgaaaacggcatgcttttgactaatcgtggagcgaagacaacaacaattgttcagaagcggtgggtgtgttcttttggagggttgcctgccatccgcacgaaaaacggtgcgatagattaacacgtgattaattaagtattagctataaaaaaattaaaaatgaattaatatgattttaaaataacttttctatataaactttttgtaaaacatgcaccgttcatcagtttaaaaagcgtgcacacggaaaacgggagatgggttgggaacccattggaaagaagacagcctgtggcatcttcctcttcttgttgtcatcttttatcaatgcaggaagatacaatctagaactgataacggcatgcacaacagtccaggcatcaataacatcaagtacaactatgtaatgacgtacttgtacctaagtagaaacgatgatcccaatctcgtgtacttcccatgacagttccctaacatcggtatctaagcaagattagctcatctctccagctgtactattttttttaaagatctaccctctaggatgtaatgagtgatgactcaaaagtgctagtctggttgatgactcaaccagcgtccttttatttcgagctgtagtcagtgtccttcacgaaaggagaaacgaagcagaggacacaaagtttagttcagatttcttggtcgtggcttattttccccccattttttccttctttttcttaagaagaaaaactaactctgcagtgagaacgcaaatatgctcgtgggccccattcagagaagcagtgacgatcgagatgacgaaattaacgaaaacgaaaggatacgagagaccgtttcgcgtgcgggcttgtggcactggcacctagtacgcgcgcaacga

SEQ ID NO: 44839 - DNA, 1501 bp, Oryza sativa
ccaaccatcctgaacaaccatacccggctgtacagatctaatctccaaaccaggagctaagcaaattattaccaggtataacatctataattattgtgagaagtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaatccaccgcagcgcaccattcctgaatcataatcaccccctcaaaaaccagaggcatggactccccagccacttctcagtctggtgccccacaatgaaccatgctatacaaaaggtaaagccgttgcccacactggcttgtggttggcacggttaatgtttcacaatagtagctcgcgaaccggtccttaatcgtcatgagcacgactttcaaaaccatgtgctcacaacccacctttaccatattttagttggcaagtaattatttaaccaatcacgattgaccatcgtgaactatcattaatccatcattaaataatagtgaataataagttatcccaatagtgtgctaatgtttctaagcatggctaagcaatcatatctaatatctagctgaaccaatatatatagctcaactagttaagttataataacccaagatatcaaggaataaagtaatcaatacaaacaggccataacaaaggaatagattcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacgaagaaaaagactaataaaaaccaaataaacaatacataaaaagtaaacaaacaggtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacctttatatggattttaattgaattatgacgcaataatgaattatttttgaaaaggaaaaggaggattattgcgtcagcgactagggtttgcggtggaccgggtgcacggcagcggttcacgggaatggacggccgagatcgatcctatccaaaacggacagccgagatcaaacggtccacgaccggctcacggggaacggcaacg

SEQ ID NO: 44840 - DNA, 1501 bp, Oryza sativa
tctcaggaagtgggtccaacagcataaaaatcatcatgcattatcccatcccacacaagttaagaattttgagtctagccaagtgtaatacacgtcccggtgctcaataaccgcgagcacggctattcgaatagatttggtttactcacactgcagtggatgtacactttacccgcgctccgcgactgcccaacacatgagcctcgtccctacacatgagacgcattacggcaaagcttttcgataacctcgcattggcagtacccgctccatgaactttatatcctcatgcactataggcgtacacggtttctagcagtgagaggagttctggcgcacccgggaaggaaagactcatacatgcattaagttataattatgtttaaattctcacatggcagtcctaccgatggcgacaccactgtagatacccgcctcgcggttctaccaatggatgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggtactagccttttccggataccacccaaatcctccgtctgccccagtcgaaaacaattgtttaattttatttctcctttcacaaatcatatcatcaacatcatggcaatgtggcgctcatgtctccacatgccgcatctcaataccttcccaaaggtaattgcccaagcatatagcatttgataaatatgagtatgcatgattctagagtagcatttctaagcatttgtcatagttgactagggactcatacgtaatcatggttacaagggaataagggtaaacaataatcaaggcatggcatattcaaaaataggatgttcatcattgcatgcaatcttatttgtaaataaaaataatttcgcaattgggatcaacatgttcaaggaatagtgatgacttgcctgctcagaataatccttattattgatataatcttgatcaaccttcacctcctggaaattgcagacgttgcctcacgactaaccgatacacaaggtctataatacgcgagaaaaaccaatattcaaacaacaatcaaatatgcgcaacaaaatatactattcgtgtttgctaatggattccaatcatgctaagggctaaagtttcttaatctttctattgtcatcgtggtctatttaggagttaaccaacatggcatttatggtatacatatatatttggctaatcggtggtttagtctatcaaatggctatggaaggattatgactatatatgcatctatctaaatagcacggttacataccagaggttctgttgttagatggatttattattatttaattgatggaggctttactttaattatgaacatattttacttgtcacaataaattataaaaggttaataattatcca

SEQ ID NO: 44841 - DNA, 993 bp, Oryza sativa
atgaacaacatatatctgtaagattcagtggcaaaattaacaaaacggagaagaaaataagcatgtttatgtcaaggagcaggcggtacctggcgatgttccattgactgaagatggggagcaaaactctgacgaagttgaagatcgtcaagctggagctgtgcagtcaaagggaggcaatctgcgtcgtactacaaggcctgttaagcaaaaccccaagtactgtgggcctaactgggccatgtaatagaagtccatattgtaataggctagcgtgaacaaggggaaagaagagagagataggatatatatatcagatcagcgagctcgagggaaacttgaatggcaaccacggtggcgtaggcggcggcggctccattcctgttggaatcggagaagactactatattgagttgccataattcctcttgctctaattctctcatcgttgcaattctctctgtaatttgggtgtgagttgtgggttgttgacaaaatttagtatcagagccactccgctccgcagatctccttggcttggttgtaaaatcccagggtaggattggaactgttcttcggaactgattctgcgaaaaggcaacttgccttctcctggttagccgagttcgggaagcgagcgagtgattctagtaccaaactgttccgtggagtcgagtatgtcgcaggaaagtaagttagatcttcttctgaaggtggtcgaggagaacgagaggaagagagtggcggcgaaggaaaggactcgagcagatttcgccgatctgaagaagatggtggaggcccgactgccggtggtggaaaagaaggtggagacactcagcgtttcggttcaaagcttgagccagaaggtggagctgatggaagggagcatgctcaaatctgaaccaccaacggaagggatcgggaacaacgcatcttggcttgctagtaagcgtgatccaaatctttaaacccctgttcattttgctggtaagg

SEQ ID NO: 44842 - DNA, 1501 bp, Oryza sativa
ttgatctgtactgctccaatccactgttcgtatagtattaatttttagtaatttttagctcgccttggctacccatcttagtagagaagtaaagagagagaagaatggtactcttctcctatcataaatactaattgatttagcataaatttagatcatttttactggtactttgatacgtcatccctgtttcagtcgatttctaagtccgttctcttttagaaataagaagaagtcgtataaaaaatctctttaaaaaactcgtatgctaacttgagacgattggacttttaattgcagcttacaattttataaaaaaaatccaagcgaacaacagtaataatattaaaatagcccttcacccactgcaacacacgggcattttttctagttatgataaatataaaaggttttgttactatggcaatgccttcttaaggtgaatctctgtagtgtaacattttgattttatcacaagtcaaacctctctgactttaatcttgtttatagaaaaaaacatcaacatcaacacatactaaattagattttatcaaaaccatcatgaaatatgtcttgacattgtatttatctgttagtgcatttttctataattcagtcaaagttagagaatctcactaaagacaaaaagaataattttcaatatgaaacagatgtggtgtatatttgataaactattgatcaaatgccaaaatatttataaccacagtaacagaatagcagtaaggcaaagccatacgatacgacgacagtcagcatctatcgtttgacccgtatataaatgcatggtacgaacgctaaaaaaccagcgttactacttgatgaaattattgatcagattggcagtagctaggcatgctttcatttgatgggtttttttttttactggcataggattcgccggagttgaggtgaaacttgtgttctttgtacggcgtgtccggccaacaaaagatgggcagcgttgagagccaatgcaaggcaaaagggttgagtttttatcggcagatatggaggccggaatggcgcagggcggtcggtcggccggccggattcgcgcgtcggagcatgggtcactactcactactgtagtcccttttttccctctgcaaaatccagccctgcaacctgcatcattcctgctctcatgttctatggcttcttgctgattcgttcaaaaaaaaatgcattgtactacatttgtagcatgagtctagctctgttttgaaaacgcgggattgaaaaaacagatgaatagaatttttttttaagattttgctaggaatacaagtgcaaaatataaagttccgaaaacggaatgatcgtttggttaggagaaaacgtaggaatcggatagtaaaagatatagactcaaagggaattttccaagaggttagagctcttgctaaccttttctccaaaatctctctctctctctctctctctctctctctatatatatatatatatatatatatatata

SEQ ID NO: 44843 - DNA, 1501 bp, Oryza sativa
aaagttcgcggcttgaaggatagatctaaagacatcaactctaaggcccactttgcgatccacccatttgctttgcgattgtgaagtatatccctgagtggaaacgatgtaaccaccgtaaccgagtgaccttgaaaatactgagataatttcctaacagtaatcaaaacgccatacaacagcttttgaacctgaggatatcttgtcttggagtcggccaaaacttcgctaacgaaataaattggtcgttggactttttgaacgtggccttcctcctcacgctcaacaaccagaaccgtgctcacaacctgggaagttgccgacacgtataacaacagcggctcttgcgaatgtggcgaagctaagaccggtggagtggtgagaagtttcttgaagtcttcaaaggctttttgtgcttcgggtccccactggaaattgtcggttttctttagcagcttgaaaaagggcaacccccgctcgccgagtcgtgagacgaactggctgagcgccgccatgcaaccagttaacttttgaacgtctttctgggagctcggcggtttcatgttgaggatggcgttgattttctccgggttggcttgcatgcccatatgggataccataaagccaagcaacttccctgacggtactccgaaagtgcacttttcagggtttaatttcatcctgaaggcgcggatgctcgcaaaggtctcttctagatccgtaatcaaatcatccttctgcttggtcttgacgactacatcatcaacataagcttcaacgttacgacctatctaagttgaaaagcatctctggatcatgtgttgataagttgcccctgcattctttaatccaaaagggatggtgatgtagcaataggccccgaagggtgtaataaatgaagtctttaagcagtcggactcctttagtcggatctgatgatatcctgagtagcaatccaaaaaactgagtagctcgcagccggccgttgagtcaactacctggtcaatacgaggtaacccgaagggatccttgggacaagatttgttgaggtcggtgtaatcaacacacatgcgccattgtcccgtcttcttccgaactaggactgggttggccagccagtcaagatgaaggacttccttgatgaagcctgctgctaacagcttggtcaattcctccttgatcgcgtccttcctatcttgtgcaaaatggtggagtcattgcttgataggtttagcatcttccttaacatgtaaagagtgttcaatcacctctctaggaatgccaggcatatctgtcacgctctgaaattctcctccttgctttaaagttcataaaataaatcgtccgaagaaattgtttaatttaacctagagttgaatccctaaattaataaatgcaaataataatcggaattggcttgttgaatttttcttggattctacatgtcagaatatgctaacaggatctttagtggaattttcagagcccaagaaataatttt

SEQ ID NO: 44844 - DNA, 1501 bp, Oryza sativa
tcgaaacaagatttcagcaatactaaaagggggtggctatcaagctagaaaagttgatgggttgaaagacaaggaattttatacaggttcaggccttcttaatcaagaagtaataccctactcctgtccggggattgatccgccgagtatattattgatcgtatgatctgggagaaaatcgtgcccctagaggcacccggacccctccttatataggggaagtggtccgtattacaaaacacaatccatatccctaacggaataggtagttacagataagatacaatcgtaaccgactaggatcacgcgcatttccttgacgtacaagtttggaatttaacccgagtccctttaaagatattctatctacacatggcaccccatacctagtcggactatacatgccgtgtaggtatggggtatccataatctccatagtagcccctgagacctttacagtcgatgaaatagtcttctctcgtaatccaaaaggataatgcgagtgctccaacttcttctgctttggcctcccgagtactaagatcaaagactgtgaagggctagaaatagaaacaatcaggtgcatcaattagatgcacctaattaggtgtagcctccgactatgtgattagttaaaaactaagcatatagccaaggtgcaaataacatccaaccgagtggttttacaaccggatcatccatggtatcacacagccaagcatatgcgacgtttaataaaacatccagccgactgctttagctttgatacaccagaaaaggagatataaaaagtcccgagtgagaaacactctaaaggtttataaatcaacacatatgataagaatcctagtaaaaactctcgaaaaagatccatcaaatgtggtataaatcatgacaataggtgaatctaaattgcctaagctatgactcacaccatatcaaaataagcatataacatgccaagagaatgaccattcaaaaaccagtcatctcaacaaaacccgaacagcttttgcagcctaaaaaggcttacaaaattagtataacacttttccgttgggcacctttttatttgcatcgtagtaattccaaagaattatctaactacgtcaaaaaggattttaacagcattgggctatactgttgtgagcaagtgttgccgaagcaaaatgcctaagtccctaaggatcacaacttagacacgacgagatagcaaaattgggctgaagtactgtttaggcctaggcccattagtactcccgataccctaatgaaataacaccgaaagcaaagcgtcggttcgtcttccccgccgaaactcttgccactttcccaattctctgctacggtgtgaaaccgcgcccgcgaagctagggttcacagattcgctccaatccatcctccaaaactccacaagaatctcccacgcaaccaccgcatcaatctcccatccattcccagccacatttcgaaccaaatcacatcatccagttcgcatcca

SEQ ID NO: 44845 - DNA, 349 bp, Oryza sativa
ttttcctctcaaaagatcacaattttttcatcttcttctcgtgatatcctttgttttttttcatccatccatccattcccctttgcacggttgagctcgtctcacagttgttaattaacagcaagaacatttttttccttaaatttctatttaatttatactacttgcgagcgagagccacctaatcttggtgcccaccaagcataagcttcatcatcttcttcttctttgaagtcgtcttcttccctcctcctctcgtcgcctcttggaaagagagagagagagagagagagagagagagagagaggtgatcgagttgcagcaatggcgaggagggcgccatggctcg

SEQ ID NO: 44846 - DNA, 1501 bp, Oryza sativa
aattctaaaattgtaaccatgccactccagtcactttctccgtcctcctctctcacgccgtctccgttcccgtcctcatcccgaccaccgcggtggacctcccggcgagggaaacgtcgacgacgaactaggcaaggaggtccgagtgagtcagatcgacgacgacaagggcgaatccgaacaaatccacatatgctcgacccgatcgcacttagcatcgatgacgacgtggcgccgccagcctccgccttctgctgcgccgcgccactggacgtcctcgcccggacgagcaccgacaggtccccggcattgtcgtcgccatccgccaggctcatcatttgctgccttgagcaagacgcgtgcgtcgacttggccggcggcatcaggtcgtgtggcgcctcggacgctgcgcctggcccgccatgctcctcctccaccattgccgcgtcgtccttgcaaggctttccttcgccgccgcagccgccactaccggcgcggtcgccggggaaggggatgatgctgttggacatatatgaggtggagtggatcacgcgggagttggagagggtgctcgtgagggagagtgggtgccgcaacggtggtggtggcggacgagcgggtgatgggcaccgtagacggaaggggacgacgaggaaggcggcgaccagttcctacatgaggccgacgactgacaagggcggcttcatggggaggcacgccgtctccgtatgcggcgacaccgccaccgccgccgtctcagtcagcgaccgtgcgtggcgagggcgaggaagcttccgggtggtggagaaggtgtaggggtctcgaggtgttcaagtgtggattactccataggtttggtcgtggatgtaggtttatgcccgtcgccgtcgctgtcggcgcctgggccagcagccgcagccgccaccaccgctgcgatgagcgcctcgtagaagaggtccgagatgatgtccttctccagtgagtcggtgagagcgaacaggaaccacaagccagcctcgtcttcttgcaccgccgccgccgacccttgcgtaggctacgacgacggtggtggtgttgtccccagcagtggtgacctgggagcgggaggacgggaaggagggagggggataaggacgggaacaaagacggcgtgagagagcaggacggaaaaagtgactagagtgacataattctaattttagacatttcgagtggcatatgtagctgatatgacgaatagtagtggtatttttttaatttagaaaagttgcaatagcatggatccaattaacccccttttttttttataataatggctaaaatttggcttggaaagtcacttggagaggctgttggatatgcggtgcagctatatttgagggagtcaaagtggacttacttccgattcaaaagccatggcggagcatgggccgtttcactcgggccaatgaggaggaggacccggcctatgtagggtttccttcctctttctctgtctact

SEQ ID NO: 44847 - DNA, 365 bp, Oryza sativa
  unsure (1)..(365): unsure at all n locations
aaaataggaacatggtgaactttggatgctattaaagtgaccggtaactttcggtgctataaaaccaaaaatgtgncctttcgatgctatataaccaattttgcctaaaaaaattaagacatgcttaattacaaaacatttgacgacaaattaaggttacaatgaaataaatggtgattacatttttttttcaataaggtgtatgatcaaacacatataaaaaaaagttaacgacgtcatacactgaaaaactgaaaaacggaaagagtatcatagtatcctcttcttcgtctccggtggggacaccatcatgcgccatgaatcgatggagtggttgatcgagctccggtgaggatgggtgcgtg

SEQ ID NO: 44848 - DNA, 1501 bp, Oryza sativa
taaaaaaatacgtaagacttccggttcttcttttcgtccgtctccctcttgccaaaatacgttttaatccgcttaatagtcggtcggaagttttctaatctactccaaaaccttgcttaatatatgatatgtatcagtaatgtaaccatcaatcacaagtagtagcttgcccacctggttggtggagaaaattttcaacctgcccaccagggttcgattcccatcatccatcctttttatatacggctatattgctcggaataagtctactgtgcctcccatatctcaaatcattgctcggaataagtctactttgcctcccacatctcattacttcacctttcctaggttgtattgctcggaataagtctactatgcctcccatatctcaaatcattgctcggaataagtctactttgcctcccacagctcaaatcctactcagaataagtctactttccctcccacttttaaatttgaaaattaaacataattatatttttcttttcatcatctgcaaaacatgacatactagagtccgcgccatctatttgcacctctttcttcaacagatagtgataaatcttataatgaaccagattttaatttgaaaattaaacataattattttttttcttttcatcatctacaaaacacgacatattagagtccgcactatctatcgtccacgcatgagccatgaaaatgattcgtgtccacgcaagtccgtgttcgattttagaaattatatcaagcgcttgccatgaatccgatggctaaaaaatcagaagtttttgcacctctttcttcaacagatatttagtgattctgaaatcttataatgaaccattttttaatttgaaaattaaacatattttttttcttttcgtcatctgcaaaacacgacatattagagtccgcaccatctatcgtccacgcatgagccgtgaaaatgattcatctccacgcaagtccatgttcgattttagaaataattatattaggcgcttgccatgcaagagttgagagagagtgcatgttatgaaaatatgagtatatcaatatgcaatagtgtttcttatcagtcctgattatcattaacccactgaataatttatctatgttggaacattattatatacatgttaatggtgtatgtatagcatttaaccttttattatacccgtagcgaagcacgggcattttgctagttaaattctaattaaatgaaatacacattttctagaatattagggtatttttaaggaggtaggtatataattaaattaattttcaagtaaagtaagtgtgagaaataaaatattatggttggatttagtttttattaaattttctatattaattacactctttgcaatttttttagaatttacatagcttaattggtaattttgataatacaaatatcatttcagcatttatttaaataaaaattattttttctctatgggcctttttcagcctattttttttcttcagc

SEQ ID NO: 44849 - DNA, 1501 bp, Oryza sativa
tttgactctatttttcctttagtatggtgtctgctctctggtgatctaatgtaccattttctcttaaccttgttttacccaatcttaatgcaaagatgcataaagagaactctgcatattcctgttttctcttaaccttgtttcagagaaccttgttttctctgaactctgcaaaagattttctgcatattcctgaaaaaaggagaactctgctccggtgcttttaactagacttataaaggctttggcataggattcctgtattggttgatgcaaaatctgctggtaacagtcagctaaattcgcttaaaaagtacacttctttgggtcttcttgctagtgcaggtagagaagcaccatggccttcctggtttcttaggtggtaaacaggcaaagaaagtaaagcaccaagtggcgccattgctgcaatgaaatcaaattattattagcaagtggatgaaaggaaaagaatacacagcctggaagagctttcaacttgaatccccttgcaattgtgtaacactacttgtccttttcacattgcatcatcgttgaaacatttggattttaatacaaaaatcattgtgggtagattttgcctcaaaaagtgctttcatactgttttaattttgtcaggtttttcagacgttttgcaatagagaatgtcaatgtccattgtgacaaaggcagttggtggcaagaaagggaggagaatctataacagctctcttctgcaatctgcattgccctctctgttctcatcaggttttagccacactgcttcaatatctctttccatcttccgtatttaagtgatcggcactcagcagctctgtgagatatctcttctgggatctgcagtttcaagcatctcccataggagagatccagtgggaatccgtaggttctagcactatgggcacagttttggatgctctcgcttggaaattcttggaaaagctgggtcaacttattgaggatgaggttatcatgacattaagtgtgaaaaggggtattgagagcctgaagaaaaatctggaattcttcaacgctgttcatgaggatgctgaggctctggccatggaggatccagggatagattcatggtggaagaacatgagagatgttatgtttgatgtcgatgacatcgtagatcttttcatggttcattcacagaagtttttgctgccaccaaggccggtatgttgcaatcagcccttgttctctagctttgcaaagttttcatttgatcacaggattgccaaaagaatcgataatataaatgaaaagtttgaagaaattaaaatgaacaaagagatgtttggcttcgagagaaccaaccggcaacaagtccagataacaattgttgacagaagtcagacatctcctgtagatgaacttgaggttgttggagaagatatcagaagggctgttgatgacatggtcaaaatgattgttagtaactacaatgacaacaggtcaactgtttttgggatccagg

SEQ ID NO: 44850 - DNA, 822 bp, Oryza sativa
aaacttgtccatgaattggcatttcttgtcaaaaccccagcctggattgttctgcaaaagatataaggagaaacaagaacgaattcatctcaataagcagcaccttgtgtttcttcaaaggaaggtgaaacaaataggaatacataaacacactgaacagggtctccagacttctttttgtaatatgaatacaggtaaaaagttctaatggctatgaaaatattttatcaaacaagatgatgacaaccagtatggtaaattttgcacatgtgatgataacagaatctccaacatgtagagtacttcagtcaggtgaactagccaacttaaagcatgtgcacttcgccatctttgagagcaataggataagaaactatcaaatatatcatctcagatggcaagtgatgataaacacagacatgttatagaactagcttagtaagaccagaccacagggcatgtcagactacagagggactttatgccttgatggttggaacgaaccattaaattgtagatacattgcattaaaaaaagctaaattgatcatttgtgtagctagaattcaaatttcaaatgctaattgaatacagctctatttttgaaagcaagcttagaaagggtgatactataatttcacatgtctatcaagttagaaaattagacaggaattgtgttattctatcaccactggagattcagaaatcagaagttgaattataaagatgacaacattcaaatatcagaccattaatattatgaataatgttctctataaaaatgtgtatactgttcagagcatcaattataacaagaaaacaa

SEQ ID NO: 44851 - DNA, 1501 bp, Oryza sativa
gacttctccgcgtcgagcaatgatacggaaaggacccatgaaccgaggtgcgagcttccctttcgtctgaaacctgtgtactcctcgcaatggcgtgacccgtaggtacacaaaatcgtccactgtgaattctaggttacggcgtcggttatctgcataactcttttgccgggactgtgccacctttagattatcccgaatggttctgactttagcttcagcttctctcaggatatcagtcccgaacacttggctttccccaacttggtcccacaatagcggtgtccggcatttgcggccatacaacgcttcgtagggtgccatttgtatgctggcttggtagctgttattgtaggagaactcggcataggggagactcttatcccaggtcttcctgaaatctaggacacatgcgcgaagcatatcttctaggatctgatttagacgctcggtctgtccatctgtctgcgggtgatacgcggtgctgaaatttaatcgggtacccaactcttcttggagcttcttccagaaatgagaggtgaattggcttccccgatcagatacaattttcttaggaatgccatggagacttacgatcctagcgaagtagagttcggctagtttgttccctccataggtggtcttcacaggaataaaccgagctaccttggttagtcgatccacgactacccatatagaatcataaccgccctgggtttttggaagtccggtgatgaaatccatcccaatttcatcccatttccattctggtacttggagaggttggagaagtccggccggtcattggtgctctgccttgacacgctggcacacatcacaaagggccacgaactctgcaatctcccgcttcatactaacccaccaatatttctctttcaagtccaagtacatcttcgtacagccagggtggatggaataaggactttcgtgagcttcctgaagtatcaactgtttaagttccctgtcgtctggaacgcatacccgatttccgttccataggattccgtgttcatcctctgtgaaaccagcggctttaccctgtttcatattcttgaggagtccatgcatatctggatcattcttctgagcctcgcggatttgatcgagtaaggtaggcttggcttccagcgtagccaagaatccacgaccaactatgcttaggttcagggcttccatctgttgattaagttccggtggaatgccacagacgccgagagtgttgcaacggctttttcgacttagagcgtcggcgaccacgttggccttaccaggatgatagtgaattcccacatcataatccttgatgagttctaactatctcctctgctgaagattcagatccgactgagtgaagatgtatttcaaactcttatgatcagtatatatttcacagcgattcccaatgagatagtgccgccagatctttagagcatgaactacagcggccaactccaaatcatgggtagggtagttgccttca

SEQ ID NO: 44852 - DNA, 1501 bp, Oryza sativa
tacccctgggacaaaaacttctaaagtttgataaaaaaattctgaattatcatattttaagtttttgacaaaaattggatgtttacaatcttatgtttataatattgatatttcgaaatttttgtccaaattttggatgtttttgttccaggagtattttgatcatttggataaaaaatgtataatactagggaaggttaaccagacggcgatggtaaattgtagaagttaagtaaaaaaaaagtgacatattgtaaaacgtgacaaaatcagtggtaaattgaagacatgtaacaaactcagtgacatataatggattttctctagaaatattgtgaaagtatagtggtgatatgagtgagcagatgaaaggccaagggcctttgcactcgatgaatttgcatatcatgattgcattgatgacgcagtagttacgacagggactcaaacaaaggcatgcagaaactgctgactttcgtatgcaatttaacacatcactccttacaccactgatctttgctcgggcgtcaaaatcagcaaatatccatgcaaaaaaggcaatattgcaaagaaaataaaacggtactccgtacttcattagtttggaactcggctagccactgccacttggctataattacggtgacaatactttctagacaggggttggtaagctgctgctatgtactgatcatagccttgcaagtactaaaatccaacggtggcaaacaatcttgatgacgtgatgcaccatataggatgaaatggaattaactacatttagtatggaccaactgtatagatttataagattagcaccggccccatcttgtcattgacgctaacctatatccccaatcgcagagctgtaacaggccagcacctaagcccctccattgccaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcagccaacgatctccatgctgcaccgtcagtccatgcctagttttcttgcccccctaccaccataaatacgcacctagctgtaagatggatcacaaaacacatcgatccatccctctaccagtacataaacaagaaagataacaccaaaaaattagctagctcgccaatggccttgttgtcctccttccggctcgccgtggcagtggcggcattgttggtcgtcggctcatgcg

SEQ ID NO: 44853 - DNA, 525 bp, Oryza sativa
taggagttcttgagtccgcctatggatgtaagtgtttccccttatcccttcgtgatactttctttttttttcggggtatgaatggttgattttctgttgcgtaaagctgtgatcaaaacatgtagtatttgggttgcttgatttgaaagtgagatttggggtagggtagatgatggccatgaattgtgtaaactaaagtttacagatgacaaaaacaaaaagaaaagagtgatttaggttgtttgacaggagaaaattgtttgatactatcactgaatgtgctttaagcaatctattcccgccaaattggccttggccagtcataggttgaaattgcggttcattgtgtatgagttgcactgtatgtttacataattacatgcgacccggttccaaatttgatgctggttgttctctgatctagctgcttgttttactggctacttggcatcaaccaacttcgctccaaattcgataaattaggccttggggtgtctttgcgttgcataatttatgcttttgatt

SEQ ID NO: 44854 - DNA, 1501 bp, Oryza sativa
cgggcttgatcatcctccccacgccgacggaccccggcgtcacggccgccttcctccgcccgcggcctctcccgctcccgctcccggcgaggccgcccgcggactggttgaagcgggtggcgaggtcgagtatccccagcttctgcatccgctccatgttctcccggatcctctccgccctctccctctcgtacccctccgccgcatccgccgccaccaccggcgacgacaacacggggctcctcgccgcctcctccgcagccttcggcggccgccccctccgaccaggcgcattcgccgcggccccccgggtgctcaccatggcttgctagctagctaatacaacttgtcttggttggtgggtcgaagccttctcgctcgccggcggcgaagtcgtcggcggcggtgagccgagggttttagcggcggaggaggaggagaaaagccgcgattgcaacggtcagattttctcgctgcctctccacgcggattttataggcgggggctcaccggggcggtgacccgaccccgctcgccctcttttgcacgcgttcggttacccagcccactcggctacgctcactgacgtatgggccctggattgggtgggtcccaccagtaggtgaggtgatgtgggtgggtacatttgtgcgtgcgcgcacgctgtgtcgcccgtgcgtagtggggtgagtggagaggggggagtagggtggggttcacgtgcgggggtgggttgtgtggcgctcgctgacaggtggggtcaggttagcggcgcgttaactgtggggcccatctgtcagtggaggtggggaacctaccttcgtgtgttcggggtggcgggaatggaaaggtgtgcgcgcgcgggtggccgaagaggcaacctacctgtactaaagtagtagacctacagtggacttgtaaagtacaggcgatggtgtgaattttgggaaattgtttaccagttgccaattgtatctcggttttgtaccgttggaatcgataaactttggaaactactaggatatttggtttttgaaatcgcattgatgcatttctgtgtgtgttgacagctaggacaacctttggtttaagatgatttcttgccgttgatttcaaaaattgccattacaaggtcattaggtggttgcttaattttgatgcctaattgtcaatatttggtaaaattgaaatgtgtaagttgtatttggtttgtttcctttctcaactttttttcttgtaagaggaagattttagaattgcaggtaatggaggctagtttaggcaacttataatttattttggcaacgaacatatcaacactatagctcatttgcaactccgtgtatgcattattttttttatctaatcccaacaaatcccttttttctattttttaatctaatctcaactaatccttactcatgagtaggaattgcaacaccactaatctccgatgagactacaactccgacatcgagaatgcaagaaccgagcaacaaag

SEQ ID NO: 44855 - DNA, 449 bp, Oryza sativa
tggggaggggtgcaggtcagggtggggagggaggtggggtgaatccggagcgttggatcggagcgaggtaatctgaacccttgagtgatgaataaaagaatgagtgaaagtatttgttgaactatagggtagatgagtaatatactcttgtagtattttcaatgcccagtacacagggaaaatatcatcctttaattgatgtcctttttctttctttactgttatcctaaccacttgcttgaacaagctgaggatgctctagtttgcaattcatgctctgtgttgttaactaatttagtaaaatatatgatgtgttcttttgcatactgctcctcggttaagttaaccaaatacaaaaacctgctacaaaggggaatgtggtcagtggagcagtttttagcttgtctgttaaatgtgccgtaatgattagttggcatttattgttcaga

SEQ ID NO: 44856 - DNA, 203 bp, Oryza sativa
aacttggtcaaacttaaaacagtttgattttgataaaagtcaaaacgtcgtataacctgaaacagagggagtacatatttacatctgtttgatcaaaactgcatcacgctggggcttaaaccacgaaagagtacatatacataatacgttgcactgtggcaatcgacttcatcgcccatctcctccacgcttccccgaccagg

SEQ ID NO: 44857 - DNA, 1501 bp, Oryza sativa
tttgctgttttaggctgctctgattgcattttggaatagattggattgcagtgcaaaggtggagtgtgtggccaatctatttcatctgtgtagaattctgacaaatttatttcgaacagccccaacttgtgtattagctgcacattatatgaatgcaacgcgaaagctacttgcatagcagaataaggcacacatttccaaattaaatcattttaaatttctcaatggtgctgatatggactagatttgttccttctccattcttacacaattatctgtagagctggcagggattcctttttcttcttcagatatagaattctgtacagcatgaaagaatgatccttttttcctttaaaatgtttctggtttccctttccctaatccctaccaaacctgaaatgttctcagtgtgacttcattgtatgcaggaggaacttgaagagcttgataaaacggataaggtgtcagcagcattgcaagagtacgtgctagaagaaaacttcaccaattctaatattactttcagacattttatgctctcgtcttcctgcttaaaaagcatcttttgtggtggttttactgttagttactgattgcactgttaacatttaccaggcttatggtaacagcggagagcaaagcggatcctctacttccagtgtaacgacataaacatcctatttctaaatttatccaaatatctctgcctcagaactcttatgccgcttctttctgttaccgcaggactactgggcctgcttgccagtcttgggacagatggtttgaaggtccgcaagatctgcgcagatgcaaatgctggtttttgtgattcttggcaagcaacaccgagggcagacaatgattgctgcaaactgtaaattgtttttggtcttcccagcatgaatgtcattagtcattaaaggtgaggggggaaattcttttactgtactgagtatgggcatcagaaagtggagtagaatgagaagagaactgtggaatacataagtggcagcaatgagttagcttaatctttgttcgacaagtttcttcgtattgaaattttctgtgcatttagtttgattggctgcatttctgctgttgttaaagtatgggatctctcaactgcaacatttgactaaaaaaaatattccctgtgaggctgtgaggttagttctatctgacatttctttagatgtttctacccttgttcagttagttaccatgctgaatcttgtgaacaccatttctgaagaatgatggctgattctatcttgacaagaattctgaatcctgcattgatgtgaaagaaactggctctttcatggatcgcattaactttccactagctcttctggcccattcaagagaagcccagctcacagaggcccagcccaataagcagctggttctctctcttcaactctcataggccacaagtgaagggaccttatccaaaactacacagcaatggcgcgcgcttgctcgtctccctcctcgc

SEQ ID NO: 44858 - DNA, 1332 bp, Oryza sativa
tggtatatacgaaatatgatagctacagtacgtatatatgttatactcaggtcagaatccttgccctcctcatgactttatatttcaatttaattctttttaattccagcagatcagccctgttaattcaatatatctttcataatcaaatacgattaataacatttatataaatataataaagttgtgtgagagaagacattgaaaaccacaatttccatgtttgtgcgcgcgcgccctatcggttggtctaataagtaaaagcaaaagccaaaatttgaattttcaaatttgattattctgaaattgattgtaagatgatttcaatgtaatttctttttagcattggcttttaaatcactacgaataaatatataatatagttttacctataaattaatttttatttcttaataagccgttttggcttattaggggatatgggtaaccgacgaggctctgtgtatctttgctcttgtaaagagttgggtgtggcagcatgttctacatccagtttgaggagaagggagtatgtactgtttgaaattgttttatacgtacatggtgtcttctacaaatgcgcatatataggtggctaatttttgcatttgttttttacactatagtgtatttattcgcaatagtcgtgttatatgcatgacaagcacagttcatccttatatataaccgcagatcacaaatggcatctttaatttaatttcttcagtacacacacctaactggatctgcttgaagattgtaataaacacttcactctgttgatcagctttgcagctagctagcttgagcttcttgtacactacatagtttgcatgtgattaattatagatatatatatttcagttaagaaaatgtacacatatatataatctttaagaaaaattaggggcgcgcggagctaagccctgtttagtggggtccaaaatcctctattaaaacattaatagtttcggtttaagtttcaccatgccacgcaatggagctgatcctggtgatattttcagctagctttcctcagagaaaaatggatgtcgtcaggagatagaagacattcatcttaatgcttgcaggcataataatcagaaaccatgaagccagcggtcgagtggtcgacctcgtgaacagatcaaaagatcacgacgtattatataaacctagggttttcgtcagtcacgattaattatatacgatcgagtagttatcagcaatttggaccatatatctactcatcttaatcatatctcggtcgtacgtattcttccagtacgtacgcatgtttcttttagatgcttctagactagcagcagcagt

SEQ ID NO: 44859 - DNA, 1501 bp, Oryza sativa
gaccgagaccgaaattttcggttagaccgaatgcccacccctagttgtgtgcgcatgtttagtttagcatgagtggaagggtgtatgtgacatcctggcccaatttggattaggcctgtgtggctcatgtgagctgtgtgcgcatgtttagtaccaccctgctcagggtgtatgtgacatcctggcccaatttggattaggcctatgtggcccatgtgagctgtgtgtgtgggccatgtgagttgtgtgcgcttgtttagtaccaccttgctagtttagcatgagtggattcaacttataaggcatattcccaccttgctagtttagcatgagtggaaccaacttataagtaaggcatattcctttttacacgaagcgagaacgaaagtgtaagcggggtggtatgtgtaagtgggcccacccgtcgaataggctggctatgcggttctggagggacggctgttacactcccttcgtctgccggctctgctgcaagccgaggtagctccaggccctcgctgttggctaaagagggacggagttgacgccgctcattgcctcctcctctctcatctctcgcatgccatcaaggagcagatccacgacgttgccgccacctcacatgcccttcgtcgccgtcacctcacacgcccttcatcatcgtctgtcgtcgcctcctgtgcacgagcccgcctcatgcgagcacggatccgccgtgcgtcattgccttgtgcgcccgtcaccatcgatgttcgtcgtcgcctcacaccacagtaaagggagagtaacatcgacgcctcacaccacagtaaagggagagggcgctgaaaggagcttggggtagttgtagaggaggaagagtaacatcgacacaccacagtaaagggagagggcgctgaaaggagcttgggggtagttgtagatgaggaagagtaacatcgacgcctcacacctaaagggagagggcgctgaaatgagcttggggtagttgtagaggaggaagaataaagagtaaacatggctaggaaaaaggggagaaagaggaggaggaagaagaagaggcagtagaggctgacatatgagtcccacctgtcactgactcataatagagagtgtagatggagagtatgttgaagtaaagtgtttgaagaggctgatttgggtattatgttggagatgctcttaaaaccagtgtaatttgattccctcagcggttttagaggatggtttcactgacgtgacacgtagacctgatctatactgtggagtcatcctgtggagcccacacaccattctcccattcctttccttcttcctcttcctcttcctctctccttcctcttcctcattcggcttctccacagtgggctgtgggatgattactccgctgcccgtgaggagatggcacagccctagtcatttcttttttaataatagaatataataccggcatttgcttaacaagttataaccaattattacacaaatttgctcaaaagag

SEQ ID NO: 44860 - DNA, 1501 bp, Oryza sativa
tgcacagtttgcatatgatccatgtaatatgctgttgtttaacttaaacttgcttattctagaacatatattttcccactgcataacatctgtaattatcctgtagaccctctacatagaccactgagctggagcacaaagaactcaaccaagtccatctcatacgccacagccgtcctgttcagtttatcactgaataggggcagtaagcagtccatgaccttttccatcaccttcttctcgaggtcgaggatgaagacgccgttgctcctgtacagcacgagcattgatcccctgttgaagttaaaccacttctcgcggggctgacatatatgggaatagtctgggtaaggcaccgccaatggtatcctgatcacagtgcggagccacgttgcaggggtgtcatcttgctgagtccaaactctcatgtggatgggaaacacgcaagcgaccgaaagtttgccgtctccactgacgcagaggagcggtgagcctccagcaccaaaggggagccttgtcaaggagatttctgaggtgtccaccgccgcggtgagtttgtacagtatgtcatcttgggttgcgctagatacacgatcaataaacagccagtgcgccgcgcccttgtgaacgacggcggatctctcacccaccagggagaagcggcggccgtccacgcacatggtgggagcgctccagctgcacgtagcagcagagtaggagtagaagtactcgttacagtctttcttgtgttggacgacgaggtacagctgcgagaacgtggagcgccctgacgatgatgatgatggcggctgcttcccatctaggtcgctgtcggtggacgtgatgatggcgtagctggtcaagtagcgatggaggccggagagattcagaggcgggagaacgtggcattccccggtgatcgggttgcagacgccgaggaggtggctgcacgctatcatcagcgcggtgcgggggacaagccgcatcaggacaatgccgcagcgcgctgcgaggggctcggcgtagttgaaggtgtcgtcgtcggcggcgaggaaggaggtgagggtgcgatccgtgaggccgagcggcgaccacggcgccggcaggaaggtgggcggacagaccgagctctgctgcgtcacccgcatcttgatcatcttttcgcagcgatagaatctcgtctgctggaagaagaagccgaggaggcgcgcgcggtggccctcgccgctgtccaggcacagcccgcggaggaaggccgggtcggtgaagcggcgcagccaccgccggcatgtcacggcgaacttgaagaggtccttgatgctgcccacgcgggagaagatctggaggaggatgtcctccgtcagagccgccatgtcgtccatggcctccatctgcgactgcgattcctgatgcgtaggcgcaaaggctggatgttaggatgtgaatataacgcgttggatgaatcaaatcagtgttcgcctctctcatcaaaacctaggtt

SEQ ID NO: 44861 - DNA, 1501 bp, Oryza sativa
gaggagttcctggaagatgaaggctttggtgtctagctcgtgcctgccgtcaagcgcctgtggtcgtcgccctagtcttccgctgtttttcttttgtcttcttgtgtgctaggcctttgccgcccatgtaataaattaactatttacgcttccgcttgataaactctgaaatgtatcaacttttggtgtaccttgcctcctgggacaaggaataatacacgcacgtaaggaactcccgttgggttatttccggtcgtgacaagttggtatcagagcctccttgaccctaggatgagctttagatcccaagtcttagcaatattttcgaaataaaaatccttccttatttgttaaaatcctctagtctctctctgtcctgctgcttcatttatcgtcaaaatctgatctgtaaaatgttgcttttctcttttgtttttgtttgtagatggccggtagcatcaaccgtcgtggcctggacctgactggcttcgttttggagctgcggggcatgtgcgttgtcctggggtatccgcatggagtggactaccaaggcaagcagctcccggagcaggagggtgacgatgcagagccccacgctgcttgggaggtcactgcagtgatcctcactggctcacccgagaggacttcgttggcagtcaccgcgggtggagattctttctccgctgcttgccagaacgccgcactcctcgccattggcactcttcaccagtgctacccggacgagttgcagcactcgccctaccgctaccaccctcgtcgcggaggagcccgtgactacgccaccttcagggatgctagctcggaggatgacgctaccatcatgcacttggcgcgcatggtggaggcgtacgacgcagcccgtatcgacttccatcatatggtgcgccgtgggttggtcgagaacaacatgaagatcctggagctgcgtcaggagaatctgcagctgaagaaggacttggacacggtggaggcgcagctgtgtcagctcaagatcgcccagggagaggtctgtcgccccaagcgccgccgcgtctgccgcagtatgaagatcaccgcccgcaagagtacctccaggcccgagcttgttcgtcagtccttggcatggacctgcttcgtcgagacccctcgcgccgagcccgcaccctcggttcctcaggaggagggagcctctggcgttggcagcacggaggatgcgctgctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttc

SEQ ID NO: 44862 - DNA, 1501 bp, Oryza sativa
catccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcggggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggaccaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccaatggagcaaccacgctgaggaagaagctacttgggaacgtgaagacgagctgaaggcagcccatcccgatctcttcgccagttcttccgaatctcggggtcgagattccgtttaaggggggtaggtttgtcacgtcccaaaacgaccctaaaatatatcctttaaattatgcctagaataattaaaatccgtgtgaaagcctccaaaaattaaaatgtgcaaagtaaaagttaaacaaggcttagaggatttttgtatatttcctaaaagcctaaaatgtgtaaataaattttagtggaattttcggagcacaaaaaaaataattaagaagaaataaacaaagttaaaaagg

SEQ ID NO: 44863 - DNA, 1450 bp, Oryza sativa
tgtgttagcttgcttgcttaagttttgtttgtgtgtgtgtgggttttagcgtatggagtatatcgagggttgtgatataaccatactagtttcagtgttcagtttagtgttaaaaaacaacctacttcacatcaataaaaaaaataaagcttagtaaaaagtctattctattttgagtctcctatctactttctcttccctttctatctctctcttacctcctacctaagagaatgaattaaaggaaaggaagttttgtgctcaacggtgccagtggtttaaacaagtaaacatttaatatactcaacctggttatttcagctaaggaacaatgtgtctggatctccaaataaaattcatccagatgctgttgtggataacacagtctgtcagccaaggaaggttaaaagtcagaagctcaagggacgccattgaaaaaaaattcaagagaattgttcacatttggtatctcacgatataaggttccaagtttgatgtgagcaagagtcaataaggaataaggaaaataaaagcttacatctatgtcatcaagatgattattcccactacaatgtggtttatagaagaaatgattatatcaaggtgtctgaaaggacaattctttttgcactattttttaagtcaaaagaatagtgtcagtaaggctaagacattcaacaacgaggaatgtaaagagatgttgatttagaagaaaaaatagcaagaagattcaattctcacgtcttcaatgtgaagtaaatggaagttaaagtttgtattgttatggaaaagtaaacacattaagtagagcaattattcttgttatcatggtactggaatatcaagtgaaggctcggttcataaaagatttgtctttcgattaatggaatggattaatggaatggatcaggagataatgattgctagcccaattcagtaatagtcaggctcgtgaagggtggcagcagttgtaatcgatcgttggacggtttcttgttgatggcagtaattgatgtgtccaagagccaggtatttccggtggaagaaatccaagttgctgagcaggaagaaaagaagcaattcaaagaatatatatatatatatatatatatatatatatatatatatatatatatatatatatatatatatatatatatatatatatatatatatatatatatatatatatatagagcaagggtgagtactctcgtactcagcaagtcacgggaacttaggtgtttaatgcaagcttggaagagaggcaaggttgttttgcaaatcttttatttgaagacattttgaaaacactaagtgatttatttctttctaagtttgggccgaaaagagacttgcgtctcgtttcgactttaagagatgtttttcaacagctcatttggtaatgtaccgacctcccgggtcagatcattacttctcggctcccaga

SEQ ID NO: 44864 - DNA, 1501 bp, Oryza sativa
caatctattactctacatagcagcaaataattcggacctaatggcgtcatcaagcatcagcacaactactaagagaggtgactttttcaaagtatgctattactctacatagcatgtaaagtatatctttttcttctttttcatagtccaattttcagactggagtactggacctcgataggttcttttgtgtgtgtgtgtgtgtgttttggggggggggggggggggggtgagattaatttggcatctgaaaatttgcctagttgcgttcgcaccaaggatgacgggacgctcttattgtcacagtcgaaaagagctgaggaaatcatcaactgatttacctcaccatatcacaactaaagttagccaaatttgattaagttaggcatctgtttggtttgtgccacacttatggcaagattcatttatcataatgtgggtcatatgtcattggcacgtaaaagtgtggtaggcttgctttcctatggctgaagtgtggcttcaattttgttggccacatgttaagcatatgttagctaaatgaagtatggcaagttttgacaatgtgggtatgccaaccaaacccctaaatcctgatgtttatgaatattatgcacatgaaaatatgttctcattaggattttagcgagttaagaaagggccattgtctttccttttttttttttgagcttatgctaggaggcgtatttggccgatgtgcactgtgccactgtcgtgtaatcgaaaataaggccccctttgaattggaggaaaaataaaggaattgaaatcctacactattcatgtcgttgattcgtcggaataagaaaaggaaaaacgtaggaaacttttctattcctacaattctagagcaaaaatgtaggaaagttaacatccactttgacctcttggaaaactttccttgagtctatctctctcgtctgattcctgctcttgcggtctaatcaaacggtcattcctatatttttcctgtgttttgcaatcctctgttttacactttcattcctatcaaaatcttgtgtttttcctattcctccgttttttcaatcctgcgattcaaaaggccataaaaaagagaagaaaatggcattcttccctacccaatcccaacaagcgaagctcaataatttcccaatcccaaccaacgaagctcaataatttgctggtgaaatggactaataagaaattttcgccgtgtttagttccaaagttttttttaaaacttctaacttttccatcacatcaaagctttcctacacacacaaccttccaatgtttccgtcacatcatttcaatttcaaccaaactttcaattttagtgtgaactaaacacacccactattatggacacattactattaggaacacgacagttcggaggaaaggatggtagatgaggctgtgtttatttcagcgcaaagtttggattttggttgaaattgaagataatgtgactgaaaagttatgtgtgtatgatagg

SEQ ID NO: 44865 - DNA, 1088 bp, Oryza sativa
tgtgttagcttgcttgcttaagttttgtttgtgtgtgtgtgggttttagcgtatggagtatatcgagggttgtgatataaccatactagtttcagtgttcagtttagtgttaaaaaacaacctacttcacatcaataaaaaaaataaagcttagtaaaaagtctattctattttgagtctcctatctactttctcttccctttctatctctctcttacctcctacctaagagaatgaattaaaggaaaggaagttttgtgctcaacggtgccagtggtttaaacaagtaaacatttaatatactcaacctggttatttcagctaaggaacaatgtgtctggatctccaaataaaattcatccagatgctgttgtggataacacagtctgtcagccaaggaaggttaaaagtcagaagctcaagggacgccattgaaaaaaaattcaagagaattgttcacatttggtatctcacgatataaggttccaagtttgatgtgagcaagagtcaataaggaataaggaaaataaaagcttacatctatgtcatcaagatgattattcccactacaatgtggtttatagaagaaatgattatatcaaggtgtctgaaaggacaattctttttgcactattttttaagtcaaaagaatagtgtcagtaaggctaagacattcaacaacgaggaatgtaaagagatgttgatttagaagaaaaaatagcaagaagattcaattctcacgtcttcaatgtgaagtaaatggaagttaaagtttgtattgttatggaaaagtaaacacattaagtagagcaattattcttgttatcatggtactggaatatcaagtgaaggctcggttcataaaagatttgtctttcgattaatggaatggattaatggaatggatcaggagataatgattgctagcccaattcagtaatagtcaggctcgtgaagggtggcagcagttgtaatcgatcgttggacggtttcttgttgatggcagtaattgatgtgtccaagagccaggtatttccggtggaagaaatccaagttgctgagcaggaagaaaagaagcaattcaaaga

SEQ ID NO: 44866 - DNA, 301 bp, Oryza sativa
atttctcaaagttttagtacatatgtatgtccaaatcaatgcagcccatttctcctttttagcttgtcaaaaatgttgtttacagtttttttttaaaaaaaaaaatttgtggaaagaaattgttgaatcgatcactccgtgacatgaaactacaagcataaagaatcagcacatcgtttagcttattcagatgctagaacaaaatgtaagtcgcattaataatatctccaacatgaataagtggtaatggatagaatggaagcgaagccagctttgagaggtgctaagttaagcttcatat

SEQ ID NO: 44867 - DNA, 297 bp, Oryza sativa
ccgttccacttccagtaattccgtaaaattgagatctatttaatggcactattaattagtctaaataggatccttctttggtcttttgtttaggttttcgattgtttgtgtaaagttgcggttgcggattttcgtcgatcgcgggttttctcgaagattcgtgaagcttcgtgaagaccttgagcaaggcaagtcaccctttgaccaattgctcctataattggaaaatcattattattttgtttgcaactggcattattagaatcacacacttaacttgcttggcctcggtttgcg

SEQ ID NO: 44868 - DNA, 1159 bp, Oryza sativa
tgcaattccagatgttagtgtagattgtacttcatacaacagtacactttatcttcaattgatttttaatgggcgggtgcacacattgttacatccatgcagcatgagagctacatgtgagaggaggtacatgggcaagcaccggggaaggatggtggatggattttgacggggtggtgggcattagagggcatgcctccaatcgtgcaaggggaagggacatcatgtgtgcgggaaccacttaagagggcgtggaagtgaggctaggcatacgatggatgaggaaccataaatcaccactacatttttttggccttaaagatttattagttctttacatttaaagtttggaataaactgtatattttccagatcctttgcaacacattggtagtgtaaatattttttctatttaaagttggaactaatggtgtatttattttagatcctttgcaatagattggtattctcttagtattttataaactttgttgttgactatagctcagggccttagccaactatatgatatgatacttaacttagctcctccaaatgcaggtttcacttgcactctatccattaccactcattaatatctatccattaccactcattaatacctgagatgggattaatgtgacttacaatttgttctcgcatctgagtaagctaaatgatgcatcgatgctttatgcttataattttagatcacaatatggtcgattcaacaattttttttcatgaaaaagaaaaaccaagtgtaaatttgacttttacaacatttttaacaagctaaaaatgagaaacggactacatcgaattggacatactataaaactttggaaaatcaaacaccaacaatcatctcaatgaaaactgaccaaatactccctccttcccaaattgatcatcatatatgcttatgcaccaagaccaaggataatttaaatcacatcaatcaagacatcaagcacacattctcccacaatgcatgcatcgattaaaacaccatgccaattacaccttagcatgcacatattctgccatgctgcagtaattgtattctgatgaaatctgtgtacatgcaggtatatgatgattaatttgagaaattttgaattccattatatgatgatcaatttgggagggagggagt

SEQ ID NO: 44869 - DNA, 1501 bp, Oryza sativa
aaacaaataaaacaaaaataaaaaatttcggccgggggggggggagccagctattctggcgcctaaaaaggaccatttttagaataagtttttttaggggtctatttgcgaaataagttttttaaaaggaccaaaatgtgaaaaatccagaaatctgcttgcaattcgcaaaaaccataaatactagtactacttacggagtactccgtactatgttagtaataactaacccataaattaaggaataacacatatcaaccgtttaattagaaaatgacagaaggtgcagcaaagagaagctgagacgcatggattaccaacaagtcatgcccctggaccggagtagttgacacttgacagcgacaaattgctgagacgcgattacaccgactctggtcgtctcactcgcctcgccaagttggttggtcgctccgctcaaatggcatgtctaattcgtagctaaaaattattatattgtgggatgaggtatatttatagctaaaagttgctatattttgtaatgggtagtatattttagcctttaatatttttttgcggagaactgtttgagatcaataaaagtttcatttattaaaaaatagggaaatgaaattaaaggctaaaatagtgatagccagacggagatccaaggtgcttatcagatattcagatgctgggttttctaagcataaataaacgtaataaatatcagtccgtcacaactctgaaagaatctgttttcctgattctgccaatggttgctgcaccatctcacacacaccacgccacaatattctttgcatctgcatattcttttctctgtttcttccttgcaacaaaaataatactagtagtacacatttgagaacttgatgttttgacactcaagcagattaatggtcagagttcaaatttttttttatccatagtccctccgttctaaaataaaccaatctgaacgtaaggtatgtccagattcactctaatgtgttagaattactcttgccatccaatcagtacagttgcgtcaagcattcaacttctgaatttccatctgataagtaattactactccagctttgagtcgttaaaaatatagtactagaaacaatccaagttagaacaagctctatagaatcattggccagctggacagacagtcactaaatataaatatccaagtgtctcaagcacacaagccacccaacaccacagtgcgacaagctctcgccaagtcgctatccaagaaatccctcccctctctgtcctaccttggaatccccaccaggatctccggctatccggcggcagctacccagccatggccgcgcgcggcggcctggagaaccccctcctcggcggcggcccggtttcttctcagggcagtcggcgccgccgcccgtggaccgcgctcgccatcgccgtggcgctgctcgccgtggcgtgcgtcgtgctgctgctcctgagctcggggggagcggagcaaggcggtgatcggagc

SEQ ID NO: 44870 - DNA, 1501 bp, Oryza sativa
gaagggtggcagcgactggagggggctcaaggagtcatcggctaacacctggaaaatcaaaagtgatgcaccgctcaagggccccttatccgtccgcttccttgtcaagaacggtggctatcgcatcgtcgacgatgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaatagttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaatcttcattggcatcccaacctttcttatcacttggcaaactatctgcattggcatcccatcatttctcatcactcggcaaaatatcttctcattatgcatcgttagtaaatattttactatcgagattaatatcattagtaattcttttactaacattttatcaatcgggcccctcttgtaccttctatctgtacagtaaatactttactattgatataatatttgcagtaattcgttcactaaaagtattaattattcttatacctcctactatccatattagtaatacaattattaaaatggcacctattaaaatctacatgacaaaaaggtggcgctgaatgtttttccaccgcctatatgggaaacaggggaaaatcacatctcaatgcctatgaataaaaagatttactcttgaatcacaccagtagaaattacactcaatcaactgcctccggtgacacactggcgaaggggcaacgtcgacatgcaaaaggaaagttacactcaatcagattgatgcctgcacgaatccggcaagcaggacataaggacattacaacaccaactagctagacctggtttagttctcaatttttttttcgaaaagtcacatcgaatctttggacacatgcatggagcataaaatatagacaaaaataaaaatcaatttaacagtttgcatggaaatcacgagatga

SEQ ID NO: 44871 - DNA, 984 bp, Oryza sativa
gcacgcccacatctcatcaagatttggacctgcacaggagctaagcagatctcctaggccggtgtgttcgatttttttcgtcaacaacctcatctcaaatgagtaaaagcccgttaatgatgattgacacctgtgacgagtggatcttttcagcccatcaaaggtgacaaacacctctgacatgttcaactcaccacccgtcacaggtgtggaaaatcaacgaaaaaaaatttcaaaagccctcagcctctagctagctcttagctctcagcccttaggccatatctaatgacatgaagaacatctcaagatctcatgacacaataactttgcattttattcacagatatgttgacacatgaagcacattcacacaagtaatatacatcacaaatccacacaactttgagtaataaactacaaatccacacaagcaaccatgagtataacccaatctgaaatttggcaatgaaaatttgcacaaccggtgaagctagcgggtgaaggagacggtggacgacgtcggcggttggggtagaggccgccggatccaactgttgccagtgcggtggaggaggctgctgccggatctggcaggtggcggtggggtggcggaggaggcgactggcggtcgggggagaggcgccagatctgcgtcccccagacgtttcgaggccgatggtcgtgacgcgggggaggcggcggcagccagcggtcgggacgcagagaaggaagtggctggcggtggggggagaggccgcggtggctggatccgtgccctgtaggccagatctggcggccgacagtcgggaggcagaggaggaagcggtcgggctgtgggggcagaggccgcggtggccagatccgcaccctataggctagatccagtggccggtggtcggaaggcgggggaggcagggccggccagtggtcgggaggcggaggaggaagcagcccacggtggccggatccgcgccccgtagg

SEQ ID NO: 44872 - DNA, 1501 bp, Oryza sativa
cgtcgtgaaaactacgtcaattcgatgaagggacaataattgatctataaatcatctgagtccgatctgatatatttgtgtcactctcttgattttgcgcttgtccgataatttataccggtcaatatcttgtataagatcgatatcgagaaatacttggaatcgtatttaattagtgcatgtcatatcatacttacagagccccattaattcttcaaatttatttgatttttgaagcgcatagaaagggccctttacttctttgcaagaatgtaattaataaataaaattacaaataaaataaattaactcattatcatgagaatatctatgtatggtctatttcatctctggcaggtgctagatcgatcgaggagacatttttaaccaacaggaacaaggcagatacatgcataatatgttgatcccgcgccgtccacgcgagggcagctcgagggccaaccctatcagccaccgccgcactcctctcccctcccctccacctcgtcgccaccggagcatgccgtaggaaagtcgagcggtgagccgggatggcagcgggccatcccccggtggagctccgcctttgacacaggaaaggcggcgcgacagcgtgcgtggcgtagagaaggcaacgtgatagtgcaggcggggagagaggcggtggacctggtgccaccgtgttcagatctggagcacccatggcaaggggcagtggccggcgccgccacgaccggatctggagcccccacggtgtgtccttgccggatctgaaggttttcatgaggcgatagcctcgagcggccagcgcgcggtgacagtctcgagcagtaggcgtgggagatcgacgcgaccagcgacgacggagagaggatggcgtggatgatagcgggaggatggcacgggcaatgcgggagatcggcgtgaccggcaatggtagggaggtcggcggtggctagtggttggtgcgttcagcgacagcaacagtctaccatttgtgaggcgatggcatgagaagcagctggcggtggccagcggcaccgacgatggccgagctagcaaccggtgtgggaggcgtcgttggccgcatggaagacccgacgaaggctagtgcgggctggtccacggtgggacactggtgctgtggtgaagctttgggggggcgatgataggttttggtaagggtgctgcaggtgaaagtccagtggatgggtgacgatggcgcctctagtgtcatggccttcttggaggtgtcatctaggagatctcttgttcctcaacatcaccgtcttttctcggtttgatcgtcagagtttttttgttgtcgtcatcaagttggagcaagggatgagtgaatctccttctctctcaccctctccctcaagtcctcaactcaacccctctatgtgagtcgttgttcttttgtgtggagtcagtgtttagcacggcgtttgcaacccccttgtaggtctagcggcgttcggtctcgtttagtggcgat

SEQ ID NO: 44873 - DNA, 1501 bp, Oryza sativa
aattatgggcttatctcctttctacagagcttatcatcatcattagagttccttcttttctcttctatctaactgattaaagtctccattcttcaacacttacattaaattgtttgaacttattgtaacctctcattaaaagtggtaggagataattaagcactactgaaagtagtggatacataatttctttcaaaaagttaaaatgaaagtgaggagcacattaatataagtccgatacaaaaataacaatcttatgtgtgtgctctcttttgcaatatctgtcggttcaaatttaaaacatccgatcataagaaaccaaacacaaatgtttgccttctttttcctgcacacatgcatgttgttccgttttttcctgctgcttcttttttcttcccttctgacggcctaaccggaaaattcagtcaaatacctgctcattttcatcactttacaggtcagtttaatgaggttagcataggaagcttgtagctaacagctagctcatggtttagacaaataatttagctgagatagactgcccatacaagttacttgcttgttttgtcaccaagctgctggactgttcctgaatttccctgatcgatgtgttcatgcatgcatgtcaatatcactactagctttttcttccctggatttttaccccattaattagccctagtctccatctatccctgtgtatctagctagctactagtagagagtagatactccattggatgtgccgatattttaacgattataagcaaaactttcatatgttttctgaagttttgtcaagttcatttgacttggtgcttcgatgacaattctatcaagcattttgataagaaattgaaagaagctgctacattgaaaatatggtcagctgccagtcactgttaaagaccaaatttgctggcatcatatcttccttccaattgatcaatccagagttgcgatgaaccattctatgaaccatctgaatcggttggcacagtttcttctccatttccgtttctcatttgcattttcttccactttgaagaggaggcaatcacttatcggaatcgattgcttctcttattgatcgcgacttccactttaccaagatgttactcgtcggcccgtcgatctgtccaccaacctaattggtggtgtcatggaacattagaaacagcaaccatgtaactttccctaactttagcttaatcaattagatggcatattctttcaggaaagcataggcatatacagatataggtacgtacactactaccaccttagttgttgggtggatgaaaatgattctgtccatggacaatgatttagtgcccactaatggacaggcacaaaagaactaaaaattggaaactagctaatataatacagaaaataaaatattatggcagaaattaacatcggtgaaacaggaacttaatttaagtccttgtgttcactttgcaagcctagagaagcaaattaaacacttgattatggt

SEQ ID NO: 44874 - DNA, 1501 bp, Oryza sativa
attatcaacgaaatgcatgtctgctagttcgtgcaagcagaactaaaattaaagacctaaattgaataaatatcgggatattaatgaaacacaatcagtgggttgtatttttggcagttcacctctcatgttcattcatttatcaacggtatccaaaatttgaaatagttaattttgagatatattcatcatagatacaaaagtttatttataaattattcctattgtactttctttattttttaagggcttattagccgtagaccaaaaacgagggattttcacaagaatacgcatagtaacatgccagtgtttagagttaatacggggaaagatgtataagtatgatttatgattgtgcttgaaattgcaagaagaaaactaggggctagtttggtttggttccaaattgtgccctaccaattcattggcaatttttaatagtgtttctggttgtttggattggtgccaaattttaacaacacatctcttagatagtaaaagttttggccatccaaatttggtagtactaaaagttacctaaactttggcactaccaagattttggtatggcactaaaccaaactggccctaggttagattttagttaagaggttgtatctaaggaagatggtatactatacactcattgtgtaactgttactccctccgttttaaaatgtttgacaccgttgcctttttagcacatgtttgatcgttcgtcttatttaaaaaaaaattgtgaaatttgtaaaactatatgtgtacatgaaagtatatttaataatgaatcaaatgatatgaaaagaataaataattgcttaattttttgaataagacgaatggtcaaacatgtactaaaaattcaacagtgtcaaacattttgaaacggtgggagtattcaacaatttacttgactttaattatttttttctcttattataaatatttaatgtttgctgtcgaataaaatttagttaaatatttataattttaattatattaatagtttttgaaatgcttagttaaaaattaagaagaagttatgtgtagattggtcttgaaaagtatagtcatactatcgtaaacttaattattagattttataaacttattttagtacaaaagttatggtcaaacttttaaaggtttactcggatcttgttctaaatgtaaaatatatagggcttgatgaattgagtatgtatatctcatccatattttatatttctaataataaaatataacactcctagtacttaatgtgtctaaattcgtactgcccaataatctgtctatttgaatatcatgtccataattgagatggaaagtgtaataacgagtgatgcataagcattaaaaaacgtttaccaaacagcattacaaactcagcccggccggcttcccccttatatacccagaccatacaaccaacaccaccatagtaaccagctgctgctgctgccgccctcttctttgtgttgccttgttgttggtgtcg

SEQ ID NO: 44875 - DNA, 1501 bp, Oryza sativa
gctcatttcgcaactgacacaaattaattaactacacaactaattgactcaatgaagctatttacttagctttcagccacagcttattttctttgttctttcaactatgcctcggtccaaaaccggttactaccggtccctcaaatatattagaagagatttgcttcggtctagtaaaaagtacttcaaattgccggtacctcacggtgctaaatcgttttcgaactttggaactaactaggtaggatgggcattggtagatccaacgatcggaaacgatttggcaccgtgatgtaccggcacttttagatactttttgttggaccggggcaaatctcatatcagaaacatttacatttcatccttgatgagggcaccacgtggtatcctagttatcaaattaaaattttgaaaaagaaatatatgaggtggaaataagaggaaaaaaggcgtgaagatgacacgtggattatactatatttttgttacttaattattattaattggtatagtagtatgtttgctatttgcccatgtacgtatactatatttgctattcagatcgaaaatcacctttacttgagtatatatagggatgaaatatgaagaaaaaattcgatatatagttgagaaaccaatagtaaacggatttactatggtaggaaaaccagaccaaggccatttttgagggaccaaaagtgaatgtaatcccaatttttaccagtgcttaattaattactattccgtcatgttaatttcatgaccctagctagctagattgggcctagtgacggatctactgttgggactgttggtgcgcaagccccacgtccatttcctatccctaattagccattaatgattctcattaagtttaattagtaattaatataaaattgggatcccgtgatgatagttgaagtgcttagtgcctaaaattgcaaaacactcagaatagactataccaatttatttgtagacttttaatacatatattaatgtagatacaaattaaagtggagaagataatatgtttattttataatgtgtatttggatttcatctgaaaatgctaagctgatattcctctgttcgtcaaccgtggaaacgtagggttgcgcccattcgctccacgccattttagaagaaataccaattaagccccggatcatgagatcaaagacaatgctatcccgctatggccgcctactcttccatatctctagtttgctttagcgccattttaatttacattctggattcgcggctgagagtgagagaggacctatttaagcatatactgctatattattcatcaccggccattccttaccatttcttctccctctgcatggtcagtgctcacaaacgaccaatcccccaaacgcagcaacaccaagcaaaagcaaaagctatagtccttcactagcttagctagccaagaatcgggagcttagctgaaacctgctgctgcattggagaagatcgaatatggctggcc

SEQ ID NO: 44876 - DNA, 1501 bp, Oryza sativa
ggcctgggttggcttgggacaagctgggacccagggtcgggttgccagttcggtctgaatcatcgtaggccttgggttaaggcaggttcgtgtgggttcacggccttgattaataatattgtatagctctagggtcgtatttacaaaatagctttgagcaactaagtgtcttttaatgctgtttactgcaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcctccgctgtttttcgtttgtcttcttgtgtgctgggccttcgccgcccaggtaataaattaactatttacgcttccgcttgataagctctaaaatgtatcaacttttggtataccttgcctcctgggacatggaataatacacgcacgtaaggaacgcccgttgggttatttccggtcgtgacaggttattgctaccgaagtctaatttggttccgagaggggggcatattaccactaattgcatagtgtgcgattgtaatttttttgttgcaataagtaggaagtatcgcaacaaataaatttgcgttaaaattagggtgacgatattgccgcgctttttgttatcgttgcaatagttatccatgtcgcaacgaatttagagcgttgttattagagtcatgtatatagcaacgcgaaactactttgttgcaaatgagtctgtagatattgcaacgcaaacctaaatcattgaaaattagtctataggtattgcaacgcaaacctaaatcgttgcaaccattcttagatattgcaacaaccaccggaaatcgttgcaactaacaagattctctcgcaacaatatttcgtcattgctatagtttaacgaatcgttgcaataggtgaaattggtggtgccacctacagattgttcatgggcctttgtattgttaaactttaacttgtttgcatcattgtggcccgggtcggggtcatgacttacgtaattaagtcggcccggccaattagctgggctgtatcgtgtaataaaaacaggtacgattaaccctacccttagcagtcgatagatagatccctgatcatagactagctggcgccagcgacccttttatatcttgcacaattgccggcgacaccgaagcactcgacgctagcgagaccacaccctgtccctatctcccaactcgatatctcgacgccgttcgaatcgatccctatatttatatatattcaggtacctcttcgatcacgagtgcaatgaaaactattgattctttattttctatatatctatgtaattaaaaattggcttatttcattgcataccaccccttaggcaaatttggtaacaaattttctcaattggaatatgg

SEQ ID NO: 44877 - DNA, 1501 bp, Oryza sativa
ctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagagaatttacccttcccttcgtcattaatttttttttcctatagtccagaaaagaccaacaaaaaaaaatagtagattagtttttcgatgatcctatagaccattgtgccttttccctagtacttgttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccatcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaatatcaaaaaaaaagttgtgcctctctcctcagcactagagagagcaagcaaaaaaaaaaagaggatccagcgagcacaccacaccattccccctttgtcaccaccttctaccaccggttcttgttttcgttgttgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtc

SEQ ID NO: 44878 - DNA, 1501 bp, Oryza sativa
tttttttccatggctggttgtgcatgctgacagtgaggcgagagaatcatggagtaagttgtcattcaaagttcaggtagacaaagatgaagaagattacaaatgtgtttgcaagttgtttgagcacatgggcatactgtgttgccacgttatcaaggtacgccagctttattttggtccttgtacttacatttttttacctctagagcatgcctctttcttcttaaattgttttacccatctaccataaatttgggtaagcgtatatgttgataagttaattcttgattcgattcatattctgtcagctttaatccagtgtatacatctgtagaaaaccatagttaccctaaaaaaaattagttttgatgtataagcagtttagtttatcatttccgtttttcattgttcatgtaggtaatgacacacataggctgcagaagcatcccagataagtacattctaagaagatggagtattagtgccagagaaggatctggcagcaaccttgagagcttcaggaatgacaaagatgctgcctcttccaggacacaccgccacacactgctctaccatgcatgtatagacttgtccaaacaaggtgacatatcggttgatgctttccaccttgctatgaaacatataactgacgcactggatgagattaaactagtggccggtaccaacgaatctcccatggggtacactgatcccccaaatgatgaacctgctggaccggatcaaggaggtgaacaaaatgaagaccccgcggctcatcaggccgtacaaagcttgccactgccacctgatcgtcgggcaaagcgtggccgacctaggtccaccaggctgaagtccccagtagatggtggagtccgaaaaaagcgcatttgttcgaactgtcatctgaaggggcactatagaactggatgccccacaaatccggagaacacatcgaagaacaaagtgatcaaggtgtgcacgaaatgcaagttagctggtcactatgcatcaacgtgtggtgttggtgtatagaagcaagtctatcgttgtttttaaatacaatcttgtaaaaatattcccatatcttgcgtgttgcacttggacaagtttttaattaaattcggatatgttttctatttcataattatgtcattcatcttgtgggatatacatgtatacgtgttcgctctgtcactcataaacctatgtgtacatgtacacctgtaaaagtacagattatgtcattaatcttgtggtattcagacgtgcattttttcactctctctctatcccgttgactatggccaattagtaccgaaatcactcgttggttactaaattaatcaattgatacccaattctgactggatcgatccatgttgacggtaacaaattatattatgtaacctatcggtcgtaatagctataaatattaccataaataagatctttatacttggtaatgatattaattttttcattccttccaacggagacacaa

SEQ ID NO: 44879 - DNA, 1501 bp, Oryza sativa
ccttttcttgaagcacaattgatcgatgatacaattacaaattgccacatcaggattgatccctttctcccacatgcttgtaaatagttttactgcagtactaagtttgccagattttgtaagcgaatttatgaatgtaccataggtgaacaggtcaggcttaagcttagacgcaattatctcattccaaacccttttagcgtctgccaagcttcccttgacacaccaaccattaagaatgatgttccagctctttatgacaggagggaactcatctttcttttggagaaagagggcctctgcttcctcaacatgcttgtaccgacagagagacatcaaaagtatctggaatccaaccaagtcaagctcaaacccataatccttcctcttgtagaacatatctatcgcctcctgcaccttgtgcgcgcctgcataccggtttaacaggacagcaaacatcctgtttgtgaccactgactggcggctctccacaggaatctcatcaaacagttgtctcatgagcctgaccttcttcatcctcccaagaatgtcaagcatctccgtgtaggcccttgacccatggttatactggggcagaccagctgcccatttgaagaaagatagtgcgactttccaattggacctctgcttctggagcacctttagcacaacatcctcatccatctcgtctgcaaattgattgagaacttcggcgagctcactgtcgccatctctagacttgaggattttaacgatttcgctgacatggacatccttggaaccatccaaagcggtagaatgacaaagccgtagagatccaacaacgcagtgaattgggagaatgctctggtgaaagcgtggatataagcctgccccgggaagctccactgaggcattctgacgaacagttggcgtgcaggaaccaaggaagccgagcctcctaataactacgcatgaacaaagtttaaattagtaccccgcacttaaattcagagaacgaaacctcgttccacttcagtatatgcattcaaattcagataatgaaacagtgcgcggtgtgatggactcatcaagagatgatgaaaaaaatcagaaggggccaagagaaaaagaaaaaaaaaagaagaaggggagtcggtgcaggtggtgcctaccgaagagcgtcctgctggacctgcaggcggcggagaggatggcggacgcccgcggcggcggcatcgtaccggagatgagcacgagagcggcggagggaacgggtaccagagcgctctctctctctctccggtcgatgactaaatgggctactaataactaagttaagcgaagctattgggccgacttgaaagcccactatgtgttgaatgggttgtggccgacgtgcgggcccgtcatgtaaggctgggcttgtgatggacacaagcgaggcccacaatgtgcgtgtccggcctacattgaggcccaaaatattcggagcaatcatacagtccggcccagatagcaa

SEQ ID NO: 44880 - DNA, 1501 bp, Oryza sativa
  unsure (1)..(1501): unsure at all n locations
ctttctccatcctaaaatgtttgacgccgtacttttttaaaaatgtttgaccgttcgtcttatttaaaaaaattaagtaattattaattatttttctatcatttgatttattgttaaatgtacttttatgtatacatatagttttacacatttcacaaaagtttttaagtaagacgaacggccaaacggccaaacatgtttaaaaaagtcaacggcgtcgaacatttagagatttagggaagaagggagtagttcagaccctgtatagatggcactaaaacttttaagtcctatcacatcggatatttggacactaattataaatattaaacgtagactattaataaaacacatccataatcttggactaattcgcgagacgaatctattgagcctaattaatccatgattagcttatgtgatgctacattaaacaatctctaattatggattaattaggcttaaaatatttgtctcacgaattagctttcatttatataattagttttgtaagtaatctatatttaatactttaaattagtgtctaaatatagggactaaagttaactccctggatccaatacactaccccaatatctctaaaattactggacacggttgcattctgcgacccgcaaacgacttttggatccgtaacccgttgacacccgcgacccctgttttcgcttttctttgggccctcctctctcctctctctcttcctccattgttcccctcctccccttctctcccctctcctcctcgcttccggcgagaagctccggcgaggcgaagcctccagaaccttcaggagagctcctcaccgaagggacaaggggccttctagaaccttgctgcttcctcccccaaaggttagatcagagcaagggcagctgctctttcttctttctttcttcctcgtttgtcttcgtttccaccttccagcgaggattctttgtgtgtttaatgggattttcgaggtgtggtacggcttgattggagaaaatattgttgttttcgtgacgaaatttagtgaggtattgtggggaaatcgagtggcctttttagcgaaaggaagtgtttttttttacttgatctgtatttcgaggtatgtgtgcatcaacatgctgttaatttggtagtaagtctgataaattgcttttctttttttttgtctctggatttttctaggcttgcagcgctggattggctccgaagatcttaattttgctccaaaggaaggatcccccatcgcaaatcttgatctgtgggtggatttggtgggttgaaaactccatcttttatggggcaaggctatgcgaaatccttgatgctcccatggagttctcctcccatggggcaagaggtgaagaggcagtagatagaggaggagcaagaggtggaagcgaagagaagtaggtgagaataggaaggacgaaggataaggagaggagggagctctccntgggagagcccctcctccccaccctgtccatggaga

SEQ ID NO: 44881 - DNA, 1501 bp, Oryza sativa
cattatagcatgctgatttagacttattgtacctgttctaagagatccatcggctgcctaaaaaataagctaaagcaaaatttaaattttaaaacaattttaacatattttcaacatagttttttttcagtgttaacttttaagtcactaaaaacacatatataaaagttttgcacacaaactattttttgtttaagttggcaacttttctagcaagaagacaatcacgatcaggacacctaaatgcgtggtggtgatttagagtcgccaaccacctcaacctagcaaaagctagatcaagatggttttgatatattaaaccgactagcagagccgatttagatggaacaagcgataaacacccgtcttgtgggtgaacggaaggtttacgggacaaacctacagagggatttcgcactctcgcgacgaaagtggatgatttacagtgcaaatcgataaagactgacaaactaagctagaactaggcgacaatactcttgactctacctgcaacaatgctctaccttctctcatatcaccagtcatcttgccaagtgaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaaattccttgtctttcaacccatccacttttccagcttgatagccacccccttttagtattgccgaaatcttgtttcgacagttgccgcgccaggtaggggtagcatcaagttcttcgccgactagtgcga

SEQ ID NO: 44882 - DNA, 1501 bp, Oryza sativa
gctgcagcaaatacagagctccctcgaactatggactcatcgagctaaaggaattaccaagtctaagattgagtcttggtgtcaactcctacaattagatccttaatatgtaaatgccacttgtaatttttgtaatttattttctcctcctttctatttgttctttttcttttttaactttgtaccacctcatttctatagatgaaatggctataaagtagagccagctctaccttcttccgtcaaaaagaaagaacatgacctttgaatcaagcttgttaacgaacttttcctgccacctagttatgagtataatatggcttacatttacaccggtgaaaatgaaaatgagaaaagaaaaggcacaatgagaaacaacagatgatatcctatctttctatatatatatatatatatagagttagtacccactaagaaacatttactcctataaagaaagacatgcaagtagccacatcatcaataattttaagctattggatcgcattagtatagagttatcaaccgttggatcaagaagctagctactcatccatctaatttaatcattgattattcatccattcacctccctttagctcataatcgcgcgtgacattgttatccagtgtgcacatccaaatcctcaaagataatactactctttttcaaaaaaaaaatacaactccaattattatataagatgtgagctttgttttgttataaacaattggataacatacaataattagatatcattaatccaaactcatttttgaaacatgcttgagatgaagcagataagtgctacacaaccttattgtgacgatatccaaattgtacatgaaaataactttcatatatcataacaatacacaatgatgtttcaaaaaataaaacatgaattgtattgttataacagaagctatataaaaagccgcattataatctattttgtatatacacagagttacatctaatcatttaaagcattgatttgtgcggggtgccaactagtatttattatgttctgttcttgtttgttgtgacgaaggccctatttggctaatgggatagggaaataatttcccacccactaaaagacatctttaaatcttaaccattcattctccctcttctatttaatactaacccttcattcatttctcaatctcaatcccaccccacatttcccattatccaaacacacccgaaatgttttgatcacatggacgaaattggcggggtagctggcagttttagtagcattaactgccaactgtccgctgctaatctgatttgatccaaattatgtggttattaatcaaatcccatagccccataaatacataatccccaaccggtaagatgctcaaacttgtatcttggtgcttctgatgttgcgatagtgtgatgcttgtacatcttggaggagtagagtatcccggtcaaagccatcagccatctcgacgttttcttccatctcgcatatttcctgcaa

SEQ ID NO: 44883 - DNA, 345 bp, Oryza sativa
aacaggtagggtgcggtaagcctcgcttctccaagcagtcaatcgtccagcaacggcgatgagcgatcaaccacaggaggtagcgacatcgaggaggggtgagagaacgccagataggtagatgctgaaatggaatccttcctgagaggagggcgagttaggccgagcgggtggaatacgaccccgagttttcccacctccagatgaaggaatcaggctggccctcagagagaatcattgacctcaccatcgaccaaacctgcaggtattgcaaaattgcttgaacgcccaaggagccacgaaggtcgcggatccatcggttgttggctaacacatcagcgaccg

SEQ ID NO: 44884 - DNA, 1388 bp, Oryza sativa
cctgccaccctatacttgggcggcaagctgacgtggcagccggcggcagacggcgccgcattttgcatttaggtccttgcctgcaaaatgcgcagagccaacaaagcattggctagggttttttttgcatctcagtcccttacagctgagatgcaaaaaaccgagccaaaattgtattgataacactttaaaaaatatttattggtaaaaattgttaataataatttataaattgtattaaagttggttgtttcgcaatttcatattttaggtaagagttcatgttgtattccctctgtactcctaaaggaagtcatttaggataatgtttaagttaaaccttaggaatataaatcatgaataactcttaaattgttgagtttgaaaatgtaaaagttatatgaatagatttgtttaggctttatggaacgaagaacctgacaacgatcaccgcctccgcattttggacgggattcccatggagggagtgccgtagttagcacctgtcagtcgcactattattcacgacgttatcgttcgtaagctgcttttctctgcaagtattgctcagtactttcggatgagaaataccagtgtcgtttcttgtaaacaagtggttaggacgagaacgggattttctgtatggacccactcgatgtattcacaagccgtagcgcaggtctgacgaatagagtgggagggtgaaaaataaacaatcgctcgtacaaactgaataagcatatgcagataataaaatacctcacgattatagttagggcacctaaaaaagcgtcttcctcgaatgccaggattcatcaaagccattagttggcatcggtcaccacaaaggtagagaggccgctgacaccaaggtggtagtaggtatgcacaaggatcgctacgccagttcggatcctcaacaccccggcgtctagccattgccgaaaggtggtgggatttacaataaaactagtgaggacgagagtattgaatgtgacttatgaaagtttttgccgcatcgctcattacgggggcttatgtaggcacggaaatcacaatgataatcttgacatgtctacatcatggggcatggtgggtcgcactgattggcgccgaaagttagattggacgtatgcggatgtatatcctgccgccctgtatatgggcggaataaggccttccgccttttagagagcggcatggcgccgaaagtaagattgggcgtatgcagatgtgacatgtaagattggacgttttggaagaataagggcgtgagaaggcattccgcagttgtatcgcactcgaataaaggaggctgcatcaatgcgaccgaaagtactcgtgcatgcgccgaaaggtatcgtgctttcgcaaaaagtaacagcgaa

SEQ ID NO: 44885 - DNA, 460 bp, Oryza sativa
ggtgctcacagggggttaaagaatggcttggtttatttgcataaagctagttttcacaattcatttcacaatcctatgacttagcagttttaatgttaatgttgaagttatcattaatcgagggttcatccaccttcccaagcctcgcttggttcggtttacccttgcattccattttacaccaactctatcatactaaccttcccgcacatcaggcaaggttactcatgccttctcatatctaaactaagcagtatcaaaatctatgagtctagtcaagagtagtacaagtccagacgcttattaaccacgagcatggctattcaaatatattggtttactcactgcagtggatgtacgcttttaatcccgcactccgtgacttgcccaacacaagagcccagtcccaacacatgagatgcgccacagcccgacttttcagtcgttcttgcttttcagc

SEQ ID NO: 44886 - DNA, 1501 bp, Oryza sativa
gaaatggtttcttcatctttttacctctttcctcattaactctcttgccacatcaaatttttgcttatgtgacaatgtatttaggtcctgattgtttcagcttaagattattgtaatctagattattgaaccatattactataagctgaattataataagccgccatagaataagctgcgagctgtttgtttccctggattataagttgttttttagttgttagccacccaataatctaaaaaagcacctttagagtggattactagattatagtaatatggcttatagattgtaataatctatcataatgagctatatgtttgttttagcttattcctaataatccagattataataatcctaagctgaatcaaacatggccttaatgctatggacacgatatgacatggagggttggggatggcctcagggagttgaaactagctgcatacacggtttaaatgcacaggccctcatgtggaccaatcggcttcccagtggacgacaggcctccatgcatgtgccatgtagacctgcggttgccgatatgttttgtggtggccaggtcagtctgcagctgatcgataggtggcgtggcaggtcctgtcgttttgtagctggttgatgggactatgtggagttaggctgacagactttccggtccacatgtgtctgatatgggcttgtcggcctcccctagaaggtccctatcaaacaacccaagaccgtcatgcttctatttctatgatttttgacaactgaacaatatttctacgattttccattaaaataatgatatatatttttaaacattctaactttcacatttgtgtggtgtaatatgtagcctctagcctctttttcaatcatttgaaatcattatgatagtagcaatagtctggaatttgaatacatctagagaagtttcaatgttgagaaaatcatcttgttagcttcttcctaaggagagaaaggaagtgtcctgttagactcaattagttcccccccaaaaaatattttcttattactgtaaccttaattgttgagaagggttggtgaggtctccagtgtcttctactcttccacaaattactgcaaggttgttcatgatctggggcatcttgcggagcttccctgaggtaatatcaggaccttactcccaagttattagatagtttctatcttcaaaacaagttctggattagaaagcacttcttaaaatgacaaaacatactatatgttaggtaatgtttcagctattagaacatatcccatactttcgtaatgactctgagtaggcattggtcaaaccaaagcggcagaaattgcataagtaatgaagctgatgcaatcacattgtggagaaggataaaatagtgtcctttccttccgcagcatcctagtttcctatttcctgtattttaacttctcatcaagtaattgttttgtttataaacaatatcggtgaatcactgtccacatgttttgcagatacacact

SEQ ID NO: 44887 - DNA, 725 bp, Oryza sativa
ttaaaatttaaatgaagaaattcgcaaatatacatttaaagagcatataaacttcaaatggccatatcttggccatttgaactcggaattggaccgttcaagtctctaatttttccttaagaagtcaagaacccatttttgtgctttgtttctgcttgttatatggagtttagtagattaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattggtattatttctttgttcaccctagattaaacaaaacccgaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggt

SEQ ID NO: 44888 - DNA, 402 bp, Oryza sativa
atataagatatatgataactcgtcgaattacataaacaagattaaagtatcatgaagatggaagcactaatcccgagaacgcaagccaccataacaagttttacctcttgttgaagatcgaaacctatgcagctcaacctgaaagcaagaactcgtcgaaacaaaatgaaaataaaagagtggcgatgcgccgagattgtattgaacgtgtgttagtttgattacatggggctcggatctatttatacccgagaattacaaaatatgttcatatcggacacgactcttatctctaacaaactctaagataccataagtctttgcaacagacttttacctaaacatatctctaaggaaattacataaaatatactaactaatagatacaattgccttctcagg

SEQ ID NO: 44889 - DNA, 1058 bp, Oryza sativa
ccacattcatatagatgttaatgaatctaggcacatgctagaaagtcttataacctgaaacggaggaagtaatacttatggaaatttcctatgtggattatgtaatgtcgtggaaatttcctatacgtatattatgcttataaataatttctgatccaaaaaagttctagaaatattgtaataaactactgaaactagatgctcatagtatgcactgtagtctgaagaagtttaaggaattttttttagataatggattttcattaatccggcctctatatccacgagggatatacacaaccaagaagtttaagaaattataaccaaaatgtaaaaaaaagaagtgtttgaatgcttgcttgaacaggatgaagcaacttgtatgtacctcagtgtgtttgtcatcgtccatgacactagtgtcttcatctttcagtggaacatatgaacctcggcgtctacttcctacaattattttttcatctaatgcaaattataatcgtgcaaggagaataatttataataaaaatcataatcaaagcagaacactgttttggtaagttttacataacaaggaattaagtatctactgtactaccactaagagtcaaatagtaaatttcacactgttttagtaatattgctcatgagaaggcccctggggtattccggctagcaccacaaggtagtgggctagccggtccgggttcgagcctcactcctcttaataatttcttatatgagagcccctcctctcatatccaatgggttttttatggtaatatttctcataagttacataattcgcctaaatatcaaatggaagagaagcgcttgctagcgcagtggcagaggtatgcggattcaaccccgaagtcccgtgttcgactctagtgcacgctcgcatttcttcttaattaattgacaccaagttcctctttagtgtccagcgtttctccttggtgtcttgtgtgtgtttttttttcaagcaaaaaacctttccaaccacatgaatttgcacagttgtattattcaactacactctgttgcaccatagt

SEQ ID NO: 44890 - DNA, 1501 bp, Oryza sativa
ttcaccgatattgtttataaacaaaacaatcctctgattgattagaagataaaatacatggaataggaaactaggatgcagaagaaaagagcactattttgtccttatccatgatgtaattaattgcaacagcttcattacttaagcaatttcagcagcttcggtttatccaatgcctactagagccattatgaccataaatgaaagtatgggatatgctcttatagctgcaacattacctaacatcaatgttttgtcattctaagaagtgctttctaatccagaacttgtttttaagatataaaccttcttataacttggagtaaggtcctgatattacctcagggaagctccacaagatgccccagatcatgaacaaccttccagtaacttgtagaacagtagaaggcactggagacctcaccaaacctttttaacaactcagatacagtaataagcaataatttttttgggggaaataattgagtctaacaggacacttcctttctctctttaggaagaagttaacaagacgattttctcaaaactgaaacttctcttgatttatttaaattccaggctattgtttttgaaacgagccacacaagacagtgcgagtttcatgtattgataaagcaggagaaaaatacaatctatagtcctagaagaccacagacaaaaaaagaaaatacaaccacaccgcgcgtctacaacaaaacccactgcatgagcaaaactgaaggtcttcgagacgacaccttcaagaagggtacgacaccaaaagtgccgctgtcgcctgtcccggagggccaggacaaggttttcacctgaagaaagtaattgggagagacaagaaaagcggcaacaccccaagaggaaaaaacggcacccacaggcgtcgttgttgccggctcgaaggcagagctttcgcccaaaatttgtctctcccaagaactgaactcctacacgctccgcagccaccaccagcgaaaaccttcgacgcatggccaccgcaccggcaccacgccgccagtcaatcgccatggggaagctcgaacctcgacacacaccggctccatccacgcagttgggttggatggggagagggtgagagagaagaatggatgccctctcccccacactagcccgcacgacgtggccaacttttgccgacaaagtcgccgtcgcaagaggacatatgtctaggaaggtgcacgtcgagaggaccgcggctccccctgacagagtaaccgccggctccgccacgaatccgttgtccatgtcacctcggaccaccagaccgttacaccggcgccatgccaccctccgcaccgtgctgttgacccctccgccacagtgcacccgccgtccaaaatgacgcggcactagaacgtccaccgaagcacgatgctctcgccccaaatccggtggaggggatcggatcttgcccgggggaagccagacgcccagctgtcgcgcggcgttggctgcccaccgcagc

SEQ ID NO: 44891 - DNA, 1501 bp, Oryza sativa
ttagtaacatctatcacactaaattagtttcattaaatacaatattgaatatattttaatagtatgtttgttttgtgttgaaaatgttactatatttttctctaagcttgatcaaacttaaaaatgtttgactaaaaaaagtcaaaactaacggatggagtagaagtgagatcgatattcatgcataagtcaggctgtgtttagttcacatcaaaattgaaagtttggttgaaattggaacgatgtgacgaaaaaattaaaagtttgtttgtgtaggaaagttttgatgtgatagaaaaactgaaagtttaaaaaaatattttggaactaaacatggcgtcaacaagttaccatccgatgaagacaatccagttgtagagagagaggtagagcctccgcacccctgacgcattccctgccattgcaggaaatatgcgagatggaagaaaacgtcgagatggctgatggctttgaccgggatactctactcctccaagatgtacaagcatcacactatcgcaacatcagaagcaccaagatacaagtttgagcatcttaccggttggggattatgtatttatggggctatgggatttgattaataaccacataatttggatcaaatcagattagcagcggacagttggcagttaatgctactaaaactgccagctaccccgccaatttcgtccatgtgatcaaaacatttcgggtgtgtttggataatgggaaatgtggggtgggattgagattgagaaatgaatgaagggttagtattaaatagaagagggagaatgaatggttaagatttaaagatgtcttttagtgggtgggaaattatttccctatcccattagccaaatagggccttcgtcacaacaaacaagaacagaacataataaatactagttggcaccccgcacaaatcaatgctttaaatgattagatgtaactctgtgtatatacaaaatagattataatgcggctttttatatagcttctgttataacaatacaattcatgttttattttttgaaacatcattgtgtattgttatgatatatgaaagttattttcatgtacaatttggatatcgtcacaataaggttgtgtagcacttatctgcttcatctcaagcatgtttcaaaaatgagtttggattaatgatatctaattattgtatgttatccaattgtttataacaaaacaaagctcacatcttatataataattggagttgtattttttttttgaaaaagagtagtattatctttgaggatttggatgtgcacactggataacaatgtcacgcgcgattatgagctaaagggaggtgaatggatgaataatcaatgattaaattagatggatgagtagctagcttcttgatccaacggttgataactctatactaatgcgatccaatagcttaaaattattgatgatgtggctacttgcatgtctttctttataggagtaaatgtttcttagtgggtactaa

SEQ ID NO: 44892 - DNA, 1501 bp, Oryza sativa
ccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtctactaatgattacatcgagcatattgtaaatggcatgattctcattctcattctactaatgattgcaatgtgtttcgacgataggttcaatcggccatagatgaaggacgattgaagttcactgatggctccaagatgaatcttgatcatgatccttttccggtgaatgcgattaatttcaatgataagaaggtgttgattcggccggagcaagccgaatctactaaaggaaaaggagtaatcattggtgaagcaaggcctaaaatgatagtgccaaagaaaccggaggttggcgtttggaaggaaaataggagtggagcttcaacttctaaagcccctagaaagaccaaagtgacttttgatatgcttttggaaaagtatgagaagcaaggtggtgagagggttcgcaacaaaggaaaaagaccaagatcacttcctagggagcgatttggtcattcaccaagacagtcgcattcacctccatatcatcatccacaagatatgtcatggggttcttatccaatggccaccgccgggttatccttatccttattacatgccctccaatgcaattcaaccaagggtggggaggaccgaggaggccaattcatgagcgtttattttcaccgaacaacggccggttatatggtaagaatcgggctaatgaagaaaagagggaaagaaagcgcatcaaggtggaggtaaggacttcggaagtaattaccatcaaagtggggtctcatgatgtgtcaataccttctggagatgaagttggagagtcttcaaggaaaaaatccgaggccggtaccagctcatcgcagtcggatggtctgaccaggccttttggccggtctgaccgcagccatacagccggtctgatcgggccatcaggccggtctgaccgccgacccgacagcggtccgaccgacccctcaaggttgtctgccgggcgcccaaatgtcgttttgccgggggcatctgcccgttctgaccggtggtctacgtccggtctgacccggctccagcgccggtttgatagaaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaaccggttgttgtagaggagaaggaggaacaatcggttgataaaggtgaatcatctccaaaagaagaca

SEQ ID NO: 44893 - DNA, 1501 bp, Oryza sativa
gattatttatatagagcaagggtgagtacgggagtactcagcaagccatgggaaataagtgtttaatataggtttcaaggaaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgaaacaaggttggcacccggccaacaacttttcaaacggccacccgggccaacaactttcaaacggccacccgggcctagctgatcccatcagctgcagatctttcaaacatcgaacccctttccacaacagcaatttcacaagcaagagtcaaacaagactacgctaggaatcacctcacatccgcccatgaccgtgggcacggctgttcgaacagtttgttaacctctgcagagggggtacactttacccacacgacattactaacccggatcacccagcccgtggggattagccacgtcgggagacctccaagctttcatgacaaggcatttccaaagccaacacaggtttatcatatgccgacgagaggggtcccagaccaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagttgttattcagattttaagtttggaggcgtccgtcgatacttgcacaggatgcacgaatatcgagacgcaactagatggttacaaggggacatgacataacaattaacaaggaaggatcaaatgcaacaaattaggtaggtccgccaatctgccttgcagacgggacaacagattaagtgcgatcctatcaatgcataatatttttcaagtaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcatgccattagatagatctcgagatttgatgaattttggaagttgaacggagtcaaacggatttacggttgggaagatattgaatttctaagattattggatttttggtctaaaggaaaaggatttaattaaatcctttttgaaaaaaaagaaaagaaaagaaaagagggagggaaaatagacttttcc

SEQ ID NO: 44894 - DNA, 1501 bp, Oryza sativa
tctttaggacctaatgagaattgagcaacctcggcttcatccatagcacaaaactgcataggcaacatacataccatgttcatattcatgtcttcttttggagatgattcacctttatcaaccgattgttcctccttctcctctacaacaaccggtttttccttctctatggacttatgcctccataccggtggtggtcgcaactcattgaaccttttatctctttgctcttcggcttttttctctcttatctcttgagcccgaagacgttgcaaccttctcttttgagtagccgtcaaatccttaggcatccacctaggatccggctctgttccaggaggtaaataatgccctctattaaccttgtttgaagacgatgaagccctcacatcgccctttgcaaaccttctatcaaaccggcgctggagccgggtcagaccggacgtagaccaccggtcagaacgggcagatgcccccggcaaaacgacatttgggcgcccggcagacaaccttgaggggtcggtcggaccgctgtcgggtcggcggtcagaccggcctgatggcccgatcagaccggctgtatggctgcggtcagaccggccaaaaggcctggtcagaccatccgactgcgatgagctggtaccggcctcggattttttccttgaagactctccaacttcatctccagaaggtattgacacatcatgagaccccactttgatggtaattacttccgaagtccttacctccaccttgatgcgctttctttccctcttttcttcattagcccgattcttaccatataaccggccgttgttcggtgaaaataaacgctcatgaattggcctcctcggtcctccccacccttggttgaattgcattggagggcatgtaataaggataaggataacccggcggtggccattggataagaaccccatgacatatcttgtggatgatgatatggaggtgaatgcgactgtcttggtgaatgaccaaatcgctccctaggaagtgatcttggtctttttcctttgttgcgaaccctctcaccaccttgcttctcatacttttccaaaagcatatcaaaagtcactttggtctttctaggggctttagaagttgaagctccactcctattttccttccaaacgccaacctccggtttctttggcactatcattttaggccttgcttcaccaatgattactccttttcctttagtagattcggcttgctccggccgaatcaacaccttcttatcattgaaattaatcgcattcaccggaaaaggatcatgatcaagattcatcttggagccatcagtgaacttcaatcgtccttcatctatggccgattgaacctatcgtcgaaacacattgcaatcattagtagaatgagaatgagaatcatgccatttacaatatgctcgatgtaatcattagtagaccggaaataacccaacgggcattccttacgtgcgtgcattaatccttgtccc

SEQ ID NO: 44895 - DNA, 1501 bp, Oryza sativa
tatttaaggcaaaggggttgatggaagttgtgatatccgagccagtcagcatctttatgtctaacaaagttggagtcattggtccatgattgaataaaaaactattgaaagtattggaccaaaagtagttggctgctggcagcattagttcatctttcttgaaatcggctaaggatagagctaagcattgggctattcccatctcttcccagtgattttgcttagaagctgatatcctttttgtggggacacccaatttaggcctggtgccccaaatatccactcgtgatcgtccaggatttcgatcacgcacatattgatacacataatagctttcgattatttacacaaatttgtttatacaagctaattatacaactgttaaaggttgaaaagatccaaactaaaatatccttattgtaaaatacaaggaaaatccaaagtattaaactattaaacttcaactaataaactccaaagaactccacaggcaaaagctcgagtgtagactagcctagaagaaaaacttgtcgttgccgtagatcttgcttccttccagtcttcttgttagcttaactatatgtcaaattatgcaaggatgagtacttatgtacgtactcagcaagacatattataaataattaggtgtaaatagatatgaatagattaaacaataataaagtaaagaagtaataaaaatcataaatcatctttatcctcaacattttaatttttaaaactacttatacttcaggagtaggaatcaccctgatgacacaactccaaaaccgggagtacggcacattcgaatgatttaattcacctctgcagagactgtccagctttacccacacgatgtcaacagtttgcaaggttgaggacaccagagccgttcgaaggtcccatttactactagttactgcacgagtgggatattgatccatcctagcagtcgggcacttgctaggcctaggcaaggctacatggtcgctgctttcacgggttccaccgttgtaaaccatgcccccaacctccttacacatgcattcaccccaatccttctcctagtgagccaaccaacactctttcatatagtgggataatgtactagtctaagtccaattacttgatcgtgtggatggacgcaactatgtcatttccatggtataagggggtaaatataatccggttaaaccaccccaaaactttccaaactccccacaccaacaaacttcatcatatatcaacattcataaacctcaatattcataatctcaactcataaatgcccattttaaccggattcctaagtttgtaaagttgtttggaatagtaaatcacataaaatgataaccaatgcttccttttataggctcatgcaataattcttgaaagcattaccaattaccacaatgttattctaaagtataacatctacccatgagatgttaaaagagtaaatatcatgcatcaaatttaaatctgaagattatatcaaggt

SEQ ID NO: 44896 - DNA, 1501 bp, Oryza sativa
aagcaaatattaagcgatcagcatgttttcatgttttgtgcctaggataagaagttaccatgagtggttgtgcgcctcgtttggcacaattgtgtgcctcgtttatcatcaaacttgttcctgtatatgtaaatagcacgcagattagtaagttagatgaaactggacggacggatagcttaaaatttgcaatatacggtaagaaaatgtattcatgcaagggaaataagggaacagaactaataaatcattctaggaagtgaaccaatggagcattctaggtagtgcaacggatgttttttgagctgttaagcaggaaggtatatatggaggcaatacgcctgctcctaagatggaggacggtgcgtgatgactgacagccccatcatggaataagcccaacaacatattcacaaccgaaaaataatttgtgaatacaacttttatatacatgttgttgataatctaaaagcaaatgctaaaaaataaactacgatgaaaaaaaaatcctaaaatcaactccaaatttaaggttgaaaattcaaattttgactgataagtataagtataagcgaaaagatgagaccattactatacaaaatatttgagaaatggaaggagggttacgaagagagtagatgagattaaccatgcatggcctctagtctacccattattgtggcagtttctagtttgaagctgctagcaatggtggcttttatggaaggggaaacgagcgcgacgctctagtggctcggatgcggcacagggcgagtgagactggttggcgatggcgagatagatggggcaacgggagcgtcacaaccctatcgtgcgagcatttgacggctgtgtcggataaagcatatataagtgttgatatttcttacggtcatagataaaatccacaagcgcatggagataccgatgtagcacttcacccgggattattccaaggtatcgattttccaagaaaatgtgtgtattcaattcctcttcaagttcatccaaggatacaaagcaaaaataggcaaagggtagagaggattacctagggaggaaccgtgtctacagaaagcttaatttaatcctatcacaatacttcagccactggcttgctcgctgctaccagaacgtgttctactctgtacctagatagggaggacttaagtaatctcgagggctgtcaccacctctacacctacctctaacgaactatgggatacacatcaaatactggtattaaataatatagacaccactgtaggatcgagatgtcgactagaggggtgtgaataggtgatttaaaattacatgacatctaatcaaaactaacataagttgctaggctcggtgagggacaagtctaactaagcaactaagttatgttttgcaatcctagggtgaaagtggctcaagtatatcactaggaaagtaaatcacacttcctaagtctagtttagcaatcctagggtgatatgatctctagtatatctctagg

SEQ ID NO: 44897 - DNA, 1501 bp, Oryza sativa
gcagcctaaagccacgaaccaaactcatactagaagtcctaatccacctaggaaaccttctcgtacaagaaaccaactttacaaactccaatcataccaaatttgaactccttccaaattcgacttcgcatcccatacgcacacaatatctccatcgtatgccatatggaatattcaccaaccacatgcattgcactctagcctaagtatcccgcatgatatctgaccgtcacggacgtcaccttatctccaagtcaactcccgatccatcaccgccaatactctcccgaggcatcaagtcacctacacatgaatcaaacaaagaaaccatattccgagaccaagctatctccaacctgactcattgttagcaaacaacagtattacatacttcactaaaaaaatgctttgtagagacatttttctattactgtagaggcacttttcaaatgcctttacaatactgtagagacattttaaaaaatgtctaataattgtgttatggtgaattgtctctacaaacgaagagacattttgtaaaatgtctataagatggtagaggcattttctagagacattaaattgtaccacagacttatgaaaccagtcaaaaagataataaaatggtcttcttgcatttgtcaagccttgaactcaagatttcttgaacaaataattttatcttcaatgcactaatgtcacgcctagaaattcacgaaccagaatttctaagctgaatatgcattaaacccctgtccaggaccagccagggtacacaaacgacaattgttgacatacagatccacgtcttacaaaaacataaaagattacaaatgcagcggaaaagataaaagcgagctaagcctgaagacttgactactgcagcgggcgactccattcctcaggcatccttgacggcagcgacgaaaccaacttcttcgagacatccccaactgagaagaacttcaactctggtgtgggggaaaagagagcaagactgagtactacccactgtactcagcaagtcataccggaagagaaggtatgatgcaagatgtatccaaaggaggctaaaggttcttttgcataaagcgggcatttaaaagcagtagttgaaagcagtaaaacagttgtagtaattaatcaatattaaccaatcactgtccaacgccacaccacgttgcaacaggcccaacaaaccacctgaactacaccagttcattagctaactaggggtgagactaatcacggtgaatctggttgaccgcccataaccgcgggcacggctattcgaatagttttactctgatcagaggtttacaactgtacccacaagacacagtcccacgacacgttcctgtgcgccgacatgccaccacgacataccggaaagaggccgtgacaggacccttcgcataaccctctctaaccgatcgcaccacacctcagggttcacccccgtccccagcaggcaacgggcagcccccctctcgtgccgcgg

SEQ ID NO: 44898 - DNA, 1501 bp, Oryza sativa; identical to SEQ ID NO: 44654

SEQ ID NO: 44899 - DNA, 361 bp, Oryza sativa
tcatcacggcaattggcctcctcgacctcgacgccatggatggagcaccgcctggatggtgtgaaaaaagaagagaaaaaagaaagaggaaagagagagttgacgtggtatgctgacatatggggcccacgtgtatcccacgctgactcagccgccatgtaaaccaaaccggggtcaaaaccaccaaagaacctcggttgaccgattttgtatagttaagggaccccgcatatctggttttgtggttcgagaacgttttttatcccaataacaagttgagggaccttcggtgtactttttcaaactaataaacagaactcttctaccccgttatccggtattatattgcctgcctgccagg

SEQ ID NO: 44900 - DNA, 1501 bp, Oryza sativa
tttcatgaataatttaaattgaaaaaggattttaaaagtctcttttggctttgggccgaaagtcggcccaaaaccttctctctctctcggcccaggtcggcccaagccgagcgcccgcccgcgcgcgcgcgttcccgtcgctgacaggtggggcccgcctgtcggggtcgtcgtcttcctcgcgtcggccgccgcccgaacctagccaagccgtgccgccgtctccttccaaattcggccgcgtctttccttctccggtgaaatcaatagaggggaaatgatcttcgggatctcctctaccttttctcttttggaatcgtcggctaatttcgtttggaaatccgtggattcgagtttgattcggatcgaaccctttcctccgaaccctaatctttccttcttgtcgccggtcgccgtgggccttcgccgccgcctccttgcccctataaaaggatccccaagcccgccgctacccgtcgccaccctcgccttcgtctctcgccgtcggaagagccctagcgccgtgtgacctagcgccgccgtcgtcgccgccgctccagccgtgcgccgccgtcgctccagtcgtcgccgtcactcgggaagaccgccatcgtggtcgccgtcgcgtcgccgtcctcgtccgccccttcgccgtcgctgttgaccgccggagcaccgccgtcgtcgtcaaaccgaaggactccgccgccttttcctcgacgccgccgtcgtccgttcatcttccaccgccgttttggtcatcggtgagttcgccgcgtcgcgttctacgtgctggtgccctccgttcgcgtcctcgcgccgtcgttcgccggcgagcatgcgcgcccgagccgccgagccgccgccggaggtgacgtcaccgctgacgtcatcgtggccgcccgtcgtgatccggtcgtggaccgcttgatctcggccgttcgttttggataagatcgatctcggccgttcgttcccgtgaaccgccgccgtgcgcccggtccaccgcaaaccctagccgttgacgcaataattcctttttccttttcaaaagtaattcattatggcgtcataattcaattaaaatccatataagtgttttaatccgatttaatctttaaaaattcataactaattcatcttagctcagatttagttggttcaagtctctaaatttttctaaaattgagatctacatgttaaaaatatccacatgtactgttcatgcttgtttatgtgctgttttggtgattttgctcttttctgtttagattccgacgtttccggagagtccgttttcgcaggagaagaatttgaagagttccaaggccagcaaggcaagtcacacagatcccaaacaaccctttgagcatgttgatcccgtttaaagctactatttctattcaactattgcatttattttcgaatgtcattggatggaattaacctattgtttgttatagcccttttgttcttgattactttattccttgataccttg

SEQ ID NO: 44901 - DNA, 1501 bp, Oryza sativa
cgtactattaagaggggtaatgaccgagctaagagatgatttaaattgccacattaggtcatttgcatattcacttgtcctcacatttcaaatcacattttatttctttgtgcattcactgagattggcctgaccagggccagtctaaccgcttgctccaagccggtctaaccgcaggtcagaggccggtctgactggccacctagtggcggtctaaccagcatgactggccggtctgaccggcggcacttgtgcggtcagaccggccccctggaggccgggatggtgttgctctggtttgggcgatatagagccgacggagccgtattcggtctgaccgagccgaggccggtctgaccggccagggcaatggggcccaatgacagggctacaatggttagaaaactagccgttgtagagtagcacggtctgaccggccacacacctccggtcagaccggcagagcactgagttgggggatttcgcccccaacggctagttttggtgggtgggagtataaatactcccccaccagcagcaaggggtctctcttggcacccaattcaattgcatacaccccttgcacctctctcacacacatttgagcttagtgtttatccattgtagtggttgaggttgttctagccaagagtcaagtgcattgcttccattgtagagctagtgtggcacttaatcatctccgagccgcgtcatcgcttgttactcttggaggttgccgccttctagacggtttgtggaggagttgcctggtgacctctccgagaagattatggaggaggcccggtgctggtttgtgagtggtttgaagttcactaccttcggagtgaaggaaaaactaccccgagtgatcgaggcttgggtagtcctctccggtgggccggctcccgccttgcccaccccttgacgaagggggcgtgcggtggcttcgtggttgagcggtggagttgggctcgcctcaacggggagtaggaaaccggtgagtttcagaacctcggtgaaaaatctcgtctccttgtttcatttacttgttgcatttacatttgtgcaatttacattcctagagatatactagagatcatatcaccctaggattgctaaactagacttaggaagtgtgatttactttcctagtgatatacttgagccactttcaccctaggattgcaaaacataacttagttgcttagttagacttgtccctcaccgagcctagcaacttatgttagttttgattagatgtcatgtaattttaaatcacctattcacacccctctagtcgacatctcgatcctacagtggtgtctatattatttaataccagtatttgatgtgtatcccatagttcgttagaggtaggtgtagaggtggtgacagccctcgagattacttaagtcctccctatctaggtacagagtagaacacgttctggtagcagcgagcaagccagtggctgaagtattgtgataggattaaattaagc

SEQ ID NO: 44902 - DNA, 1501 bp, Oryza sativa
cgcgagggcgacgggcatgcggcaggggcgcggggcgcgaggcggcaggcgcgcgacgggacgtcgggccggcgcggcagcggcgatggcgacggcgcgcggcggctcggggcgcgaggcgcgcgcggcagaggagggggcatggctaggaaacctcgtcgagcacctactgcgcaatgaacagtgctagctcctatttaaccctaatttagcctattccctatataaattttattctataaatcctaatttttgcacaaattaagtttactcaatatttgtgttatttcaaccaatggattcaccctggattaatattacccatattttatttttatataatttatttgaattttaattagggctaattcttattccatcgcacttaaatttaattattaccaatatggtcgcggtaatattctatttatttctatctcgcctaatctttattttaaattatatttcaattatttattttgccaatttatttttagggtttattcctaattgattattctttactcacgatcaatgaactccgaaatcaaatccaaataaaataggcgaataaaaccggcatgatgcaatttatttaaaaagtttttaaagatccgtatttttagggtttcgattttgtcggtcgaattttcagggtgttacagttactctatatttatcagaatcacacaagtacaatatttgggattgtctatctagccgtcgtcgatatggtggcacgaacaccaacacgtagtcgacgacggggtagtcttcctccttgaatataaactcgtcacgatgagagattgcactagatccctcttgttggtcttcacaggcaccagattggatctgtctaggctaatctctgatgtcgatatctggctttgtcttggcttgtgttggtctcctcccccttctttagggggtcttgtatttatacccatagatgtcccattgtccaaacataactacaaataccaatatggatacaatttgagtagtccatatagttttcatatagaactctacttgtccttacttatctggaactccttctatatacgagtaataattccatataagactgtatataatgggccccgccgagtttagtcgattactattgggtatgtggtatccataaccatgatatatacactgtttaacaaaatgaatagaccactaaaaaagttatagaagtaatttgcgaggactgtaaataaaataaaaaaatttgctccatgacactttgaggcatttgctctataaaacctactttttacagctttaccctaagatactctggttatacggttatctgtcaaaagacactccgataattaatttatatagagagataaaatcttttaaaaaaggttttacctttggacaacttgcaagctttaaatttcaaaattttggctgactttaaacattttatgcaaattaaaaattttcccaaataccggaaataaaaaacagttatttaaatcca

SEQ ID NO: 44903 - DNA, 1501 bp, Oryza sativa
accctgcttcctcacagaacaaaaaaagaaataaaaataaaaactctaacaaacaacaattttgtcatccattgtacgcctccatgtaaactttagtcgttttgtctaccagaagatcacgtaattgttttcttaattttcagcacacatatgtaggattgaaacacaagaactaagccaaccagagagggataaatggttggtgtacccaaaaaccaaaacttttagtggaaataaaagttactctcaattcgacggatcgcggtctgaccgaagtagccgagccggtctgaccgcctggaagccgtcggtctaaccgcagttgttgctccggtataaccaccgagattagccaatgtcgcctgtagccatcgccggtctgaccgccgttactccaccggtctgactgagcctatgccatcagtctgaccggtggtgtgttgccggttggaccgccgcacccgagaaaacatagattgaagatctgtcaaagtagatgacaactttattacttctctctatgtttacaaagtgcaacaacagcactccttacgaaaatctcgactaaactcgaaaccctaactaaactatcaactcaatgctctcaaaagcgataccgggaagcctcacgctccctctctatttatacatggggtaggcagcctaaagccacgaaccaaactcatactagaagtcctaatccacctaggaaaccttctcgtacaagaaaccaactttacaaactccaatcataccaaatttgaactccttccaaattcgacttcgcatcccatacgcacacaatatctccatcgtatgccatatggaatattcaccaaccacatgcattgcactctagcctaagtatcccgcatgatatctgaccgtcacggacgtcaccttatctccaagtcaactcccgatccatcaccgccaatactctcccgaggcatcaagtcacctacacatgaatcaaacaaagaaaccatattccgagaccaagctatctccaacctgactcattgttagcaaacaacagtattacatacttcactaaaaaaatgctttgtagagacatttttctattactgtagaggcacttttcaaatgcctttacaatactgtagagacattttaaaaaatgtctaataattgtgttatggtgaattgtctctacaaacgaagagacattttgtaaaatgtctataagatggtagaggcattttctagagacattaaattgtaccacagacttatgaaaccagtcaaaaagataataaaatggtcttcttgcatttgtcaagccttgaactcaagatttcttgaacaaataattttatcttcaatgcactaatgtcacgcctagaaattcacgaaccagaatttctaagctgaatatgcattaaacccctgtccaggaccagccagggtacacaaacgacaattgttgacatacagatccacgtcttacaaaaacataaaagattacaaatgcagcgga

SEQ ID NO: 44904 - DNA, 1501 bp, Oryza sativa
tgagctctactatttaaacttgctctaagagcaagtttaatagtatagccaactactagctccaattcatctataggcaatctaatagcttattcatacaatagttacatactacactattaatatctggtcccacctttcatacacaatgcgtcttggagtccgtgctatagttggctacaaatctgtagtccactgctcttctctcacctcatttatctccttaaaatatgtttgccgctggcttataggctgctattttacctgctctaagtgttttttattggattcagtttccagaactagcagttcaaatattttcttagagcaagtttaatagtccagccaactgctggctccaaagcatctatagtcaacttaatagccaattcatataatagttacttataaacatatatactacacaatcaatatttggtcccacctatcatacacacatgtgtcttgaagtctgtgctgtagctggctacaaatctgtagcccactgtttttatttcttttcttttatcttcttaaaatatctttatagctagcttttagtctgctattgtaactgctattacccctcttaattattcaaccctcccagaaatatgactcatgttgttgtgacattcagttagtagttttatctatgaggtcgtataaaatcagatgggtttgtagttagggtacaaatttcgattatttgaacaaccaagcatagtaataaaatctttttattactctggctaatcttatgtggtttactcatctaaatatattttctttgataattaggacatttaaattccacagcaacgcgctggatattatcagttaatactacaacaactgctaattatttactctaaatgtagggattcttgttaccatgaaaaaaattacctgtttcaacattaccacctgcggatcaaattaggagcagagattatgacctaaatacctcttattaaatagaatgtttatgagtggacgtgtagcggagtaagataagaaaataaataagatgtgattaatgagacaaatagatatatatcgtttcgcttattcgtggaataaaccaaacgacatattcgcaaacaaaaagtaatatgtgaataaaacttttatatacatgttcttagtgatttaaaagtaagaatcagctctaaatttaaattgtggctgataaatacgagtataagcatacagatagagctactccgaaaactgataagtatgagtatatgattgaatctgaaattgtcccttattctaggatgcagggatgtactttaactaggagtaaagaaaatccctgtttaattaacgccaaactttccccaaattctaaacttttttaaaattatagaggcctcaccaaagtcgacagatcccgtaaaagaacaaaacttgcgggacgcctccccttacccctaatcccactccacccaacgaggagatagcgcaagagaggagagggtttctgcggcggcga

SEQ ID NO: 44905 - DNA, 1501 bp, Oryza sativa
cagtattatagtttaaaatcgatgtttcatatttgaaccctcggtacataatacaatcagtacatcatgataagtttgattgaacccaaaaccgggattggacatgttgatgttttaattttctgcaacaacatataaatacgcggagggtttcgctcttactaatattcgagaagttagagacttaattttattattacatctccaatacatcttcgcgcataacttggattacatgaaggaggatgaattccatgagaagatgaaacaaatcaaagacgacagcgacgaacgcgcgatgattaattgctgctaaacccaagctcttccaagtgctacggcgtaggtaactgacttgtctgccagaatacgtggttcactctgcccgcggccacctcggggttgcgtccgttcaggaagcaatagttgtgtgaggtgagaacaaaacaatgttaggcttttgatcctgatgacttccattcatatatgacataggaaagaaaaacaaagtgatcgtcagatgtgatgatgattcctgagctcgatcgaggaagctgcaagatacaacatcctctcctcgatcctttaatttccactccacctcaacatgggggtgattggttgtaggctcatgttatttgccataatggaatgcccaagtattttgctcaagaaatcataggccggccaaatcttccggagatgtttacaggggtagagtaatgtgcgtgtgtattcataggggtgaacacgcacgtgttatgagcatatgcgtttgtactgtattttgaaaaatgaagaaaaacaagagggtcatgtatggtgtgacataatgtcatgtgctctttcttacccttttttttttgttagaaacacagtgtacaaatgcagacgcttacaacgtgtgcacactgccacagaaagaataattaaatgcgagcactcatgttaaatctagaatttgaatccaggtgcgttggttccaccacaagaaacctaaccagttaaactacgctcacttcacgcttacataattttttttaatactatttcaccctcattgtatagttcagccattacggttactccacaaaacagatcgcatcttaatttctagatcgatcggcaatctccatacgcaaccatgtttaattacagtaatttgcaccatcctatatatcctcgtgggatgcatgcactactaaaacctcttataaacctcttataaaggacggctcataggtgatggttcattttcctacctttacatgacaaaaaaaaacatatatatatatatatatatatatatatatatatatcgaaccaacaccttaaacactatagatagcgtttacagaggaaaaaccatcagctataataatatatattatatgtgtttaaaaattgacactcctgtcgatgccgcgcatcattattatccatgcgaccacatggccaagcccagccgtccttatcgcctctcgactcccacgccatgcct

SEQ ID NO: 44906 - DNA, 1501 bp, Oryza sativa
cttattaagttcctgtactagattgtatacttactaagtaagttcttgtactaaatttcactcacccattaagttattgtattaaaatgctcatttctcaggttattgcactaaattacacccgtctgctaagttaatataccatgattgtttattaaaagtttagtgagatcatgtcttgatggcgcattcgtatgtgatgcgtatatatgtttcgcatgtagtgaaacatgaaaaatgttaaaccgcatgttgggttaataactaaaaggagatcaacaaggagaatattttggcgtccagatctctaaaaaacgtttcaatcatttaatcatgcgcgtgtacgtgaattacgtccaattttgttatatattgtgaacaattttttaaaaaaatttaacagatgtaattacattgtaacttgcatataactataatataacttttacataattttgaaccgttagatttgtttcaagatttgtgcaatcaatgatgggaaaaaaatcacaacacacacaagtgaaaggatttagtccatgacctccgtttcacgcaaatagcatgccacgaaaagatttttaaatgttacatacaattaagtcacattatagctaatataattacaccacgattacactataattgtatttgtcaaatttttaaaagaaaaagttattgaaaatgtataggtgatcccattacgtcggctggtggaaggcggactcagcacgtactgcagcaggcgctcccgattcttcatgcggttggatacgctggatgccatgtcagatggggagaacagtggattttcttcaacttgaaagattaatcgacgttaaataaacatttaatcttaatgcattgggtgaaagatcttgagctggttgctatatatccaggcgacatgcatgcatcacggtccagtcgctatacctactataccatagactgaaaaataaatatgaacagatacaaagtaacaaacataaagtaagttttcctttctgaatctgttgattctagttttcctttttgggtctgtttattctaccctgttagtttctgacagagaaacgactggttatttcactgagaaacgactggttatttaacttataagaatatggagaagttgaaaaacccagtttactaatttatataagaaaatacaaactagttgtaaatcagtgatgtttggaaaagttacagctttttctacacaaaaacagaatatatatcttgttgctagaagttttccaaataaacatagcccacatgcctttagctgagtcgtgacttataagacaatgaatagttgaatagttcctcaattgataggtcaagtgatcaagcccacttatgaggccatgaatagttgcctcaattgattggtcacaggctcaaccacaagtcaatcgaccagagtttctactagtttctttcttcattattatataacactgttaacttccgtaccattcgttctatctaggggttt

SEQ ID NO: 44907 - DNA, 1157 bp, Oryza sativa
tatgacaaatctaaatagcatttgtaaatattacatgactttaaatgggaaagccataaacagctaacttgtacagctaatcaagatctacaacttttattttggtcacttcttcatctgacaaagtgatagtaccaatgtttacaaaattaacatatctgtgttgatatttgtaaaccagatgagaaaaatgtgatttttatgaataatataactatcactttgtcggatgaagaagtaaccaaaataaaagttgtagatcttgatgagaggatcaactttgttgttgaccatatttccatgtgaaatcatttagtatttacaattgttgattatatttttcatattgtcaaaatcaatttcaagctgttagaaacaaagttatatagataaatgaccaaaataaaagttgtagatcttgatgagaggatcaactttgttgttgaccatatttccatttcaaatcatttagtatttacaaatgttgattatatttgtcatattgtcaaaatcaatttcaagctgttagaaacaaagttatatagataaatgaccaaaataaaagttatagatcttgatgagaggatcaactttgttgttgaccatatttccatttcaaatcatttagtatttacaaatgttgattatatttgtcatattgtcaaaatcaatttcaagctgttggaaacaaagttatatagacaaatgaccaaaataaaagttgtagatcttgataacctctacaattttgttgttgaccatatttcgatttgaaatcatttactatccgaaaatgtgttataactaataaaataaattattatacagcagctatatattttgtactcacaaatataaagacttacctgggaaatggaaaaatagtcatcggtgacgggccttagttcaagcccgatagagattaatctatctctatcgggcattatcttagggcccgttacagatgagtcatccgtgacgggcctgaatgtcatctcaatcgggcattagtatggagcccgtcaccgatgcgtcatctgtgactggccctacggcaaagcccgattgagatgactcatcactctaatataactagggtttctcagagtggatcgaaaatttttctaagtcccgctacagtttcccgcctccttaga

SEQ ID NO: 44908 - DNA, 1501 bp, Oryza sativa
agatccactgttgccgagcctgacgcgggtggatttgccgtcgttgggcctggagcatgcagatttgccacaaggcctcaagaagctctcactcgttgtcgcggagagctctcggccatcctcgttccacggccatcctcgctgaggtggttgactttgtcgcggcgggcctccgcgccctccctcaccaacatcaatgatggtgcgctacttcggtttcttcccttagactggttgaagaagctagagaggataccgacgtagggatgccgatgctgacatcatcggctggctttttttttgtgaatttgacaaatctgtttcgaatttcaaatgttgaaattgcattatgaattttgcgaatcggacgatatttggatgtgcactttgttttcttacgctaaaattcattgtttagtcaagccacttaattatgcgctgatggggctcttagggtagcggcctacgaaactcatcaattttcacagaccttaaatactagcaaagcgtttggccccatgcaaaattatgttttgtcatagtaagtgatacgggagtggagtcgtgggtgcatgactccatccactagagttcaaaatcccaacacccacaagtattacggacgcatagatgtttgttagctaggatgagcattcgtgggtgttacacatgtagtggcgtgtgcgtctacttttgtattatgaaaggaaacatcattttaccaaatatatttatttttgttttacatgttatcttggtgcacaaaaaatacgggcgtaaaggtttgcgagcgtataaaatttccacgatcccaggaaagcccttggggcacagaaaaaatacgggtgtgaaagtttttttttgaacgactcgcacgagacggtgcgaagttctattgatagagcaggaaaaaaatacaatattacaactctggagagtcgtaaccaggaaaaggaaaaaatataccaccacccacacgccgacatcgccaacacacacgcccaggagaaggctagcaccggatcggccgccactaagcgtgaccgaccgccactaggccaacaaaggggcacagacgagattctgcgaaaccacgtctgacgcaccgatgctccaccaccacacaagctttgccgacatgtgggacccctgcaccggcgtcccccgccggccagccttcatgcgtcgaagaccgcgccacacccaccggcagctcctcctcacacctaggtcgcctcctccatcaccggccgcgcctctctgcgccaagccggcctcctccaccggacgcgcctcgcgccaatccggcctccctccaccggccgcgcctctcgcgccaagccggcctccatctccgccgcctgcgcctctcgcgccgagccggcctccgctaccatcggctgcacttctctgcgccaagccggtttccgacccctccactgcacgatgccacgccggccagatgcagccgtctcccacgccctcggctagtcaagcgagg

SEQ ID NO: 44909 - DNA, 1501 bp, Oryza sativa
agtcgtgcccatggcgattaaggaccggttcgcgggatgccctataagaacttatcgtacttaccacaagccagcgtgggcaatggctgggcttgtagtgtagctttcctctagccgacgtacccaggtgagggtgggcgtgatggagttggttcagccggggtgtccagttgatcggcttccggattcaccgcggcacgagaggggggctgcccgttgcctgctggggacgggggtgaaccctgaggtgtggtgcgatcggttagagagggttatgcgaagggtcctgtcacggcctctttccggtatgtcgtggtggcatgtcggcgcacaggaacgtgtcgtgggactgtgtcttgtgggtacagttgtaaacctctgatcagagtaaaactattcgaatagccgtgcccgcggttatgggcggtcaaccagattcaccgtgattagtctcacccctagttagctaatgaactggtgtagttcaggtggtttgttgggcctgttgcaacgtggtgtggcgttggacagtgattggttaatattgattaattactacaactgttttactgctttcaactactgcttttaaatgcccgctttatgcaaaagaacctttagcctcctttggatacatcttgcatcataccttctcttccggtatgacttgctgagtacagtgggtagtactcagtcttgctctcttttcccccacaccagagttgaagttcttctcagttggggatgtctcgaagaagttggtttcgtcgctgccgtcaaggatgcctgaggaatggagtcgcccgctgcagtagtcaagtcttcaggcttagctcgcttttatcttttccgctgcatttgtaatcttttatgtttttgtaagacgtggatctgtatgtcaacaattgtcgtttgtgtaccctggctggtcctggacaggggtttaatgcatattcagcttagaaattctggttcgtgaatttctaggcgtgacattagtgcattgaagataaaattatttgttcaagaaatcttgagttcaaggcttgacaaatgcaagaagaccattttattatctttttgactggtttcataagtctgtggtacaatttaatgtctctagaaaatgcctctaccatcttatagacattttacaaaatgtctcttcgtttgtagagacaattcaccataacacaattattagacattttttaaaatgtctctacagtattgtaaaggcatttgaaaagtgcctctacagtaatagaaaaatgtctctacaaagcatttttttagtgaagtatgtaatactgttgtttgctaacaatgagtcaggttggagatagcttggtctcggaatatggtttctttgtttgattcatgtgtaggtgacttgatgcctcgggagagtattggcggtgatggatcgggagttgacttggagataaggtgacgtccgtgacggtcagatatcatgcgggatacttaggctagagtgcaa

SEQ ID NO: 44910 - DNA, 1501 bp, Oryza sativa; identical to SEQ ID NO: 44234

SEQ ID NO: 44911 - DNA, 1501 bp, Oryza sativa
ggtcggatgcatcagcggcaccgccgagcttgaggggagaggtggtggcatcgttggagttagtcaccgacgccgagatgctcccaaatccccacgtgacgccaacgagaacgaaatggcaagcgaagagggtggggcaccgttgcaagggagtagaaggcctcgccaatggaggaagggtgggaggatagcgcctcgccatcaagttagggagaggatgggggtggagtaaaggcctctgccgtcgagttagttcctccatggcgatctcgtcctcgcgtgccgcacctactccgcctcgtagcggacgccacgcacataaccctatgttggcaatcgtacctcctaccgctactggagctcgaggcggcgatgtcctcccatgcatagatctcgtcggctcgggcggtctcgtcccctgcgtcgtcgggagcactgccatctgggagtaggcccgcgaggagtgcgctctaagaccaaatgttgagctgcacttgtggcgcggcagagtttagggagatcaagggtgcccccgacggcttgctcctggagctactcctctttctctccccacacgctctcccactgggccatgacactcgcacggagatcaccacgccagcctccgcagtggctacagtgggggtagggatgctacaagaggctgcacatggtggtgcccatcctcgccaccgacgttgccctccaagttgccaatgtcctcgtcatcgtgttagtggagttcctctacccctaattgttgtctagccgggctagacattcgagcacgcctgcatcgatgcgtgcgccgtgctcgccttgtctccgccagtcgtcgtcgctaaaggcgccacgctcaccttctccctgccacctagctatcagatgcagggaaggagaagaagcaagaaaagagaaaagagaaataaagaaaataaggtggggacccactacaattttttatttgtaaccagacactcactaacatgtgggtcccatcaatttttttatattataagtgccacatcaacaccagctaaaacaccatccaaaccgtcttaagacattatttgtactggttttgggagttgcgagagacgtgtcaaatctgatattgtgattcaggaacgaaatttagacgcgccgttgagggacctatagtgaacgcattccccactggctatgctactacccgcagcgatttttttacattttttattaaaatatttacaaacataattttttgtttcaaaaatttacaaatctaattgcctctcaccctctaggagggcgatttttaaaaatcgcccttccaaagggcgataagggacctaaatgcaaattttccagcacagcttgtttgctctatgattttataatttaaaattatattatataaagtcagatgaaataaaaatttatatcaaaattgtagagctcaaggagatctacaactttgtagttaacattttttcatttaagatgttttagatatccaaat

SEQ ID NO: 44912 - DNA, 1501 bp, Oryza sativa
gatgaagaccgtacgtgcgcgatccggtgatctctcacctcttcggcggcggcggagcgcactgtattgccgccgccggcgaccactccgtcgtctacgacttcgagctcgtcgtgtaggaggttggcgtcgagctcctcgccaatgcgctcgcagaggttgtgcagcacgcagcagacggccagcatgttggctagctccggcagcttcacctcggcacgccgcaggcactgccaccgcgccctgagccgccggaacgcgcccaccgccgccgcgcgcgcgtcggccacgtgcgcattgagcctgtcctgcgcccacgtctggttgggctgcgtgtacggcaccagcatccagctcgtcagcgggtagctcgcgccgccgacgagccacagcggctgttgccacccgagcttgtcgtggccgagcagaagcccagcctcgcaccgggcgtacagcgccgacttcgcgaggacggcggcgtcggagagcgagccggggtggccgatgcagacgtcggtgaaggcgccctcgtcgtccacgacggcctgcatggcgacggagtaggtggccttgttgttccggtcggtaaggcggtggtcgtagtactcgccggcgtgctccctcggcacgacgatgcggacactggtggagaaaccatctttcgtcggtcggactaattccacaatagtctcggttgcaacaaacaccgggactaaagatccccggttaaaaagggtaacgggcatcaccaaccgggactaaagatctttagtcctggtttaaatgctgtcagggcctgtcaggccctcccgggatatttagtcccggttggtatcgtaacattagtcggactaaagatcccagcgatctttagccccggttcataacaccaaccgggactaaaatcccacccctatatatatatatatgtcttcgtcctcctccagcccgagtaagcttcaaaatttcttcaaaaaagaggggaggtcatgccaaaatttctattgaatttattttggtgattatatataaatcggaggtgcctaaaaggttagcaacttcatcctccaatgttttatttttttcatattacatttggatcatgttttgcacacttttttgtcttcaaaattttattgttagttgatgagagagaaaatttgtgtggagaagaaagaatatatagaaatttagtttatttgttaaagaaggttttataaaatagttgagaaggaaaatatagtgaaagttaatcttgaataatagaaaacaaagtaaaatgaaaaattaaaataagtacaacacattaatattagtttaaaactttataaatagtaaatatataattattcggtgtaatatttcataattttgtatgaataatgatatgtcattattgtgttactgttgaaagagtttgtaattattttataattattgtatgactgtcattattgtacgaataattatgtgtgtacgattttttttcatgtcatgtaga

SEQ ID NO: 44913 - DNA, 984 bp, Oryza sativa
accgtgttagtgtgtccgctcggtagccgcgtggtttccacgtgtgcagtccgtgtggtgtctagtggagtccgttgtcggccactcgcctcggttgacacacgggatccgcttccatcgacccgtggaccgtctctgtgtactcggtctaccgtggtcctttttgttgacatgtggggtccgcatgtcaacggcgcagccttcctgtcttttcccaggctagcgcttacacatgttttataattgcaaagcttaattataataatccgcaaatctccatataacagcattaaacttcggatgatcatatcttggtcatacgaactccgaatcgacccgttcaagtctcttaatgtttgttataacctaaagaacccggtgctttctttttatgtactgttattgcttctttataggcttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattatgttgatttaaattaatgcattaccgctttatttaaattcccgcgttatcactgttttatttagccatgcctatttacctttgttatgaccttattattgctattgttattattattcccttgttcaccctagattaaacaaaacctcaactagtgggtactctattcatggttccactagtatgaatttaggtagatgcttcgctgtttgaattagacaacattaggtggtttcacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 44914 - DNA, 1501 bp, Oryza sativa
aaaaattttctaatgtttagtgattccgataaccatcgcaagtcatcaataatactttatgtgattgatcattgatacaaaacaaatccacccgacatggtgtcagaaatgttgtagccataaaattgcttcctcattttttttgcatatggttcgtatcgccgatcagacagatgacataatagcgttgcttaattatacaaatagcacgaatacactaactaaattatttaccctactatagtttatcaactgcagtcctatagaaactttattcattaaatccaacgacctatatcgtccaacccaacgctccaaatcatctcacgttccccctcccctctctcccactttgcctgcacgggtcgcacgccacccccaccatgcgccgtatctcgcatgcgttgcaccaaatcctagctcaagtatgccgcagcccgcaggcgctgccgcgccatgccccccgaccctcttgccggtctcctcagcgccaccgtcgcgctgaccacatccccttctgtaccgcggcaccaccgaagactgtgtcgtggcaggcgtagtgctgggggacctacacccacacccagccatcgatgagctcctggaggtggagggcatctctcttgccagtggcctgacttctccctcctcggctcctcacctacgccgacctcctttcctccgcagcctacctcggagtcacagattgtcaccaccaacaaggtcagttcctatcacccctgctccacttcttgaagagctgttccatttgatgatttttgtggcagcagagcatatatgtgagcctgacagggaagctcgaggacgtcatgtggcagccatgcaggtggccaactcgacgatggcaggcacatcaggcacaactacaagagattttatgataagtgacgtttcatttacgtcacaaacagtgaaatttacgtcatgttatgtaatctgtgacattcgtcacctatcatgcgtctctaatggcgttctatgacgaaatcttattttttgtcattaatctagtgacgattcttctgtcgtgatagagttatgacatccattttcgtcaccatcaagcctaaaaatcgtaatgagattctatgtggcctattaaggtccatatagtgagcaacttgtttatggggtagacctattgtaagtccaattagattttaataaattcagcccaattatactatatccatccatattaagtgggccatacatattcaaaagggccaataggcccaaccattgcaatgaaattgaatctaggccattgtcacgcccagaaattcccgaatagaattccaagcagaatgtgcattagaatccccgtccaggaccggccgaggtacataaacgacaaagtttacatacagatccacgtcttacaaatattataaaagtcttacataaatgcagcggaaaattaaaaggcaattggagctaagcctcgacttggactgcagcgggaacaccactccacagg

SEQ ID NO: 44915 - DNA, 1501 bp, Oryza sativa
aagaacgacggtttagaactagtgatgcctcgaagggcgacgctacgttcagggtgtaatcgcgatgcacatgagaagaatcgcgtacctggctaacgtaattgccgattacgaacgaattggcccaaatcctcatgccagcgccgccgtcctcctgatgttgacgatgacgaaaccgagtcgatgacgccagcatgcgccgtcgtgcccttgctgccgccagcacgcgtcgccagccacccccttcaccgatggccgcagaatcgtgccatcggctttccgtcgtcggttcgcccttgaaaagccagccgacgggtcttcaatcgaccatccgcactcgccgtcgacgaccgccgcccgcagagacgctgaggagaccgcgcccgcatcccccccgccgacggcacgcacagcacgcctccagcgctaccgcacacgactgggtcgggggccgaagccgccgcggcctcccgccgctgatagccgtccgccttgccggcccacatgccgagccaaattccgccggcgcacagcaaggagctgcgcttgccggacgctggatacggcccgtagccaaccacgccagcgtcagtgctgcttgtagcctcaccgccgctccgcctctgtcatcgaccccgccgcgccgacgagctctgtcgaccccgccatgacgacgagccccgtcaacctcgccgcctcactcgcatgagccgccgggatactcgccgccaccatcgaatcggtggaattgggggctagggtttcaaccctagccacccgattggataaggtgcagcgctcttgttgggccgcttatgggccaaggccattagcaggccgacggtcccgacgggccggttaaaatttgagtagccggtacatagaggtgggccgagtataaattaggcctataaaaggagtcgggctcaaatcgaaatttggcccgaaaatggcaaacttctaaatatgtcctagaattttcaggatacacgcggatttggaattttagcggaatagtccctcgggattatagaaattactgagaatgtcagattatttttgttattccgtattttcaattttctgtatattaactatttattagttaatttttgaatcaaccataaaatcctagagacatggtttttaggcaatgagctctcatcatttgaacctgagcatcgtgtttatggtttatttttcctagctgttttcagaatactatttaatgggttagtaattcagtaattactttggtacctaaataattagtgaaacaattctgaaaattattgggagaattatgggaatatattgacacagtactaaatttagataaccagaatttactatttgcacacttgtcatgctcctacttgcagtacttattgaattttgcatgactaatgtaggaaaatgactgatattgctaagagagattttgctgaactagcagtcagcggcaagaattacctgacatgggcactggatgccaaaatca

SEQ ID NO: 44916 - DNA, 1501 bp, Oryza sativa
attttagtgttgtctgtcttggttgtcaggctacagaataatctgcctgcatatgggttttaatacacggtcacatttggaacacggacatttcatatataattcctacaggaaatgtatatatcaagatttcatatataatgcgatacatttcaagattttatacatttcatatataatgcgatacttccaagctctaaacaaacctcaagatttgcaacgcataacgtaataatcctgaatcgcggagaacgaaatttggttggtggtacatcccgatcggaaaaaactccgcggtttgaacttgcacagggtttggcggcaatgcgcgtccaaagccaaacaaatttctgttgtgccctaacacacggcacgtatgtacgtacaaaacaatcagttctatggttagccgaaagctagaaaagcacacatctgcaaacctttgccatggtattggcatttggtaacaatataccgaatgcatcctgcaatattattacaacaaacacaaattaacaggattataactgaagatggaagatagtaatttcagagtgccccgtaccatggaaacatcttgatacatttgcataatgaggatttaatttctgtcatttctgtttcatcggatgcgcattttaccatggaaacacggtcttatcggaagtgcacagggctcgctaccaccgtttttttgacaaattgacccttttcaaaaacttatttcgaaactaacccctgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctaactcagcgccaaccgcttcggcgcggaggtgcccaacctcagcgccaagtaagttggcgctgaccttggctacttagagcccggccgaggccgccccagccagttcttcctccgttttttccccagccgcccgcctagggttcggtcgccaccgagttctcctcgcccaatctcccccaaaaacctctctaatcgaaggtgatttgtgcggcattgagtttgggatcggaagagaaggtaaacccctctataaaccctaagttacccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtact

SEQ ID NO: 44917 - DNA, 1501 bp, Oryza sativa
gagattgtcccggaaacagagtgaagatcggctgaagtccgaatcggctacgactaagatcggcagagttcgagtcggacggggttagccgattgagccgaatccgacaatatgacacagcatatgttgtcggtttaggttgacgtgcttcatgatgatttccacgcatggatagagtcctgagaagtcaattgtatctattacttaggatattttatgtaatttccttagagatatgtttgggcaaaagtctactgcaaagacttatggtatcttagagtttgttagagataagagtcgtgtccgatatgaacatattttgtaattctcgggtataaatagaccaaagccccatgtaatcaaactaacacacgttcaatacaatctcggcgcatcgccacccttttattttcgttttgtttcgacgagttcttacttttaggttgagctgcatcggtttcgatcttcaacaagaggtaaaacttgttatggtggcttgcgttctcgagattagtgcttccatcttcatgatactctaatcttgtttatgtaattcgacgagttatcatatatcttatataatctccggcaatatcgctatctaacctacaatcggctaacaattgttactagaaggcagccgattaggttaaataccgatgttgacttagattatataggatatctaccactctatgacatatccgacgacttgattgtctagatattgtccttcttttcatacttatagcttcatcagttgagtttgatcttatgagttgtgattagaatcttaatctctagcctgtctttggttgctgattagggtagtattggggtttcagccgatcttatctgatttaactacatttatcctacatgcttctttgacatgttaaatttgccctttatgttaagatctcgttgcatttaagtatattaggctttttgtttgatatattctactcgctttaatatcctaatatagagtagtatcggagtattagccgatacatgctagatctatctgatcggctatgctatgaacacatataatctcattattagtatatatttcgatctaagtgatttatactgtctcggcatgacgaccgatctatcccaatcacttgatttaagtatatatcgatctaaggattatatattgttaatatctgcagccaatcgagtagatttagttctttttatttcttaatgactgccgatcgatgcaaatatgacgtcggctcaaggataaatgatatgtcatcggcacttagccgatcggctatcgtttatggatttaaccgcggttttctttgtcttagtttcctgttgattgcatgatcaaatcaactggcacgctcacacacccaaaggcaagttttggacctgcactggagttaagcagatcacccaggcctcgtgtttttacatcaacacgcttttggcacgcctagtgggaccgattagaagtcagaaccgcaacagcattctctca

SEQ ID NO: 44918 - DNA, 1501 bp, Oryza sativa
gaaaactagcgattatgtttgcaacccggagcaattacgaaagatacaacggtactactccctccgtttcatcatattataagatttttctagcattacgcatattcatataaatgttaacgaatctagatatatacgtatatatatctctaaattcattaacaactatataaatgtcggtaatattaaaaagtcttataatatgaaatggaggaagtatgatttatttgtgtgagcaaagatagggcaggcaacaccatagtgctgcattttctttcaagaactgatccacatccacgagttgtatgtgtgtaaaatgaagttctctttgcgaccatgaaagctgatagtcgatgatgtaacgcacaatcgagtcgagtgtgtccgcaaaacctgcaactgcaaggggcaagtaacatctcttcacgttctgcaaaattgattagttgattattccattgcctaatcaatgaaaacttgcatggattgcttccatcaaatcggcagcgagaagaaataataatagtgattccgaaaagtcaaactacagacatgcttttggtttgtattgtgttgacttgagtccttggcaacccaaaagctgtaaattttggtcatgcctatgtttttttaaactgtattgttgccgaatatacatttgataattcgtcttattttcagcaattatacaaatatgaaaaaaaagtcatgcctaaagtattttttataaaatagatcacaataaaatgaataataattacctaacatttttaataatacaaatggtagaagtacgacaaaaatcaacagtaacctatgttaaaaaccgggagtactattagagggagtactacttgtactatttagattacttgaccctaccaccaccaccagcacagaatactcgcattaacataatcagaatacatatgttgggtagaaacacataatggcatcaattaccataatattaacaaaaatactcagaaaaaataatattggaaaataaacaaaattgattaaacatgttctatttttgtttataaagacaataggtggaatttgatctggaaatgttgaatggccatgaatgcaaatgaggacatcaggtaggtaaatttattacttagtcatgctgcagagtagaagcaatttcattaaaaagaaggaactatatataatatacaagtcaactcaagaggtacaacgtgcaatgcacaattaaatcattttgattccaattttgtagaatgaacgggaagcaactccagatcatctacacaacaactcctctatacatgcatgccataaacactggccccaattacttaacagaaaaaaaaaaaaagagaagagagcagtatctagttctgccttgttcttgctccttatataaacagccattgcttgctggtgacaacatatcgatcgatcaggcgacgacaaccgcagcatcagagagagccgatcgatcgatcgatctaccacaagggaagcatga

SEQ ID NO: 44919 - DNA, 982 bp, Oryza sativa
ggagagctggtgggaatcgaaccgtggtcggcgggttgaagattttctccactgaccaagtaggcaagctgctagttgtggttggtgtctacatgagcggtaaatattgtatatcaaccgaggttttggagtagattagaaaagtccgatccgactattaagcggagtaaaacggattttagcaacgtgggatgacggacgaaaaaaaccaccggaagccttacgtatttttttattaggtatagatcaagtaagggtttaattttttttttcatgttgagttggttgtttcttctcgttagcagattaaaccacatcatcggaataacaagaaccgtcagatgcaattaagaatgaagagttttcaccggaggtcttgccaatatgcagcgtccacgcatcggaagacggaagaagagaatgaaaactaagtgaacgagaaaaaaaaataaaaggaaatcaaaacaaatacatacttccgatatagaacgacattattgcagaaatcaaaacatcttggaacagatatagaacgaccgaaagtataatttttttaggaaaagaaaatcaaatattaagcaaataattgtgctaagtatctttatttctatctctctttactattataaacattgaagatgtttttatcggtattttagtacctcattcgtatttaagtcggtttttaagttcgttcgtttttagaaatacagatccgtgtttgagtcagtttttaagttatttcgcttttagaaataccataaaagtcatataagaaatttcttttaaagaaaaacttatatactaacttaagacgatcggacttttaattgcagctcctgattttgtaaaaaaaaatatctaagagaattcccacagtaaatttcaccttaactaaaccgtataataataataagattaaaataaccttcactcgttgtaacgcacaaatttttttttaagtatatatatatatatatat

SEQ ID NO: 44920 - DNA, 473 bp, Oryza sativa
ggccccgccaccgctcgcccgccgccgccaagccgactgctcgacgttgccgcaccgtgattcctccgacagggcgacgccgacgccggcctccccgcgcctcgccgccaccaccaagccgacgctgacgctagatttgtagagatcgccggcctccccgtcgcctgtcgctagccgagaaaagagatgatgacgtggagggataggaggggaaagaaatgtggggcccatgtgggtcccaagctgactcagccgccacgtaggctaaaatcggggtcaaaaccaccgagggaccttttgtgaccggttttgattagttaagggatgcgagatatctggttttgcggtttgaggatgattttgtatctcgatgacaagttgagggaccttgagtgtactttttccttattagttcacccattacgtcggccgtcgaatgagtgaggctcacagcccaaatcagagcaaagtat

SEQ ID NO: 44921 - DNA, 306 bp, Oryza sativa
ggagagctggtgggaatcgaaccgtggtcggcgggttgaagattttctccactgaccaagtaggcaagctgctagttgtggttggtgtctacatgagcggtaaatattgtatatcaaccgaggttttggagtagattagaaaagtccgatccgactattaagcggagtaaaacggattttagcaacgtgggatgacggacgaaaaaaaccaccggaagccttacgtatttttttattaggtatagatcaagtaagggtttaattttttttttcatgttgagttggttgtttcttctcgttagcaga

SEQ ID NO: 44922 - DNA, 355 bp, Oryza sativa
tatgcgggaaatgctagaatgacttacattgtgaaacggaggaagcacttttttttttgaaactgaactcagtacttgatgctgaaagggttggtctcgttgcaacgtgtgctttaatttgtttgcagtggcattcctggcttggtagttggtagcgaccgtttttttgacaaattgacccttttggaaaacttacttcgaaactaacccctgccaaaaacttcaaccaaaaataggccgtcgcctcagcgccaaacacattggcgctgacgttggtcgtgtcagcgccaacgggactggcgctgacattgtgccaccgtggcggccgggccgatcccctagctgacgtggcagc

SEQ ID NO: 44923 - DNA, 1501 bp, Oryza sativa
cctagtgccacacttgaagcatacctgatcttgctttccatattcaccactagtagagcccttcttagacttactgttctgatttcctttcttcttgaaagacgtcttgttaactttgccaccatttttccagaaattcttccctttgttctggttattctggtttttccccttcttaaaggagctagcatttgcttcaggtgctgctgaacttccagtggggcgagacgtatgattttcaacaagtgtctcatcttctccttgtgcttcgatgagcatggagaccagttcagaatacttctcgtatttagcctggcggtattgcctctgaatattcacatgattggcatggaaggtggacaaagttttgtctatcatgtcagcatcagtgattttctctccacatagcttaagacaagtgacattgcggtgaagaactgagttatattgctccacagatttgtaatcttggaaacgtaagtgaagccactcacgttttgtttttaggagcaaggcctttacttgatggccatagcgatccttcagtgagtcccaaaggaccttcggatcttcctcagtcatatactcattcttgagagtagtattcaaatggtgcctcaggaaatgcagtgcctgatttttctcagctgaagttggtaaattattaactcctccagctgatgttgcaatagttgggtcctgaatgcagttcaggagtttcttagcaccaagcatgattttggcatccagtgcccatgtcaggtaattcttgccgctgactgctagttcagcaaaatctctcttagcaatatcagtcattttcctacattagtcatgcaaaattcaataagtactgcaagtaggagcatgacaagtgtgcaaatagtaaattctggttatctaaatttagtactgtgtcaatatattcccataattctcccaataattttcagaattgtttcactaattatttaggtaccaaagtaattactgaattactaacccattaaatagtattctgaaaacagctaggaaaaataaaccataaacacgatgctcaggttcaaatgatgagagctcattgcctaaaaaccatgtctctaggattttatggttgattcaaaaattaactaataaatagttaatatacagaaaattgaaaatacggaataacaaaaataatctgacattctcagtaatttctataatcccgagggactattccgctaaaattccaaatccgcgtgtatcctgaaaattctaggacatatttagaagtttgccattttcgggccaaatttcgatttgagcccgactccttttataggcctaatttatactcggcccacctctatgtaccggctactcaaattttaaccggcccgtcgggaccgtcggcctgctaatggccttggcccataagcggcccaacaagagcgctgcaccttatccaatcgggtggctagggttgaaaccctagcccccaattccaccgattcga

SEQ ID NO: 44924 - DNA, 1501 bp, Oryza sativa
acccaattggctgttgagctggctgctgaagaatcaaaggtggctgacttgagcttggttgagtggctgatggttgtacttcagtacttggttgctttagcttcaacatctgcatcagctactctagagccaaagtattagatgtctgcacccctgatatcggctgttgccttgtgagtaaaattgtatcaactcctggcgcaattggaaccgatgtaggagtcgtttgatgctgtccacttcccaacttagtccttacagttttgtaagatggaaaaacaagatttggaaaatatattggccccttagttttctcctcatcaatggacccatctaccactgatttgatcatgcccgtcaatgtattgacaagcacactagattggttgatcaatgcatgatgcacggctgagtcaatgtgatcttgcagagttggtttggattcttctctatccccatcttgttcaccatcaggcttcttatcagtcttttcttcaataagctttgggaactcgactttattcttttgaatcagcttcccttgtcgagtcatactgtaacaaccaagacacatatgttgcatctgttgaacaagtttcttcatctctgctttctgttcatcagacaagtgctcaatagtgacgaggacgatgttgtcgtctgtgatttcagtgaaagatggtggaatgatgaatggtgaagtggccccggccactgggcgtgccaaaagcgtgttgacgagaaacacaacagcctaggagatttgcttcactccagtgcaggtccaaggctttccttgagtgacaagaacgtgccagctggtttgatcctgcaaccagcaagaaagacaccaaacgtaattagatgaacgatagccgatcggctaatacagccaacgacgtatcgtcaggacccagccgatacagataaaccaaatcggttgcggctttatgatagataagtaaaacaaaaccctaaatatgtcctatcgattgcaatactatctcttttgtttttatcaatcacttttagacaatattatagaaatagccgataatctaatatttagagcaagaatagataatgtattggctattactccaatacaaacttatataaacaaattaatctagataaatatatcaagtaataatcgatcaccatatatgatggattagtcgagatcaatcaaacttgatatatttacttagagtgatctatctatataagtggcaaatatacacaaaatagattatgagacatgcactatcatgtatattaggtaatatcggctgaaactccaatgctgttactagttatgtataattccaggttagtttttagggttctagacaagactagggttgacgcaactcaaagtatgtagagaaacctaaagtctaaacaatcaagttgtcgacgtttgatgtcacgattccggtatttgcatagtatggggatcgttggtactaggatatatgcgagattgaggcaaaagaga

SEQ ID NO: 44925 - DNA, 1501 bp, Oryza sativa
caagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcaccttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggcggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaa

SEQ ID NO: 44926 - DNA, 1501 bp, Oryza sativa
ctggtgatcaacatatttgtctatcttgtcagttacagggtcaaactgattggcacacccgcatctcatcaatattttggacctgtactggggctaagaagatctcccaggtcgttgtgttcgtcgacttagtgcatgccaacacagtcccggcaccatcggctgagcgcggatttttcgtctagaacgccctgaacccgaaagcgagatttggacctgcactggagctaagctgaactcccaggccgccgtgttttctcatcaacacacttttggcacacccaataggacatcaagccattcatatgattcctgattattacataatagaatttaatcccagttacacccaacaagctgtccgatgagcagagggtagagatggaacaaattattcaacaatttcagaagatgtacttgggatccttcagcatgacttgacaaggaacaattatacaaaagggaaaagtaacaatgtcgaagtcgaagattgaagaaggaaccagtgattatgcagttcatcatgctttgatcaaccaatctggtgttttggtcaatacattatcagatatgatcaatagttgaggagaaagttaaggggcatacatattttctaaataatattttcccaccttacagaaccatcaagactgagttggctggccataggcaactgattgcttctattccctcttctttggctccttccacatttatgtagagttagcaacaaccaatgcagggggcaggcatcttaacagtcaactcaagatcagcttacgcaactattgatccctgaaaagccaaatcagctagttgtgatttgtgaatcgattaagttcaagctatagcacctatttcctgtatctctgaatataatctggcaccgattcattaactttttgctgagttgcagtcaaatccgacaacttcatctcttgaaccccactaaacaaatacttgtcaaactgcttttctagatcggcccaacttctgatagaattgtatgggaaagaagaaaactaagtaaaagtcgacccagataacgacaaggggaaaaacctaactctcaagccctccacagctgatgcttcatcacattgtgctaaaaatcggctaatatgctcataagttgaaacattgtctagccctaagaatttggagcaatcaggaatcttgtatcggtttggcaaaggtactctatcaaagtattctggatagggatgccgatatatgatcccactatccttaggcctaaggccaaaatgttctctcatcacatcagcaatcatatcggccaatggctactgttgcacacctcatttatattaattgctgttcaaactggttatacataggttgaggtgaaaactgaacaaaaggagatccttctggccgatgcttcattggtgaaaaaggttgatagtgattattgaaattgaatcccatatttggctgttgaggtttatatttatagccttgtggatccatgatgtgacca

SEQ ID NO: 44927 - DNA, 1501 bp, Oryza sativa
gcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggcggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcacacctgtaaccggaaattaaatggaatcattagtaattgcaaaaaaattaacaaatgaatacgaagactcgttagtaattccctgacgctgtgtcacctgtgactgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacatgttagtcttgttctatttatctgagctaaattacgatatttgtatgattttcattcgatgaaacagtatgttagtttaaacgatagttactttttacgagcagtgaaataaaaatgaaagagcgaactgagtaatcaagaataatataaaatcataaagattgaaaacaatccttggagcaatgggcagagttggcgatacttttttttatagtttgcaatcaatattatgacaatttcattttgtcctcgacaagcatttgattcagaaattgatcatgtacaaattccctgctaggtacagt

SEQ ID NO: 44928 - DNA, 1501 bp, Oryza sativa
tgcggtcaccggtggcgccggtgaaggcgacggccccgggagttgcaacagagagcggccagagaagaaagggtatacctcaaaccataagttgcatcgcacgcccaaaactcgccctcccatcctcccaatcaaattcccagataccatcctcccaactatatcctcgaggcagctccggcaagcagtcgccgccatgtctggcgtgcactgcgccagcgagtagatcttgggaaaagttgtctcgtcgaacgcctcctcccccgtgccgaaccgcctgacggagtccgttgctgcgtagtcggcggtggtgttgatgagtcggacgacggcggcctcaaaagccggagccactgccgcgctgacattttgggctttccaagcaacgaccatcccttggctattggaggtagggctgatcgggaaggcgtcgttggcgaagcggaggatgcaggtgtcgtcgtagacgattacggtcttgacgagcgggcagagttcctgggcgctctgaatggccgcggcaacgcaggtagcgcaggaggaagagttggtatcgccacgacagagcgcgagggcgtagatggcatcgggaactgtgcccgaggagccggaggcgaagagggagggggaggaggaggcgtacgatggcagggaggtggctaagtactgtatgtttgcgtgatacgtgccgtgctccgtgtagttgccgctgtcaccacacaaaggcaccagcgtctgcgcatcggtgaggggcgcgtggagcagcagcaaggcgaggccggcggctgcggcggcgaggtagtagcaggccatggacatgatggtttgtgactgaggaagagatcagaaggggccggatacgtacggagacgccggctggagtgccgtagagccgtggcccatgtatgcgtggacagtggacttccaggtcttggatgtgagtctctttccatgcatgtgaccaatcaaacgaggcaaattttcctagcctaattgtcatgtgtgccatgtctgagacggcaggacaacttctaaacttgcaagtgtgcgtatatgttgctgggccagggggaagtatccagtgcaatactactattcggtgggagaaattcaatcttcaatgtggaccgtcggatgaaaagtgtactgctcagatcgaagcacttcccacattgttggttgtttatgcaaaaatgtctctatgttatgtgccaaaatgcttccagtccctctattatagcagaagccaaggctgaacatttgactctcctctctctccaaaacatttcagctttccccattgagggctagggtttctagtacactgtggattcagctcgtcgcactgagcggcggcgcagtctcaggttgggcgctagtgcacctcgtcgccgtcgtgtttctggccggtatgcggcggggtgaggggccgctagcttgttggcggcgaggtctgggacagagatagaaggaaaggtaagtggatcgattcggtcttgtg

SEQ ID NO: 44929 - DNA, 1501 bp, Oryza sativa
agagccttaaccttaatacaagtaacagtttgtttgttcccaaaaagtttgggggttcaactgaaccctcatgtcccaagttggatccgcccgtgtcacctatcatgaatttgaagagcacaacacataaaaatatgctgctaggaagcaagatgaacatattgttctaaaaaaagttggtcctaggcaccaggtagctctcccaatttggcattatccattggggctcttgtgctgctatttagtgttatattgtccaatatatgtgtcatatacttgccaattgtttggaattcattagtcatgttggaccaaggcggtggctaagtgcccctaggcggctcttaccctgtcaaccctctagtgcctcttgaaccatggatggacagcaattgtgcttttgcaccaatgtacccaacacatttttttttcaaattaccttgagacttcttagtcctggatgcttttacacaatgctcaatgcgaagttcagtaactatagggtacatgcatagtaatggaatgtcataacaagttcaatagaaacatagaacagccaaaaatgtaacacatagtataattcgtttgctgttttctttagaacactattggtttgtgttattaacaagtttagattcacattcattgttctgaatataattttggaatccaaagcataataatcatagtaccataccatctaattagagcaactgtgacatgttgctgtgatgtgtgcttagtaccaggaaattgggaatcattataggtaggttatgattttgagtgattaaaaggggagtttttgttagtctgagttctagcagcatagtgaacgacctggtatgttagctgcatgttagcattcctcttggtattatcaatcagcataaaatgcaatatgactagcgagcttcactttgaagctttaggcccttctcttttcttgagctccaaacttcaacttcctagttttcgattagcacgctttcaaactattaaatgatgtgttttttgcaaaaacaatttctatatagaagttgtttaaaaaattcaaataaatctatttttcaagtttataattaatacttaattaatcatgtgctgatgagctttctcgttttgcgtgcgctaaagatctcgagaggaatcgaacacagccttaactacatattgttgaaatgtggatgttgcaatgctttcatcaaggcaatagatgtgacatggcagatcgttgtaaatcagttttactatggcagcagtatttccctgtgtcaatttctagttgcactttagtgtattgctacagtgattgctagctcagcaccacctttgtgttgtataaatactttgggtttattatatcttgttttatttccccaaataggactaattttcatgagatttggtgtgctttctaatgcagactgtttttgtgtgcatgtaggaagctgattttatcatctgaatcaagtttatatatctacaatatctgcacaaa

SEQ ID NO: 44930 - DNA, 1501 bp, Oryza sativa
atctgtttcaaccaaatgataagaaggatctgataacatcaactgcatcttggctagcaatgggttggattctcaacggtctgacctttgtgatggggcctcttaaaatgttaaagctcaatggtgttcctcacatggtattaatacattcttttgatacactcttgcttttaggctacaaggaaagtattgactgacatagcataggctacaaggaaagtattgactgacatagcatatggtacagagcaattatgtagtgtgccatatacttgtgggatacaattacattgtttcaaacatggtagattgatttctgtttcaaaaatatatgatgatgttctcaacatactactcagtgttggtactatattgattttttttatatatattaacttctcaataggtaaccatctggtaatgagataatgcttcatatttgatacatgaattgcattattttcatttttttttcattggtaaccatatctgtgtgtgtgttgttgaagtcgacaaatattgctggcacacacacaggtcctcttttgttccgtccttatcattgatgtttaaacgcacatgttcatcatagatatcgagacattgagtagagaatgctaagtttttcggagacaaaggtcttttgcaagatgacagaaaagtaaatgagataacaaattctatcataacccaagctaaatgatttggtcttccaaaaccaaagtgctttcataaaaaaaagggctattcatgacaatttcctctacatgcaaaatgtgattaggctgcttcatcgaaagaaaaaaggcactctcttcatcaaggtggacatatcgaaggccttctcgaaaccctgcaaaatctggggttcggtcaaaaatggggaaactggatctccaaccttctgggaacctcatcttccagagtgttgcttaatggaatcccaggggaacacatcaatcacgcgtgtgggctcaggcaaggtgatcctctatcaccaacgttgtttattctcgtgatggaacctttgcaacagatcataaagaaggaggaagagtcctttgtaatcactaatcttcctcaaagacaggcaagattccgatgctccttatatgcggatgatgttgctctcttcatggcaccatcacaaaatgaccttcaagcactgaagaagatcctttccctctttgctcaaataagtggactgcacacaaatctcaccaaaactgaaatcttcccaatatcatgctctggtattgatgttgaaggccttctcccttctttcacaggaagcctgaaatctttcccctgcaaatacctcagtctccccctgcacttcaagaaaattaggaaattagacttacaaccactaattgataaggtggggggggggtcatattccagggtggaaaggatgtttcttcacagctacaggccgcaaggtcttggtgaaataaactctctcagctatgccaatttaccacatatttgtcattccttc

SEQ ID NO: 44931 - DNA, 1501 bp, Oryza sativa
cacgccgccgcgacgccacgccgtcgccactgtcgccgcgatgccacggcgcggccaccgcgccgccacgccactgctgcgcgcgcccaacagtgccgaacgttaacgaacgtgattgaaacgtgaccgaacgcgaacaaacgtaacgaaacgttaacgaatgcgaatgcaaacgttaacgaacgcgaacgaacgtgaacgaaacgttaacgaacgcgaacgagcgtaacaaaacgcgaacgaacgtaacgaaacgttaatgaacgcgaacgaacgtgcacgaaacgttaacgaacgcgaacgaacgtgaacaaaacgattacggaacgcgaacgaacgtgcacgaaacacttacgaatgtgaatgcacttgtactaaaagtgtgagaacgaacgcgtttatactaatacgatttactggtaatacatatatgattatatatgtaacttggcccgtttagactaatacattttcctggtaatgttgcagagaagacgtcgttatcgtaccttaagccaaagtggtagctagccatcgaaggaattcgcgcaggcaagtgatgtaaagaagtgattgttagatatttaatataagacggttagacttagcatacatgattattacaattttaatataagattgttatcgatttaatataatattgttagacttagcatatatgagtgttagagatttaatataatattgttagacttagcatatatatatatatgactattacaattttaatataagattagtagcgatttaatatgagattagtagagatttaatataagattgttatacttagcatatatatatgattattacaattttaatatgagattagtagccatttaatataagattgttagacttagcatatatatatatatgattattacaattttaatataagattagccgcgatttaatatgagattaatagagatttaatataagattagtagcgatttaatataatattgttatacttagcatatatatatgattattacaattttaatatgagattagtatccatttaatataagattgttagacttagcatatatatatatatatgattattacaattttaatataagattagccgcgatttattatgagattagtagagatttaatataagattagtagcgatttaatataagattgttatacttagcatacatatatgattattacaattttaatatgagattagtagtgatttaatataagattgttagacttagcatacatgattattacaattttaatataagattattagagattaaatataagattgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtttgcacaga

SEQ ID NO: 44932 - DNA, 1501 bp, Oryza sativa
aatttgtcgcatcagaaaacattgaatgtctcctcctcatcttttttctctccctttcactctccgcaccttgagaaatttgtatatctgccatctaaaaaaattagattcgctagaataccatcattaaaatagaatttgatcaaatgccactctcaaacgaagggcattcgttataatgccattgctctgtttcttacatttccaaattatatttcctcgatttttttctcgaatgtgtatgcccctggatgaataggtcgaattagatcacatttcatctccctattctcagttctagaaccaagcaagctcgagaggagagtttgcaattgcaaccgcacaacctcaccggtgtcgcccaccacctgctcgctggtagcctcaccgcctcaacccacacatccatggcacattggtccatcgccaagccattcggcgttaccaccgctgtggctctgcacctctctcctcgttgccgccatctctccactaatgccaccgctaggggagcgttgcggttgccgactctgcgaaaaccgaccaaaccaccaccgccaccgccaccgccaccgcccctacacctgcgtctgagtttccccgtcccaccacctccaacaacaacggccttgtcatttcctctaccgcgcgtggcgaagacgaaagaaggaaactaactactagcacaacggcttcaccgagtaagcgctcggctcctgcccgatgaggactcctatgtctctttcctcaaggattgcaccggcaacttcgccgtctctggcctccctttgcctctcaccaaccggctggtgctcgcctatgcggtgtttggggacacggaggcagcgtgccaggtgttcaacgaaatgtcagacaagagcggaatcacctgggcgatcatggtctcggcctactccgatgggtgcttctatcacgacacgttacattggtctcctctcgcgcttactcggttctagaacacacaatggagggatgaaatgtggtctggttcaacctattcatctaggggcataaatgtccgagagaaaataaatttgaggaaaaataatttggaaatgcaagaaacgatgaaaatgatattttagcgaataccccttgcttgagagtggcatttgatctaatcccattttgacgatgatattataacgaaaccaattcttatggatggtctatatgcaaatttctccatgtaggatgtcatgttgtagttctatatatgcgtggggtaatttaaaagctaatactaaaaataaacatcgaagaaactaattaaagtcaaatttaaaattaagttataaaatttaaatattaatagaggttgattttatataaaacaaatgatgtgcctaaaccactttctccggtcaaacactccgtccccacctatcactcgactagtcgaattcccgaacctcctctacactagccgcctcgtgacaacttaccattaccatcgccagcacaatgcgccgccaccgtc

SEQ ID NO: 44933 - DNA, 1501 bp, Oryza sativa
tctttgtttgaatggaagattatgagaaaagcaaagatcttgactgggggaagaggctcaatattgtaagcggagtcgctcgaggcttgcaatatctccacgaagactctcaactgagggtagttcatcgagacctcaaagcaagcaacgtgctgctggacttcgatcacaacccaaagatttcagactttgggttagcgaaactgtttgagtgggatcagacgcaagacgtcaccagtcacatcgctggaacatagtaagtactaagtggacctgcaattccatcgcacggtagtatgaaagtataattaacgatcatctccttatttttcagtggatacatggcaccggaatacgccatgcgtgggcagtattcagtcaagtcggacgcgttcagttttggtgttctgatcatagagattgtcacgggaaggagaaacagcagcttctccaactcggagcaatccattgacctcttgagtcttgtgagcatcattaatctctgctcctcatcatcatcaccatgacctgatcaatcacgaaaaccatcttcttaatcgagacatcatcctgaagaatttatcctgattacgcatgtaggtatgggagcactggacaacggggacgatcgaggagctgctggatccggcgataggcagccgtgcagtgaacgttctgctgaagctgatcaacatcgggctgctctgcgtccaggacaacccggcggacaggccggcgatgtcggcggtgaacgtgatgctcagcagcgacacggtctccctccaggccccgtcgaggccaacgttctccattcaggagatggacggcgccgccgacacggatctctacgagtcgggagcgtacccccggagcgcgttccagcccaccggcgacggcaacacgagagcagcggcggcggcgtcgccgaatgagttgtcgctctcggagctggaaccaagatgagcgtttcgaatttggagcgatttgtgcggatgaccgcagggtttttcttcaataacgaaagaatcaacacgtgtggcctctgcacttgtttgtcgataataataaataaatgccctcgttgatggttggttggagctctgcatatagttgcaagattgttttttttaggcgggtcacggggggtaaaatgtccttctgaatatattacgtcaaacgattttacacaagacaaagcttcaaactacgcaagcgcagaaaccctggagaataagagaaaaaaacataggaaagacaaggaagagaaacacgacaggaacacaaccacccccgagggcacttgagccaccctaacaggactaagagagagagggggtgcatgatgtttttcactaacaagatcacaaaaccaaactcctaatctgagctaaagccaattcctaacttgacaacatctactctacactgcccgaaaaaaaaatctactctacacgcaaccttcaagcaccaggaattgagaattgccggaaggccattctca

SEQ ID NO: 44934 - DNA, 1501 bp, Oryza sativa
actttgaacccatgcctatgcaccgtacttcgcttgataaatgccatggacagggcggaacaggagtagggcagttagagataaagctttactcctaaccctaaatactcattaaaataacactccaaattttgaaaattaaaagaaaaaataacctatgatgattactttaattaagctttagggttgagaaaattttggcttcgcctctggtcctaggcaatagagaatcggatagtgagcttgggagtttattcaatatgttttcaaatttatgtttcctcgtgtttacatatgtgaacaaggggtgcataactttgactataattttcctatactttattagtgacgttgctgactactagaattggccagccggcatctcagtcacacttgcatccgaggatgatttaaacaagaatgaatatttggtagactcaaatagaccctattgaaatgtaatcgacgaaattaccctccttttaagtctcccttcgcagtaacgtaattgtgtctggtcaacgcacaatttcggtcagtaactccctggcccaccaccactcttctttgggggaaaatacgtggtggaaaccttgtagacagtagaaacttagaaactattgttggatcgaaaaatgggcgtccgatattcgtccacgtcatcccgactaaatattttactcacagatttactaatgagtaaaaattttactgcacataataacgtggatgaatcttaaacgtccatttagtccttcaagtttcaccgaaagctcaatttagtctttcaggttttattttgtccacgtagatcctctaagtacttgttttggcttaaaatcatccttgtacccacttaatataccatatggctatttttagtcgataattcttttagaaaatgtcacttttgcccttaatttgtatacatctatacaccggaaaaaaaaccaaaatgaataaatacgtcccattatttcaacatgtgcatataaaacttgagcttaatagctaccgtatacacttgcaagtacataatttatttttttttacatatattgctatgcattatctataaaaagaatttattgcatgcaatttttctcttatatatgtgaatgaggaggtataagtgtcatttatcatgagagttattggttatgtgggtttaaggataagtttgaattaaaataaaaacttgaaggactaatatggacagattgaaacattaagaactaaactgatcattgtatgaaacttgaaggaccactttagctattcaccattttttaatccactgtatttatcgtttccaccacatattttcctcttcttccgagtatttatggcgtacttgcaaagtggcaatacggtggcgtattttccccctcggccaccgaaacctctctctcctcgagctagaccaccatggcgacgacggtggcgacggccatgcgacgccgacgaaatctcactccctgcgacagccgcctcgccaccg

SEQ ID NO: 44935 - DNA, 1501 bp, Oryza sativa
cattggcattctagcgaagccagtttttatgggtgaaagatatgtaaatttcttcagttccaaggggccatatcttacaacctttttaacttgtggtcaccggatctgacggtcatgaactccggggaggtcgacgaacggcggagaacgaagagaagaagtgcagagcggcatcctctgtctaacgacggagacgagaggccttgaggccgtttccttttttttttcttttcttttctttttctccccattaagcgggtgaagtaaccaagtttctgttttgcttggcgtgtttctactttggtttgataatgtaaaactttctagcattgctccacattcatatagatgatgttaataaatttagacacaaagccttacattatgaaacagagattttttttttctgaaaattaatgcagtcctaatctacagcttaaaaaaaatgtgtccatattaacttggagagttaccttatcgtactgtgttagacttttttacatgatgtttttttcccgatctagctgattgaatttagcaaatcccttaaatttaatattgtgaattttattacaatttatagtattataaactcacacaatatttctatatatgacccttaaaaaactatttttctatgtatgaatagggtaaacttaccctccaaataaaacatcttaggtcctatttaatttggattagattattgttgcggattatctacttaattataagaataaatttaatatattttaaaaatttcgacactagacgatttttcttaaaagctatcatggatatggataccacatagctaatagtagttgactaaactcggtaggtcccatcatataccaagtcttatacggaatcatatctcgtatataaaaggagttccgaataaggaaggacaaaggtaagaaaaaaaaaggaaaaacaagaagaggggcggatggaggaagaagatgaatctgacggatgggccccacgtgtagatggggaggaagatgaaaaatgtgacggtgatggcatgattttaatttcgtaaaatttgaatgacacactcacgaatagacgaattgtaatagcatttttttaatagccatatttgcaatggcatagatcgaattaaccctataaagaaacatgtgttttcaaacgaccacgctcatgcaagagaggatcaatgggaaaagggaacccaattctcatgaattatttttagcatacatggattatgttttagatatttgctagattttagttttattagatttttttttctaaactttcatctaattgaggccctcattggatcaaggactaaattttagttcctgtcacatctgatgtttgacgctaattagaagtattaaacttttactaatgacaaaatccattccataattctagactagtttgcgagacaaatttattaagcataattaatccatgattagcctatgtgatactccctccatctatttttgataggcatatt

SEQ ID NO: 44936 - DNA, 1501 bp, Oryza sativa
atttatgtaaacaaccattataccaattcaataatatgttgttccgtatagaaactatgtttcgtatagaaactaaaatttccatatttaaagccagcggataactaaatatgaagccagcaggtttccaaggttgttgatatttcttaatgatattactaaaaatataatttctagcaatgacacccgaaatattactcggtattctttacggttacagatataatctgcaagcgcgcggatacaccgctgtagcattttacccagaagtattttaaggtatcatatttatttaatcctaggaaaagatatgataatagagtactatgctagaaatttatatcactcgtacagatcaaagtctaatgcaggggttcatcaattcaaggatagatagattaacacacagaaggaactaaccagaatactctcactaaaataataatctaaactaagtggagaaagaataataacataatcatttttgtacttatagtatatagtcattttagtctgcacttgccattatacaattatgtagccaatatccccaaactatgccctcctggtatttcgagaaaccacccctaattgctgagtttcttacgacaatctgttatggccattcaactggtaatagatacggaagagtacccacaccaggaaaatctcttagccctatatacgcacatggaggaatactcgtggcatacatcaccatttaatgttatctaataatctaagcaccacgattacattactaaatattactctacatctttgcagatgacatagagaaatcatataaatgaatatcaaaccaataccattgcatatctccagtaagctagctacataattattacgagacaagtatgaactaaagtaggtactcaaataattatataaatgaagtaaaggaccaaaactatacaaagaagaatatttcattactgaattaaatcttacaagagagagaagagttactagagtcatactcaaaatctccagaagacttgaagaactaataaattattctaattctactccacaagcactagacacaaagtaaataaactagagaactcctgcttgatcctccttggtgtgtattgaaatggagagggagagatccttaaatagcctccatatgacggctgtggtggttggaaatgttctaaacaccccgcaaccgtcattggggagcaatctaggacgtccacatggaaggcaaggatcagaggcgccggtggtggttcggccgaaccctggtgtaggatcgagatgtcgactagaggggggtgaataggcgatttaaaattaaatgacacctaatcaaaactaacctaagttgctaggcttggtaagggataagtctaactaagcaactaagttatgttttgcaatcctagggtgaaagtggctcaaataaaagtaaatcacaattcctaagtctagtttagcaatcctagggtgatatgatctcaagtatgtctctagg

SEQ ID NO: 44937 - DNA, 1501 bp, Oryza sativa
tggcacactacataattgctctgtaccatatgctatgtcagtcaatactttccttgtagcctatgctatgtcagtcaatactttccttgtagcctaaaagcaagagtgtatcaaaagaatgtattaataccatgtgaggaacaccattgagctttaacattttaagaggccccatcacaaaggtcagaccgttgagaatccaacccattgctagccaagatgcagttgatgttatcagatccttcttatcatttggttgaaacagatgactgcttgtgttgaagtgtgagcctgacttccccaaactccttgcaagctgcaggcatgaccccaaacaaggaatttagtgcgacattacaaaataacatttgtttttagtgccaactaggccatgagtgtagcagcaagattgcctacattgttttcctaaatgaatctggttgttgaattgattcatgacgcaaacaattcccagaaaatcttcccaatcaggacctcggctttgagaaaaaaaacagtgagtgaatgaatattgaaaaaaaccattatgggttgctctcattgaattttgcctttgtgaacaaccatggatgtatatatcctatacaccatagaaaacaaatcggatcacttgcaccaccattggttaagaccaatgccatcactgttgcttcctccatcattcaggacaaatggtgttggaattaatgaatgggccttagcccactcgaagattaattctttggaaaatcacaaaagctcacctcatgggatgacatgcatgtggagtttagtaccaccttgcttattctaggagaggggggcctccttaaaagggaggatgccctcctagccacttaaagcatgtgtggtggagagaagaggggggaacacacgcgcgcgctcgctctcctcgcctcgcctggcagttcggttacgcgcagtggagatcgtgcgcgcgccctgatcaagcgacccttctcaatataaaccgacccgtcgtcttcacgcaatatacgcgaaatcaatctagggtttgccttcctactctgtgctgcaccgtcgctcgtagattactccatcccgctcgccggcgtgcaccggcgatcgcgagagcaggtctccggaacctctgcctttgacgtcctgcaccgggagaaggcggcaataaggtttttgggaagtgctttgcgcgactgctccctgttcatccgcgacggctcgtcttcctcttcgctcgcgtgctgcgtgccttcgtagacgcctgcgaaaagtttcgatcaagcagccagtctttccgccacctcggtacgtgttcaatatgttgcgcatatttgatctgttcatgttatactgtgtagtttacaagtgtagatataatgatgcgttcatgctaattttcatctgtaatgtcatgatttatttatggaatagattaaatcattatatgcctataatctcaacaatccaaaaacttattataggcactgtgattttacta

SEQ ID NO: 44938 - DNA, 1501 bp, Oryza sativa
gagattcaaataacatacaagtgcatgaaatatccttggttgatgtgttgtataagacttttctttcccttagtgaactatcacttaccgtagtgattttcacatccccctcgatttcgatgttctcaactatgcatttctccataacagctacaacctctttctgaaaagtgtcaaatatctcatgggtgaacacctcccttccatgcttctcaaacccccattctgtttttagtttttggttagaatgaactgtaacattgtcattttctagctctttgtgacgttgttcttctagagctgtatcaaacctgagccaaaactccaccaaagcaagtttgaagcctataaaatgacagaaaaaggagttggtactctcagatcttgaagtcgttcgaagaatgccccaagagaaatgtccttgaagtaaactggtatccatgattcccggatacgatacctcgttgtcaaccactcatggtcttctagaccatagtcagaaataatggaagtccattgtgcctcaaattcctcatcagtttcagtacaccatacacatttgttaaaccgatcaaggaactctttgtcctctcttaggggatagcctaccttatcctttaatttcctcataatatgccacatgcataacctgtgggtgctcgtagggaaatcaacactaattgctgccttcatactagcacattcgtcagttattattagcctaggttcaacacctcccattgctcgcaagaatgtctgcagcaaccatctatacgactctatcttttcattacttagcagtgcggcaccaaataatacacaagaccgaatcgatccacttacctttccttctatctctgtcccagacctcgccgccaacaagctagcggcccctcaccccgccgcataccggccagaaacacgacggcgacgaggtgcactagcgcccaacctgagactgcgccgccgctcagtgcgacgagctgaatccacagtgtactagaaaccctagccctcaatggggaaagctgaaatgttttggagagagaggagagtcaaatgttcagccttggcttctgctataatagagggactggaagcattttggcacataacatagagacatttttgcataaacaaccaacaatgtgggaagtgcttcgatctgagcagtacacttttcatccgacggtccacattgaagattgaatttctcccaccgaatagtagtattgcactggatacttccccctggcccagcaacatatacgcacacttgcaagtttagaagttgtcctgccgtctcagacatggcacacatgacaattaggctaggaaaatttgcctcgtttgattggtcacatgcatggaaagagactcacatccaagacctggaagtccactgtccacgcatacatgggccacggctctacggcactccagccggcgtctccgtacgtatccggccccttctgatctcttcctcagtcacaaaccatca

SEQ ID NO: 44939 - DNA, 1501 bp, Oryza sativa
gaagttgattttgccgattgggactcgggataacgaattcggcaagtggtcaccaaattgggaaggaccgttccaaatctataaggttgtatctaagggagcttacatgttgcaaggactcgatggagaagtttatggacgagcgctaaatggaaaatagttgaagaaatattacccaagtgtttgggttaatgcatgatcggccggtgttgccgatacatgatagccgatgtatttacatcaccttgaaatggccgatattgttatatcgcccttagttgttttcatattgtaatcggttgtggtctgccgatgtgcaatggccgatattgttatatcgcccttagttcaacttataattttagcaatgccttcatctttgtaaaattaggggggcacatatatgaaaagttgcaaatttttgagcaaaatgtggagttatattgaatcggcataaagattatcaagatgagttagataaagagccagagtttcttagccgattacaaaatttcctaagatctattacacaagatatcacagagacaagtaacactggatagccgatatagctctttgcctaatttgttctacttcttcaatggattgagcatcttgagcatcggttccagagatgacttttagagacttggtcatatctgcgacattcttgatagccgatttcagccttgccttctgttcttcgacaaactatgggagatcggctagcttcttgtgttccagatccagttcggcattgcattcttggagttgtgccaagagctcaatcttccgagcttcaagccgatcaatattagacatgatcgggccttcagatagttgatcaagtttggacttctcttcatgcacgagttgctgattggcctggatggtagtgtcacacctcgaagttctttcccaagcctaaattgaagttataaatggtctcaagaaaatacatgtgtaaagcaagagtaaaccttaataaattaatgcaaataataatcggaattggcatgtggaatttttcttgagttctacatgtcgaaattcgctaacaggatttttagtggaattttcagagccctagaaatagttttaaccaattaaaattgagcataagcaatatttaaatccctgggaaaagtctttttctttttcatttcttttcctttctctttttctttgaatgggcggccggcccattctccttccttcctcccctcctgctgggccggccgaaggccaaggcccagctaggccgcgcgggctggccgcccgcctcctctcacccgggtcgccgacaggtggggcccacctatcggacccgtctcccacctcgcgccgcgccgccgcgcccgcaaccaccgccgaaaccgccgccgcgcccacgtccgcgtctcccgggccacgccgtccacgtcgccctcccgcccgcgcatgcgccgcaccttccgcgcccgcctcccctcttttctcccgcccgcgcccgcgcccgaga

SEQ ID NO: 44940 - DNA, 1501 bp, Oryza sativa
acttccagacaaggaattgaagagctgaaaactgaactacttttggttgctaagctgaaccacaacaatcttgtcaggcttattggcgtttgcttagaagaaaatgagaaaatacttgcatatgaatatatgcccaatagaagcctcgataccattctttttggtactatttctctcatctccctgtttcccaaaaagaaattaaatttcatgatgatagtgcaaatacgcctaactcatacctacatgtcataattggtgttttcttgcttgagtggcagatgcagagagaatcaaagagcttgattggggccagaggttcaagatcataaatggcatagctagaggattgcaatatcttcacgaagattctcaactgaagatagttcatcgtgacctcaaagcaagcaatgttctcttggattctgcttataatcctaagatttctgactttggtctagctaagatattcgaaagggatcaatcacaagttatcactcaccgtatcgctgggacttagtaagtatggccaatcctttaaaataatgaagtcaatagatcatgcagtaaaagttatgttcttgctacagtggatacatgtctccagagtatgcgatgcgcggacaatattcaatgaagttagacgtgtatagtttcggtgtcctggttttagagatcatcacaggaagaagaaactttggctcctacggttctgaccatgtggttgatctcatatatgttgtgagtacatggacccaattattctataccgagctaacttcttctcccaattataacttaaatcgaacactaacccattgatttgatgcagacatgggagcactggactagcgataaagccatcgagttgatcgatccatcattgggaaaccactatccagttgataaggtgctgaagtgcatccacattgggctactctgtgttcaaccgaaacctgctgataggccattgatgtcagctgttaatgccatgcttagtagtactggtacagtccgtctcccatgcttgtccaggccttcattttgggtccaggagattggtgctactgctagctaaggtgcaaattcagagcagaacccacacaactcaagaaaaatgtcgcaaaatgaagcgccgatcacagaacttgagcccagatgagtattgtaggatgagaattgaaagaacctcggcctcctcttccttgcatttaccgggaattgtacaacaaactcttattaagctgcgctagctaggtaccgagtttttggctcaataaaatcaatttgaaattgttagagcttaataatatctcctgttatcagcctgtttaaatcaacggaagtcatgtttgtactgttgcacactgatactgtagcaaataagacacatgcttgatacaatggtttttcttttgaaagaattgacatattgattctttctgttactcttgattcgcacttcaatattcaaatcatatcctaatctgttgcaactcca

SEQ ID NO: 44941 - DNA, 1501 bp, Oryza sativa
ggttcaccaccctcggtaacgagcgatattttgtgattctgcagaagccgttggtaaaccaataaaaaccgacaaaatctaaaaatttcttatcaaacaattaaattttagtttgattttttctcccctataaaaactgagctatttgtattttgacccggtccagaaatccggatttcctagttatcctttgcttttgtaaatcgtgaggacgcctactccctccgtcccataaaaaaccaagctagtattgggtgtgacacattttagtactacgaatctggacatatctatgtcaagattcattgaactagaatatgtcacatccagtcctaattctttttttcgggacgaagggagtaatggcctaggtatgttaaagctcagccgttggtgcgattttgaagaggtttttttttttcatgcgcaacttacgacctagttgacacaccttcaactctagctccgtctcttttggagcatgagtttaaccaaacggtttcaactttcaactctaaaaaaagaagtgaatcaagttgaagtggtctcacaaaatgaataagtagagttaagtttagacagcttcacaactacagtctacacttaaaatctagagttatattagccataccaaacgggccattagtccatcaaatttcatctgagattcaatttaatatccaatgtttcaatatataaatttatccttttcgaatacatctaaattcacttgtgccacctcgcgaatcatggttagttattattgccccttattcgcatcaattatgaaaggagaaatgaagaataatatgtgtgacctgggcaacggggatcaggtttattcagtttttcaaaatattgtttccttttgctacgttaatgaacaagggatacaatacaagagacctatattcattaatggagtgttgactagaattggtcaggtgacatctcagtttcgtcccaggatgatcttaaaccagaattaatactttctcttttaaaaaaagaattaatatttgtgagactcaaaataaacaaatcaaaatgtcgactaaattactctcttaagagagtctcatgaggaactcctaaatttaatagtggtgctcgtatttacggctaatttttatttcagtggtagacgatcgtgataaatcttaagatatattatctcggtcttctgaagatgctcctacaaataagttgtgcgtttgttcatatggacgagtgcacgtgcattgtgggtcactgtgtttgttctgtgttaaaaaaaaatttactactctctcaagagagtctcgctggctgacgggcacgtgtctctctctagtcaacacacaattctagttagtcaactccctagccccaccgctcttctatttcctctgcaactgcgacctttcctcgagcagctagaccaccatggcgacggcggtggcggcgacggccatgcgacgcgggcaacaccttcctctctctctttctctctgctacaacc

SEQ ID NO: 44942 - DNA, 154 bp, Oryza sativa
caacgatgtagtcttccgccagcccgtctgccgtatcatcaaccgagtacgcgggggtaagttctcatcggctagatccttctttttcgcaatagattggttttcctcttccttatcttattttcccctttctctgttcttttggatttgtagc

SEQ ID NO: 44943 - DNA, 1501 bp, Oryza sativa
cagagtttagaatttgagagaagcatcagaatgttaggcatccatgtcttttttcccttcttataaaattttctctcaaattacttatccggtctacaatccgattacaccattgtgttcgttgcaattaaatctttacaacaagatctaacatgattatattatgatgaaaacttacaaattacttttataattgttgatgtaaaaacacgaggcctgggaggatctgcttaactccagtgcaggtccaaaacttgcctttgggtgtgtgagcgtgccagttgatttgatcctacaatcaacaggaaactaagacaaagaaaatcgcggttaaatccataaacgatagccgatcggctaagtgccgatgagatatcatttatccttgagccgacgtcatatttgcatcgatcggcagtcattaagaaataaaaagaactaaatctactcgatcggctgcagatattaacaatatataatccttagatcgatatatacttaaatcaagtgattgggatagatcggtcgtcatgccgagacagtataaatcacttagatcgaaatatatactaataatgagattatatgtgttcatagcatagccgatcagatagatctagcatgtatcggctaatactccgatactactctatattaggatattaaagcgagtagaatatatcaaacaaaaagcctaatatacttaaatgcaacgagatcttaacataaagggcaaatttaacatgtcaaagaagcatgtaggataaatgtagttaaatcagataagatcggctgaaaccccaatactaccctaatcagcaaccaaagacaggctagagattaagattctaatcacgactcataagatcaaactcaactgatgaagctataagtatgaaaagaaggacaatatctagacaatcaagtcgtcggatatgtcatagagtggtagatatcctatataatctaagtcaacatcggtatttaacctaatcggctgccttctagtaacaattgttagccgattgtaggttagatagcgatattgccggagattatataagatatatgataactcgtcgaattacataaacaagattagagtatcatgaagatggaagcactaatctcgagaacgcaagccaccataacaagttttacctcttgttgaagatcgaaaccgatgcagctcaacctaaaagtaagaactcgtcgaaacaaaacgaaaataaaagggtggcgatgcgccgagattgtattgaacgtgtgttagtttgattacatggggctttgatctatttatacccgagaattacaaaatatgttcatatcggacacgactcttatctctaacaaactctaagataccataagtctttgcagtagacttttacctaaacatatctctaaggaaattacataaaatatactaactaatagatacaattgccttctcaggactctatccatgcgtggcaatcgtcatgaagcacgtcaacct

SEQ ID NO: 44944 - DNA, 1501 bp, Oryza sativa
attaaatttttaaaataagatatcacatgattatgttttaatgaaagaaaaatatatgtttcaatctactaacacatgatgtttcatacacgacaacgatatgtttcaacgtgtgttttcaatctgtttcacacactttttaaatgtttcgatgatttattttgtttgttttaccatgtataacttaatgtttcaccggtggttaactgaaacatttgactgtctaattttttgagataagatcgggcgtccgattggaagtttataattagaagaaaaaattgtttgaagaaggaaactatggatcggtcatccgattcctaaaaaaatggggcagtcaaatgttgcagttgaccaacaagtaaaacattaatttatatggtgaaataaaaaaaatcaacaactgaaacatttaaaaattttgtaaaacatggtaaagatacacgttgaatcatatcagtactatgtatgaaacaacaagtgttaacagattgaaacatatatttttctttcgccaaaatatagtcatgcgatttcatgctttaaagatttaattacaacgaatacaatgaatacaatggtatgattggattgtagattgaataaataatttaggagaaataggtatttaaagagagaaaaaggaggaaaaaaaactaacttgtgatatacttgcatgcatgcagaaccggacacgtccgatttttattcatccaatcgggcccctatcctgagcattacgggcagctgactacgtcaaccctgctgaaaatatgaactgaccgacgacctatgggaggagaaaaactggtccatagcgaagaaccaatggttaatattgattgaaattaatccacgcactggatttttagatactcgaaggcaaaagaacacggaaagagatctaaacactcaagctaagctatataggctctggccgtgtttagttcccctcaaaattttttttatgtatatggacgcacatttaaagtattaaacatagaataataacaaaataaattacgtatttcacctgtaaactgcgagatgaatttattaagtctaattaatccatcattagcaaatatttactgtagcaccacattgttaaattggcgtaattaggctcaaaagtttcgtctcgcaatttatatacaaactgtgcatttggtttttttcgttcacatttaatgcttcatatatgtgtctaaatatttgatgtgacagaattttttgaagttcgaaggtaactaaatacggcctctgttcggaagctagatactgcggctcaacagtgtttctattgttgattcagttattacgatgtagtgctgccgaacacagccactccctctgccgtgaatataagggattttcaccattaaatttatcctaaaatataaaggagtttcacgatctaagacagtactatggacctgtttagagaagtttaagattctgagaagcagctggttggtagccaacttctgagaatctgcaa

SEQ ID NO: 44945 - DNA, 1501 bp, Oryza sativa
aatttataattaattatagtatagaaatatgagtttagagtcctaaataatacaattagaaataatgaaaattcaaaattggaaaaaaaggaatatttaaaaaagagcctagagtctatatataaataatttacaaataatggaaattcggaattaaaaataaaaaatattggaagaggagtctagagtacatataggagtataatttagaaataaatgaaattttgaatttaaaaataagaaatataatagaaatttagaattagaaaataaagaatattggaaggtgagtatagagtcaatataggaataccatttagaaataactaatgttcgatattaaaaataattaataactatcacgtatatacaatataatatgaatattacacattagatattttttaaaaagtaaatcatttcaattttttattagttacaaaaatagtaattaaaaagataaattaatcattttccacatagttgaagtatttcctctattttcccacaaagttgagtggcttttgctaaaatgccacatggctcaaaaacgtttagcatagactatcaactttgaggcaaaagagaggaggcactttaactatgtggcagatatgcaattttcccattaaaactaaatatgtgcctgaattctatatcttgatttccacattatatacgaacctttttttttgttgattcaacacaattcaagatttccttgttatattaagtatgagccctaatgttacttttttatgaataaatgaatttgaattcaaaattaatgaatacatagttgtccttgagttggagtcttttttatatattgtttgttgttgacttagatcccattcatttagaagtttcccgaaatcggtaagaggttcttctctccatcggggcaacaggtgttcaatagatcaaaaatcataaatgtgccactaatgattacaatgacctgagcagtaccccaaggtcctaagttcaaatcttcataagagcgaatttcagattgggttgtttgcggagctaagttccctatttcaatggccgtatatattcgattggatgtagaggcaggtaaaaaaaatacccttctctaaaataaataaatgtaccactaataattaacacgttgtgccacatatggattattcttttaatctaaaccaacatgagttgttcccactaattggatggctagatctttttttttcattattgagttgtacgaatttggaaagttcccactaattgtacgaatttaatttttagttgtaccatgtcacgcccagaaattcccgaatagaattccaagcagaatgtgcattaaaatccccgtccaggaccagccggggtacacaaacgacaatgttgacattcagatccacgtcttacaaacatcataaaagtcttacataaatgcagcggaagaaaaaaaaagacaacaagagctaagccttgactaaactgcagcaggaacaccactccacaggca

SEQ ID NO: 44946 - DNA, 1501 bp, Oryza sativa
tagatcatatgttaatttgattgattaccctgaagctagtgattctaataatgagggtgatcatgatatgtatgttgccgagtggtcatgaactaataaaaataagccttttgtttgttctaatttaatgccgactccttgtaaagatcgacaaagtgagattaagtatagctttgatgtggccaaatgtgataagatttttgattatcttttacaagaaaaacaaattgattctcgttctcattctacaatgattgctatgtgtttcgacgataggttcaatcggccatagatgaagaacgattgaaattttccgatggttccaagatgaagcttgatcatgatgcttttccggcgaatacaattaatttcaatgataagaaggtgttgatttggccgaagcaagccgaatctactaaggggaaaggaatggtcagtgaagagcctaggccaaagatgattgtgccaaagaatccagaagttggtgtttggaaggagaataggagtgaggcttcaagttccaaagctcctaagaagactaagatgaccttcattatgcttttgaacaagtatgagaagcaaggtggtgagaaaactcgcaataaaggaaagagaccaagatcatctcctagggagcgatttggtcattcaccaagacgttcggaatcacctacatatcatcgttctcaagacatgtcatgggggccttatccaatgccgccgccgggttatccttttccttactacgtgccatggggggcaataccgccaatgttcaatcatatgcctccaatgtaatacaaccaaggatggggaggaccaaggaggccagctcgtgagcgtttatcttcaccaaataatggttagttttatgctaaaaatcaggtcaatgaaggaaagagggaaggaaagcgcatcaaggtggagacaaggacttcagaagtgattactatcaaagtggggtctcatgatgtgctaataccttctggacatgaggttggagagtcttcaagcaacaaattcgaagccagaaccaactcatcgcagtcagccggtctgaccaacctcttaggccggtctgactgggccttcaggccggtctgaccgcctgtcgcaggccggtctgaccgggccttctggccggtctgaccgggcttcagcgccggtttgatgggagaatttcaaagggtagttcgggggtttcatcgtcttcgagtaaaatcaaaagtgggcattatttaccttctggaacagagccgaaactaaggtggatgcctaaggatttgacagctgctcaaaagaggaggttgcaacgtcttcaggcccaagaattaagagagagagagagaggccgaagagcaaagagatagaaggttcaatgagttgcgaccaccgcctacaaagatgtggaggcgtaagtccatagatattgaagaattggttgttgtgcaaaaggaggaggaagaacaatcggttgatgaatcatatccaaaggaagaca

SEQ ID NO: 44947 - DNA, 386 bp, Oryza sativa
cctattaaggtccatatagtgagcaacttgtttatggggtagacctattgtaagtccaattagattttaataaattcagcccaattatactatatccatccatattaagtgggccatacatattcaaaagggccaataggcccaaccattgcaatgaaattgaatctaggccattgtcacgcccagaaatttccgaatagaattccaagcagaatgtgcattagaatccccatccaggaccggccgaggtacataaacgacaaagtttacatacagatccacgtcttacaaatattataaaagtcttacataaatgcagcggaaaattaaaaggcaattggagctaagcctcgacttggactgcagcgggaacaccactccacagg

SEQ ID NO: 44948 - DNA, 472 bp, Oryza sativa
tgttagtatttagagaagagtgcacagtgactctgttttgatagatttgaccctgcgatgcagtgtaggatttgatttgatttgatgttgtcatatgaataatctaattatttaggtaaacaagcatcggtatggttgacatcgttgaggttgggccattagattgaagatgttccaattttctgaatgtcttagcaataaatgatccatacaaacatttgcattgacacggttatgcatgataaaatgtatattatcattataatttttcacccgttgcaacgcacgggcatttttgctagtaaaataaaatgtacggacatgcctgtgtactaggtaaaaaaaataaaatggacatagaaaaatgcattttgttataattcttaaagaattacaataatacaaaatccttagtgtgcgctccacggcctataggcaaggtggatctgacttgacaattatgtttaccagg

SEQ ID NO: 44949 - DNA, 1501 bp, Oryza sativa
agtcagtcgggatttgatgggaagaatgcattaggtcctaactcaggaatatgggttgctaggtatttatgctcttattgttattattagtaagtatataatttctcattatttgatcgctatgtaagtctgtcttatttattcgctctcatgcaaaatgatctatgcataaaattccgctcttactcgcttattttatttgagtcctttacagctttatttaaattggatttgagcatgcattgatcctacccctttgtcttctctagatggccgaccacccacccaaccaccgcggagaaggcgtggacgactttgtggcagagttggctcacatgaccctagtggtgggctaccccaacacgccagagtactcgactgttccgccgctcagtggcgagtttcctcaccgtgttcgtctggaggttcatggctatgtgggcacctgcctcgctaacatggtggttgaagcatctggaggcaccgcagatcacgcctgtcaagaggcagcatatcggatgatggccagacttcgtgggcgccacaactacatcttctgcaacacggcgtactatttccaccctcgccgagcaagtggtgacgatgtcaacacctttcgcctgacagccggtgagaacgacaccaccttcagtcacatgtgcgccgtgatgaggggaatggacaggatgcactcggatctgcacaagatgtccaaggccttgaatgatgggaagctcgtgaggatcatagctttgaaggatgagatagcacgcctgaagaaggagaacgctcagttgaagggcctcccagcgctaggaggagtccggatccgcaccacgccccgcaagtcgacgactacacccgtgcgcattcagcttgcgcccaggaaccgacctccgcccgcagctcccgcagctcctccagttccgcccacagctcccgcagttccagcagttcccgtagctccagctccagtcccggctcccgtccctgtgtcagctcccgcgtccgctctctccttcgctccagcatcagtcgccaggggtccagccggtggcaatggaggttggttgcctgctactcccagtggcagctgcgaccacagcagcagcagttccagtggcacagagccgggcagcggcgagacatatctgcaagactccaggagccgctcagagggacctggtgacgagcaggaggacgccttcgactccatcgaccgcaggagccgttccgagcattaggctcgctttcccttagtttaccgactgcttagtatttgtctattagtttgagtgtttaggtctgttcgcttgggggtcagtcgacggtcgatatcatgtgcctatgatatggctatcttaataaggatttgcttgctgttttaagtgttttaattcagatcagaacaattgcagtttaaattcctatataataaagcttagttcctgagcatctgtttttcttcttttccaccccctccgtctgctctccctccaga

SEQ ID NO: 44950 - DNA, 1501 bp, Oryza sativa
gtaatttaaatcgcatcaatcatgacaccatgccctcattcaagtaaaacaccatgccaattacactcttagcatgcgcacattatctcctacgacattaattatatttcgatgaaatccatgtctatacggttatatgataatcaatttgataaattttggattttattatatgataatcaatttgcgaagaagggagtactattgcagatacgataactaggtaccggatttttgttacgcaaatacccttgtacctatgtggtactaggccatgccaccaagccgaatagaagatgagcttattgtgctcaatctgaattctgaaattcccaaacagaacaaatatgagcctatatatcatgtgcagtatgtctacattttgtccgttgtaacactttgtcctgtcctcgtctatacctatatcttatcttaattacttaaaagactagtaattttccgttcgtcaccaaaaaatttcgtttgtaatccgttttgtatgcgcatttgtgtcatcaatgtccgattcttccaatcggagactagaaaaaccaagttatagccggtaacccataacaacaaaatcttgacaataatctaatctcatggaagcacttaccaaaatcagactttgatagttcgatacaaccataaggcaaaaacaagaaccagatttcacccaaataaaatcagtaaaggatccaccttaaacttgatctccttcaagcccagcactagaccgatggcagctagccccaattaaagatgaacagtgttggaccacttgatgtcgtggtcacaccattgccgcctgcgccttcctctgccgccacctacaacaagatccacaaaagatgtggtcgtcgccagccttcgcattgcttggtgccctccaccaatccacccatcgccagcctctgtcttgctagctgcgtcctcctccagatccaccgtcgccatggccactctaccagatccactatcaccatggacattgctgccgccttctcgtcctccttgccgtcatcattgcgattcgcctagcgccggcgcggggataaggcgagatgcacagtgggtggctggcgtgatgtggtcgtggcattgagcatgatgcggtgcatgcggccgagcggcgcgtgtgagtcgagcaacggcacaacgagcaggagagagggtgcgctcgaggcggaggatgagatgaggaggaaagaagaaggcgaaggcatggcagaggcagaggtggaggtagcgaaccggaggctgcttgctcgaaggattcgagattggaacgaggagtggtgggttggtggagagtggggacggggagggattaaagattgtgggcgaccttttgattttcttttttcctttttgtttttttgagcttctttcggctagggtcctttttcttgcaaacgattcgtctcttgcgggcgtgcatcactgctgccaccacatcatttataattgtaaattagaaataaatagatatagtatt

SEQ ID NO: 44951 - DNA, 1501 bp, Oryza sativa
ctaataggtgtagcccccgacaatgtggttaattgaacaaaccaagcatatagtcaaggaataaataatccaaccaaccaagtggttttgataatcgtaatcaaccaagtgacttgatatcaatatatagtatatgcggtgtgaatcctccaaataacatgatccgagtgatataccaaaatagctataaaaaagctcgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaatgaccataatatataatcagcctaagccataatattggtcaataaaaatgcacacttacgtggcaaaaagcaatgatattatatccaatcaattgcttgataaacccaaacagcaccttgactatataaaaaagtcagcggggcagctatgtaaagctttactgtttgacaccttttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagatcaagcgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgcttattggcaatagctgacgcagtcggcatggagatgaaatgaccaacatgaagacgaaattgctcatcaaaagtaatggaagatgtcattggtagtaaaaaacagtgacaccaatcaaaggtaatgaagttgcacagccgtggaggcgaagaaaccaatcggcagcagacaagtcagccaacagtgaagatgaaggcatccagcaacatcgacaaaattgagcagccatggtggcgaaataatcagtcggtgacagatgaggcagccgatgaagaagatgaagatgcccattagtggcgacataataagccatccgtgaaggcgaggataccagtcggtggtgacgaaagcaagccgacggtgaagatgtagacacgtatcaaaggcaataacgaaatccaccaatca

SEQ ID NO: 44952 - DNA, 1501 bp, Oryza sativa
tgaatggtggggacgtagcctctcgctgcgcggcgctggttgatagtttcgcgaagatcgatgggacgcctgcgatgcggggagcggggacgttcagctcgacgctccctgcgtcggtcaggaggcgagtggacggatcgctcgttgtggtccctactcctgcgactagatccggcaccgacggcgctgaggctcggttggtgatagtcttaagatcgaagaggggggactcgactgccagtcggtgtgcgaatgcttgcggagttaatcgggaccaaagttgcgatcatggtcttggtctggttcaagatgttgacgacgtgattggcttgattgagtgcgtcttccatgaggagggtgtcgaggagggtgatcgctgcaaccgcgtctgttgaggagtgtgaaaaaccgcagttcccttgacgtcttgctgcccaatgagttctcgtgctcgtcacctggcatccaaggcgcgttgtcgccggtcctcagcctcctttgcagcccgttcgcgctcctattgctcatgctgcagccgttctcgctcttgtgcttggcgctcctcttcgagtcggtgtcgttcggcttccttttgtacgcattgttcttctgcttcccgggctttacgctgttcttccgtctcgttgtcggccatgaaaatgccgaagtagagaggcgtgtaattatcttcaaagtcttcgccaaagtcgtcgaggttgcggtagtcgtagcggtagccgaagtcgtcgtactcaatgatctccgttggccgtgagtcgacgccgggggagctgaggtagccatccagttgttccgtcaaaactgtgccgagaggctagagtatgacgccgacttccttagagctagactggatcggggccgaggccggatcccgcctagacctacgggaagaagacgcccttgtggtgaagacggcagccaaatcatcggggagtttcatcaggattgggggataagctccatcgtcttgatcatgtcgtgttatagtagattggatctcgtccgagtggtttgaggccaactcggctgagatgatcttggggtagatctaagccgagttcggaataccgaacggggcagagacctagcctcttcccgactggttcgaatccgagtcgaagagagaaatcttgccgaagtcgttggtgatgaagtcgaggctgccaaaccagaacgtctgcccgggtgggaagacgaagtcattgatgccggagacgaaacccatcgcactaatcctcgaagaacttgacgcggcccctacctggcgcgccaactgtcgaaacaagatttcggcaatactaaaagggggtggctatcaagctagaaaagtggatgagtttagagacaagaaattttatacaggttcaggccttcttaatcaagaagtaataccctactcctgtccagtgattgatccgccgagtgtattatagatcgtatgatctgggagaaaaatcgtaccccaagaggcacctggacc

SEQ ID NO: 44953 - DNA, 1501 bp, Oryza sativa
gaaacaactcattagcgtataattaattaaatattagctatttatttttaaaaaatggttgaatatattttttaagtaactttcgaataggaattctttagaaaaacataccattaaattgtttgaaaaatgtacacgtaaaaaacgagaaagatagttagaaaaataaggtaaaaaacacaaccttactgctgggtaaagaacataacattttactgctgtgtctaagaccgtacctagaaattgaaggcctatgtgaaagtactccctccgtcccataaaaaatcaacctagtactggatgtgacacattctagtgctatgaatctagacatactctgtcggtatgtctagattaattgtactggaatatatcacattcagttctagattcgttttttttttacgaaaggagtatatattgagcctgaattgaaaagatgtggtgacctacgacagatagccacaaccgtgtactgtacacactgccgtggccggtggtgtatagtcgtggacacacagaagtcaggcagctaggagcttgttcattaattcgtgccgtctgtacgtgcccattaaccatccttaagtagcggtgctgattgttttgaaaaaaagatcgaagtagtgtcctagcggcgacggtgtgggaaaaccgagtcttaaaaaagcgagacgatgcgatgtgtggtgcatgttggatgttagtttgatcaaacgagacaacatgagaacatacattcttttttgcctgttgtttgagctttcaaattaatactaaattgctcaaatagcttgttgggctttccatacgtgtaatacgttttcatttctttgctattatagttagcatggataggataattacgaattagtactagtagttatagatttgggggccttgaacatgtgcacactttacatcggtggatatacggcccctgctgccatcgacagttaccatacaggaagctcacccgtagcagggtctgcttcctgggccgcactaccgatgatctttctcagccgccacgcctagccccatcctgctcacgggcactgccatgttgaacgtgttggaattaatagatgggttaaagcctattcgaagattaattctttggaaaattacaaaagtccacctcatgggatggtatgcatgtggagtttagtaccaccttacttattctagcggatggggacctccttaaaagggaggatgccctcctagccacttgaagcatgtgtggtggagagaagaggcggaacacacgcacgcacgcaagtcaaatggtccgcaaaattggctccttttgtaattttgttttgctgcgggaaattttggaaacattctgaaaaatccagtgcgtgaaaacggcgtggagtccgagtaagttacgcgcggcttatccgattcggttactgtcgaaacatgaattcggcaataataaaacggggtagcgcacgagacctaaaagtggatggatgcagagacaaaggat

SEQ ID NO: 44954 - DNA, 1501 bp, Oryza sativa
gttgatgggtttaaaatgttatgtattgttattcagggggtaacttggatgagcgcaaaaaatcatagggtaattcagtctttttccgataaattcctttactacattgaatcttcacaaaatgtttaccattaaaacactcaaaaatcctaaaaccactaatatttggacttgatgtgcataaatgagatattgatatttattgtgaaaaaaattactactactatgaaaaaaaacaacggtttatccaagtacattagaaatcgaaaacgctcagtgtcaggcgccacgctcgcacacgtcgtgactccaaacaccctgaagccttcgatggcgtggtggccggtgtcaggaagtcctggtgggtaatcaccaaatgttcagtacgagtacatccagttccggggcaagattaaaggcggtgatatgcggtggccttagcgtcgagctcgtgtggctaggcagcgatgacccttctctccttaaactaggggtggaaccacgagtagggcagttaaggctaaagcatatgtaaattatactgtactctcttcatacttataaagtaagtcgttaaggacaatacttaagtcaaaccttataaatataaatcataaataactctcaatctgttgagtttaaaaatgtaaaaaatatatgaatagatttgccttgaaaaataatttcataaagtatatatattatttttaataaatatttttatagaaacaagaagtcaatgttgtgttttgaagatcgtgtcgctgtccaaaacgattttctttacgagtacggagggagaattgattaattgagccatgtgtctggagaaatttttggctctaccactgcctcaaacctttcgtctcgtctcgtgtttgaggaggttggcactgatgtctcaccgttgggaccatgcaggagtggagtacgagaataccaaatgggtgtgtacggtgctttttcgatgtttcaaccgatgtacttgatgtttctttgtgtcgaaatgtttcaatggttgaaattctatatttcgtacgttagaaaaaaaatttcaattcataatttgaatgtgtttcaccgtttttaataatatgaaacatgtttctatatagtggtgaaaattttttcgatgagcagggaaacaatgctcgatttgttggaaaacaaattgggatgtagtagttccgatttcgattagaaattttgtggttgcactacaacttaggtaaaaaaaagaaaaagaaaaagaaagccgtctgtgtcgtggacttgactttttttttaacgtgtgatgactctaaccctttgcttcttgtctcccaagcttacaagactaataattcttactagtactactcagcacgatttagaaagagtctttataattaacatccgaatagacaacgaatccactctcagcgaccacaaacccaatcccaagaacccgttcgatcgatggctgcttccgacgtgcaccacggcggcgccacgccggcgg

SEQ ID NO: 44955 - DNA, 1501 bp, Oryza sativa
tagatgattttatttcactataccagagagtgtaagttggtgagtctgtgaaatgttaatttaccccaaaatgagttgagatgaatttcgtatgcattttataattttgtgtatgctttatgtataatttttcttagataaattttagaggtgaaatttgtactgtgagtgcaagtttttattccttaacattaaagttaatgacttggtgagttcacagaaattcgaatcatctcaaaaagagttatatttgattttatatggattttacaacttttaggtacttttcttatataatctcagattttgtttttagtggtccactatcagtcatacggacaatatgcaaaaaggcctttgagatttctagaaaccaacccgcagtcctaggcccatatgtcagtgtttagtatgttttcatattgaaccttataattgtttaaattctcaaaccaaagtccctgcgacctggacagaacagagcgccatggccgagctcgatctcgagctcgccggcggcaaacgatggctcgtttgggggtgcgaccaaaagacgccggagtaacgtcggcggcgagtccgagcggaggatgttttggcatgggtaggcatgttgtgccataggtgcgaatcgactaagggagtgcatgcatgtgctttctaaggagtccagggtgctgaccgagatgtaaaacaaggctggcgaagctaagttgacgacggcagctcgtgtgacggctcggctgcggcaagaacctccggggtgaacggcgacagctcaatcggctccaagaactatcgtgcatgtcagcatgtgtgtccatgaggttagtgagtccagagaaatggtgtgtgcgcgagtaaacgaacaatggctcaccggaggaggcggaatcgcgccattgcctgggatttttgaggggttttgaggaggacatcaaggagaagacgttggcgcgacggctcggctcggcttggtctacagcggtcggaacgaggacgatatcggctgctatggagattatggataccccatacctacacggtatgtatgtccaactgggtatggggtgccatgtatagatatactatctttaaagggactcgggttaaaatccaaacttgtatgtcaaggaaatacccgggatcttagtcggttacgattgtatcttatctgtaactacctattccgttaaggatatgggctgtactttgtaatacggactcctcccctatataaggaggggtccaggtgcctcttggggtacgatttttctcccagatcatacgatctataatacactcggcggatcaatcactggacaggagtagggtattacttcttgattaagaaggcctgaacctgtataaaatttcttgtctctaaactcatccacttttctagcttgatagccacccccttttagtattgccgaaatcttgtttcgacagttggcgcgccaggtaggggccgcgtcaagttcttcgaggattagtgcga

SEQ ID NO: 44956 - DNA, 1501 bp, Oryza sativa
agcaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacgcttgatctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacgatgcatcttaaaaggtgtcaaacagtaaagctttacatagctgccccgctgacttttttatatagtcaaggtgctgtttgggtttatcaagcaattgattggatataatatcattgctttttgccacgtaagtgtgcatttttattgaccaatattatggcttaggctgattatatattatggtcatttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacgagcttttttatagctattttggtatatcactcggatcatgttatttggaggattcacaccgcatatactatatattgatatcaagtcacttggttgattacgattatcaaaaccacttggttggttggattatttattccttgactatatgcttggtttgttcaattaaccacattgtcgggggctacacctattaggtgcatctattcgatgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagata

SEQ ID NO: 44957 - DNA, 1501 bp, Oryza sativa
ttgtacacctctgatcagagcaaaattattcgaatagtcgtgcccgccgttatgggcggtcaaccggatttaccgtgattagtctcacccctaattagctaatgaactggtgtagttcaggtggttggttgggcctgttgcaatgtggtgtagcgttggacagtggttggttaatattgattaattactacaactgttttactgctttcaactactgcttttaaatgcctgctttattgcaaatgaacctctagcctcctttggttatatcttgcatcataccttctcttccggtatgacttgctgagtacagtgggtagtactcagtcttgctctctctccccccccccccacaccagagttgaaattcttctcagttggagctgtctcgaagaagttggtttcgtcgcttccgataaggatgcctgtggaatggagtcgcccgctacaggagtcaagttttcaggcttaactcgcttttatcttttccgctgcatttgtaatcttttatatttttgtaagacgtggatctgtatgtcaacaattgtcgtttgtgtaccctggctggtcttggacagaggtttaatgcacattcaccttagaaattctggttcgtgaatttctgggtgtgacagaccgccactgcctacccctcattctgcacctccgtggcttgtcccaagcttgatgccacgacggagcatgaggggaggtgaggagttgttggagatcaaaagagatttggtgtattatttacatggtgtcctattgttattctttttctaatgattgtattgaaacatcagataaaaccactttgcaatgctaagggagttactttacactggttttgatagttgagagagtttctattttggctttttggttgagggacgtaaatcggactcaggctatagttgagggatgaaaaaaatggacttcctcctcattttaatgctttaggcccacctgtccagacaacaagatggctgaaatgggccttggaaggtgaaacccacatcaatttcaagctagtactagtcatatgcccgcactgctagtcccaatgggattgttcatagaatgtgtttgcttttgttgttttgtgctttggtgaagttcatcaaggctgtttaaactaatataaaagaagttatttttttaaaaaagagagataatacaaaagaaatagacgtgtggaacttttttattcatgaaaagaatgcggtactttactcttcttttatacttgataaatatcaaatctaccatggggaccatgttagcttcaattgttcattttgggggattagctcaagcagcgatgtaagtttttagttttgctgcatctaactatacttcccgaccatgacatgttgttctcagatagtgtcatctcgaccatgacatgttgtttgtccatgcaactgatctatttgtagtgtttacttctacttgattgtgattgatataatgtattgcattgttgggcaaagctttc

SEQ ID NO: 44958 - DNA, 651 bp, Oryza sativa
aatgacttacattgtgaaacggagggagtattacttatagaaaggacacatgagacattttgttaccatcttttatttatggtggtttaatttcatatggaaaaattgtcaccaaccagtatcatataaagagagaaatatgtcaataaaaacatatttcttccaacaaacaactactgctataacgtgagtccgtgacataactagtttcaaagataaatatttattagtaaaaagttaagaacatatttctacaacaaacatgtgtcatcaatgtttgataacaaaattactacatcaattcagaatgtcagttgaaggaccactggattcccatgctagatgacaacaattacaaagaatttctaggaaagagccaatgcaatttagagacaggttacaagaaatgcatgtaagggaaaagtgcacagtactcattggctaggataccctgatatgtccctaaaacgacgtattcgtctcagatacgtgaggggatacgaatatgtatcgaatacgctccgatacgtatcccgtacgtatccttcgctccatcccgcgagagcagcgatcgatcctagcatgccgcgcgccatcgtagctgagtacagcaaaaaaaaaaaagaaccaccactgccataaagcgagtga

SEQ ID NO: 44959 - DNA, 1501 bp, Oryza sativa
tcgaaacaagatttcggcaatactaaaagggggtggctatcaagctggaaaagtggatgagtttagagacaaggaattttatacaggttcaggccttcttaatcaagaagtaataccctacacctgtccggggattgatccgccgagtgtattatagatcgtatgatcttggagaaaaatcgtaccccaagaggcacccggacccctccttatataggggaggagtccgtattacaaagtacagcccatatccctaacggaataggtagttacagataagatacaatcataaccgactaagatcccgggtatttccttgacaaacaagtttggattttaacccgagtccctttaaagataatctatctatatatggcaccccatacccagtcggatatacatgccgtgtaggtatggggtatccataatctctacagtagcccctgagacctttacagtcgacgaaatagtcttctctcgtaattcaaaacaataatccgagtgctccaacttcttctgccttggtctcccgagtactaaaatcaaagactgtgaagggctaaaatagaaaaaatcaggtgcatcaactagatgcacctaattaggtgtagcccccaactatgtgattagttaaataaaaactaaacacatagttaaagtgcaactaacatccatccgagtggttttacaaccgaatcgtccaaggtatcacatagctaagcatatgcgacgtttgataaaacatccagccgactgctttagctttaatacacaaaaaaggagatataaagagacccgagtgagaaacactctaaaggtctataaatcaacacatatgataagaatccgagtaaaaactctcaaaaagatccatcaaatgtgatataaagcatgacaaacgatgagtctaaatagcctaagttatgactcacgccatgaccaaaataagcatataacgtgccgagaaaatgactactcaaaaccagtcatctcaacaaaacccaaacagcttttgcagcctaaaaagcttgcaaaattagtataacacttttccgttgggcacctttttatttgcatcgtagtaattccaaagaattatttaactgcgtcaaaaaggattttaacagcattaggctatattgttgtgagcaaatattgccgaagcaaaaatgcctaagtccctaaggatcacaacttagccacgccgatagcaaaattgggctgaagtactgtttaggcccatgcccattagtacttccaataccctaatgaaacaacactgaagatcaagcgccgtttcgtcttccccgccgaaaccctcgccactttccccattttctgctacagtacgaacccgcgccggcgaaactagggttcaccgattcgctccactccatcctccaaaacttcacgaaaatctcccacacaaccaccgcatcaatctcccattcattcctagccacaccccgaaccaaatcacctcattcagatcgcatccatg

SEQ ID NO: 44960 - DNA, 789 bp, Oryza sativa
gttgaaagtcaaggtgaggtatggcacttgtgtgctgcacaaaaaatcctgtgatggcgctgactgtgcttctgaatcatctgtgccagagtgttcacttgaaattgtgttggcagtagcagttgttgcgccagttgcaacactagtatgcattgtgtctgcatgatctgacatttcttcaaatagttgcatctcatcattggcttcaaatacttgcatctgatcattggttgcaaatacctgcatctcatcattggcttcaaatacttgcatctgatcattggttgcaaatacttgcatctcatcattggctacattgtgtgctcgtaaacttccagcatcatcagcagtatacatagtttcaaagtcaaaagtgttgtccaaatttatagtaggaatctccatgctagtgtcagttggatttacagggaattatgtttcacttctgtcttcatcatcaattagtaaatgatgtagtggatgttcattttcaccagaaactaattccgggatactgttgaggtcaaaatccatttttgctgcatgtgtttcagactattagtaagtttatacagagcattcattgaggtaattcagtaattggggggagaagtaacttgcacatcacatgaaagtaaagcttttatttttttcagaggagtaattttgtcagacaattacatctgtggtatagaaaattacttgcatgttttagagggagtaacatttatatgttttgaagtaagccagtacagtttggaagtaagttacatgcaacaggatagcaac

SEQ ID NO: 44961 - DNA, 1501 bp, Oryza sativa
ctctaagtttccgactcccacgtaaccttgtttagtttccctctccaaaccaaatctgagatatccagagaaaattccgaaaatcatcagaagagctcgtgtttattttaagttatcccggagtcatcattcaaatattctaaaaatcagtcttaacgatttcctattcaaaaatatcctaccaaatttctatacaaaaatctctccaaaaattcaaatagatcactgtgtttcttctcggaccgagttccttgcaatccagcccatattccggatttccttttccctggtcactctctgtgttgggctgttctaccccatgtcctggcccagcctaggcagcccggctccagccgagcctctgcaggccgacgccatccagggccgctctcgcgctacacgcaagcagcctcgcgaccttcccgtgctcgcacacgcccgcccgtgccgcctcacatcagccacgcgccgatctccattagccgtcgcgcaaatcatagcgagaggctgagctcgcctcgccatcgatctccccggtcggttcctagaccttgcactcttttcctttttctccttcttcttctttccctggaagcgttaaactcgttttcatcccaaaatttcctcagccacagccaaggccagctgtgtagccgattcgtcgtcgtcgtccctctgctgctgcaccacagcaccgcaggaacacctctcatcggtgagaattctcaataacctttgtccccttctttccttgcttctatcgggttcctatcgtgctcctgtccaccaccatggctgccaccgaggtcggcatggccgacgcttcatctctatcaactaaccacaaaaatggaaccttctcatccaggaacacgttttgacgcactcacctgcccgcgttcgccaccggagctgccacttccatgcccggtgtcaccatagctcccgatctggaactcgcgttccggttagctctgttgtcttccagcccagtgtccacgtcctgtgggggtgtcagcctgtggaacacgtcatgctatcgtatccatcgccgttccctcactggagctctagagcttttctctctacctctgttactcacgtgaaaagccacgggaagaacatgaacagttccggcagcgctgtttcctattggttgaacccaaccaatcccatcaaaaccacctaaatagtgcctaaccacaataaaccagtccaaacaattccattaggatgtttttctcatgttcgagctctaaaactccaaatcaatttcagttttcacctctgtcatctatagcattaattccaaattgcaaccactactacacataccatgaatcataaccctagaataaatcttttgtcatccaaatcaagttaactcttgatttatcattttcttttgttctggctccgattcacaatatttattttatcgtttatttgtagtatttttattataggcttatttggtcgtttcttcgtgtgcgtacgttag

SEQ ID NO: 44962 - DNA, 1501 bp, Oryza sativa
gggttctgttccgcttaatgtttcttttagaggagttttagttggtcaaaatctaattagatggcataatttatgtgcttccattgtgcatattaacttaacagacgaggatgaaatttttagatggaattttcattaaaatggccaattttctgttcgatctatgtacttagctttaattaataatggttacatagagaaaaataaaattatttggaaacttaaaatgcctcttaagattaagatttttatgtggtatctccttaaagggattgttttaactaaagataatttgactagaaggaattggaatggtagtttgagatgttgcttttgtatgaaaaatgaatcaattcaccaactattctttgagtgccatttttctaaatttctttggagagctatacaattctcttttggactttatcctccacatagtatatctcatatgtttggaaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaattaaacttgagacggcaattatgcatttatttgccaacttcaggtggaggttctctattagaattcagtagttaggggatctttttcttttgttggtgtctattagtttgcttagctttgtttctgctttcgtgaactttctgtgtgagttctgtaataattggctgtaactctttgagtaaaggccggaatgttacattccattatctaaaaaaaaacgttgataaaaaagtcaatggcgttatacattaaaatatggagggagtagttgcttagcagtaataagcaaccaagtgggataaaactgttgactaactcaaagaaagtagctgcatcgcggggttgacctgctttccctctctttgttactcagtagggcgtagtttctagcccaagctagaggtggggaaaatgaccacaactgaagaaccgagttctcaaaaaagaagaaagttctaaaaaaaataactgaagaaccgaaccaaacaaagaccaagactagattgaacaggactccaaattttggtcacaaaatcagtcataaactcctgctaattgagtttgataaggttattttggtcatatgtcccaattaaccgaaatgacaaaattttaaccgaaccctaatagaagcctaatatcccaagaagtatcaaaacccctaacatctaactaaaccccgtctttcccccacgctccactcaggtgatgacatgttatcattcaccctagctcccagctaccacctcccttgcctctcccctccatcctcctctttctaccgtccgcttgcattcttcctatcgtgccgtccaccatc

SEQ ID NO: 44963 - DNA, 1501 bp, Oryza sativa
ccatttttctaaatttctttggagagctatacaattctcttttggactttatcctccacatagtatatctcatatgtttggaaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaattaaacttgagacggcaattatgcatttatttgccaacttcaggtggaggttctctattagaattcagtagttaggggatctttttcttttgttggtgtctattagtttgcttagctttgtttctgctttcgtgaactttctgtgtgagttctgtaataattggctgtaactctttgagtaaaggccggaatgttacattccattatctaaaaaaaaacgttgataaaaaagtcaatggcgttatacattaaaatatggagggagtagttgcttagcagtaataagcaaccaagtgggataaaactgttgactaactcaaagaaagtagctgcatcgcggggttgacctgctttccctctctttgttactcagtagggcgtagtttctagcccaagctagaggtggggaaaatgaccacaactgaagaaccgagttctcaaaaaagaagaaagttctaaaaaaaataactgaagaaccgaaccaaacaaagaccaagactagattgaacaggactccaaattttggtcacaaaatcagtcataaactcctgctaattgagtttgataaggttattttggtcatatgtcccaattaaccgaaatgacaaaattttaaccgaaccctaatagaagcctaatatcccaagaagtatcaaaacccctaacatctaactaaaccccgtctttcccccacgctccactcaggtgatgacatgttatcattcaccctagctcccagctaccacctcccttgcctctcccctccatcctcctctttctaccgtccgcttgcattcttcctatcgtgccgtccaccatcagtgtcgtacaactgctaacactttacccctgctgaggacgtcctttgcctccagcctccttcttcggcatcaacgtcacccaccttctccggtgccgctcaccccatcacctactgtccaagcgtcgctgctccccaaccttatttgccttcctctttctctcattccaaggtcacttaaattcctaggtattgtagctcacaatttagaggtaaagatgggagcttgattttctttaggttggcggttggggatcgatatatctccacgtcatccatcacagatccatatttcagctatgtccataacttgaaccgacaaaaaccatatagctcgatcttcaccattttgcaatgcaattcgttctctatact

SEQ ID NO: 44964 - DNA, 1501 bp, Oryza sativa
aacaatccgcttccactcgggaagcctagtctatgatgcccgcagacatcccgaatcacacagattcgtttctgaccactcaggtcatccatctgccacttaggctgattctggttacgattcccaatccacaacaacttttcacaaagcacaggcaaacaaatctacgcaacgggaaccacctcacatccgcccatgaccgtgggcacggctgttcgaacagttggttaacctctgcagaggggtacactttacccacacaacacgaacttgctcccatcacctaacccgtgttcatgacacacggctggaaaagggagattcgcgacaaggcatttccaaagctaactctgggttacctcatgccacatagagggtctccctgaccaacatcgggccaactccggctttccttttaggactcccgggtgccttcctctgtttcggactcccaggatgcctctacccccacatcccggctttccgcctctattggtatacaagatttcccaaaagcagctaattacttagccagggtgtcccataccaccatgtggttgcacttgttatgcttgatgaatttcccaaaggaatcggtccttatatgcgaatacgggacagtgccacccaggcacagcatccgcatcgcgagttttcacaattcattttattttcaaacacgccgacaccacatgtcgggttttaaaggcttctcaaacccatttctcagattatcgacaaacaacggtgtatgtggaatagttggtatacgcgctcagagagcacggataccgaagtaccacaaaggtggagcgacaaggattcagggtagtacagcctacaggaattagtgcgactactaggtaggtccgtcggtttggcacgcaaaccgaggccaagcatgctataaatgtgtgttgctaataatgcaagttgcaaacaaattaataatgattttccaattataggagcaattggtcaaagggtgatttgccttgctcgaggtcttcacgaagcttcacgaatcttcgagaaaacccgcgatcgacgaaaatccggtaaccgcaactatacgcaaacaattaaaaatctacacaagacccaaaataaagatcctatttagactagataatagtaccattagatagatctcaatttttacggaattattggaagtttaacggagtcaatcggatgagcggttgagaagatatggattttctaaggattaaggaatttctgtctaaaggaaaaaggatttaataatttattaaaccctttttggaaagaaattgaaggagggatatgatttagacttcctcgggcggcttgggtgcggcccaagaggagaggcacggctcggccgaactaatgggccggccggcccggagaggcggcccaagggggcgcggggtaagtgagggagagaaagggccggtgggccgagtccaccttgtggggtcccgagtggggcccgcttgtcggtggcgcggctcaccgt

SEQ ID NO: 44965 - DNA, 1501 bp, Oryza sativa
ttgactaaatctcggcaggacccaccacataccatgtcttatacgaaaactgacttcggatatggagggagttccggagaagggaagacaaccagagttctacatggaaacgacaaggactactcttggacaaggggacacttatgggtataaaatacaaggccccctaggaggagaggggacacagaacaatagatcaagacacaagatcaacatacaagccaatatacgccaagacacaccgccggatatcgacatcagagaaatgcctggactgaccctatccggtacctacagaggccgggtatagggatctagcgctgtctctgatctcgccgggcacgaactcgaggaggaagactaccctgttgtcgacaacagttagataggctactccaaatattatactggtgtgattatggtgaataagagcaacgatcggcttcggccaacaggatgtagggctattacctgacaattcaggggcccgaacctatataaaaatcctcatctccgtctcttttaccttaatctcgcatatatcctggtaccaaacgatccccatactgtgcaaataccggaatcgcgacatcaaacgtcgacaagtccttactttttaatatgattaacctaaaactattgtttattataaaaaaatattataaaaaataaatattactccctccgtttcacaatgtaagtcattctagcatttcccacattcatattgatgctaatgaatctagacatatatacctatctagattcattagtatcaatatgaatgtggaaaatgctagaatgacttatattgtgaaacggaggaagtattgtatactcgaactgaacttgagcgagcctacttaaaagctcaaggtggtatagatttggctcgagcttttctcaagctcgagcctatgtagcctggctcggtcgagctgatcagctcgttgacattcctaattgttttgattgtcatccactaccaacaatcgatatactcgattatatcgtatactgattgatctcctaatataatcactgcttggcgcatgatctacttgctcactacatgatctcatctaaaaggacaaaaaaaaaattctaaaacttttgatgttgtttggattttaaatttcgtaaaaaaaataatcacctcatgaataatattattaagaaatcttgaactaagccacatttgtcacttgtcagcagagagccagagatgaggtttggcttgcctgaggggttagaatgtaacaaatccgaagcaagaagggtataattacaatattacatgttgtttaacgaagatgagaaggccaaaaaaatctgagcccctaaacccctcaagatcaaccacccaggtgccacgagggtttaagcgaaagcccccgcatcgaaccaaacaccggctcccccaaccgcacccccctccttccgttggcggcggcggcggcggcgcggcgccattccccttcctccgccaccctcctgttga

SEQ ID NO: 44966 - DNA, 1501 bp, Oryza sativa
tcactgatgaatcggagccagcgtactcgaaattgttcatatgcttgagaagagagttagggtagtccaaaatgcaacaaaggtaagattatctgatccaaagtgaatgcgttaattaaggggtggtcgaaagcaaaacacgggtaataaaaagtggtccaaaatgaaatttactctattatttatttttaatccaaatttaaattatatatcatgacaaatatacaattaaattttttgttgactccatttagatataaataatttaacatgaagaaagaaaaactaaacataggaaaatattaagtttgttaatggagaaatagtttaaatcaactcagaatagataaaactcaattaggcccataaggatgggccgaatgtcttccacaacttggcctgttaagtgcacatggcccatgtggcccaagtctgcttagatgcattaagagccgtcggattcaatcgaacggttaggatcactcgagatatatataaaacattccatgttgaaaccctaaccctaaactcattctcctccctctcccaccgcgagtggcagtggcggcggcgaccggcgatctggggtccgaggtgaggcggtggctacctgtcctaccgtgagcagcgacagcgacagcggtggctacctctctaccgcgagcagcggcggcgacagcggtgccctcccccatcatgagcggccggggcgatgccctcctctaccgctagcagcggcggcggcgattggcgatctcgcggcagaagcggggcggcggctacttgccctaccgcgagcagcggcggcgacggcgacagctaccgccctaccgcgatccccatcatcctcagcggcggccggtgatctcgcgaccgacgcggggtggcggctacctcccccatcacgagcagtggcggcgacggcgacgtcctcccccatcgtgagcggccacagcggtgccctctcccacagctagcggcagcaacggcggccttctccaccgcgagtggccgcggtggcgccctccgatgggtagatccggtggcagcggccctctccccaccgcgatgccctcccccaccctcactgtctccacttctccccctctctctctctgtgcggcagcggaggaagggccggcaacgccttcccctccgcgagatcggggggaggggaggtgccgcggtggtggtgacggacgacatagaggcggtgggtcggacagtgtgtaggtggccggccggacctcacctccgccagatccggcggcatggaggcggctgcggctcggcgaggcgggaggggcggcggcctggacggagtggaggcgggcggtggtggcatcggcggccgccatttttttttttgcaatttttttccatcgctattgctaacttaatcggattgcgtatggacaaaactcggacgaaattagatgtgacaaaaggaaaaatatgaatatttatattagttatagatatatgaaaatgattctgtata

SEQ ID NO: 44967 - DNA, 1501 bp, Oryza sativa
gatggagagatatgaatagggttcagtgaaaggtgggtcctataaactgactcatcaccatgaacaagtcaaagtgccatgtcggatgaaatcattatgcaaactatctactatgcattggttttaatagttgaggtagtctcttggttttatagttaagggatgtaaagcgaactcaggctacagttgaggttgagggaggcaagatggatttttttccttataatgatgtcaagttgattccgggaggatccacgatctccacaacttcatctttctcaccgtagcgttgtcgtcgaacttaggtcacacagttcataattactccttccgttttcaagactagaatatggccatgtccctaattgcttagttttaatttcaacatttagtgttagtgttagagacagatctagcctcatcaatcgtgtattacttacttattaattcctcgaatgacatgaactgtataaattgtgtaaggtaattagttttgacttattttttttaacctttctatgtttaattaagagataatctattctatcacattaagtttgctctagttcaataatttaccatcaggatatttctatactttttacaatatgccatttggccgaatactttttcaaaaatactgaaaatgccattgtggactcaaagagttataatgattggccatactagaagttttatatagttatttttttctctatcctggaataacataaaagttagtctatacatttcaatatttttggccttttgcatgtatttttttctgaaatacttatctattcatgtgataaacaactatatggataccacatacctaatagtagttgactaaatctcggcaggacccaccacataccatgtcttatacgaaaactgacttcggatatggagggagttccggagaagggaagacaaccagagttctacatggaaacgacaaggactactcttggacaaggggacacttatgggtataaaatacaaggccccctaggaggagaggggacacagaacaatagatcaagacacaagatcaacatacaagccaatatacgccaagacacaccgccggatatcgacatcagagaaatgcctggactgaccctatccggtacctacagaggccgggtatagggatctagcgctgtctctgatctcgccgggcacgaactcgaggaggaagactaccctgttgtcgacaacagttagataggctactccaaatattatactggtgtgattatggtgaataagagcaacgatcggcttcggccaacaggatgtagggctattacctgacaattcaggggcccgaacctatataaaaatcctcatctccgtctcttttaccttaatctcgcatatatcctggtaccaaacgatccccatactgtgcaaataccggaatcgcgacatcaaacgtcgacaagtccttactttttaatatgattaacctaaaactattgtttattataaaaaa

SEQ ID NO: 44968 - DNA, 1501 bp, Oryza sativa
tggatgtgacacattctaatacaatgaatctggacagaagcatgtccagattcattatactaggatatgtcacatcccacaaaaaaatccttaaagtctttaaggatgagagtactagtgtgtgatgatataacatattagtatattgacctttataagttggacctttataagttggtggacgtcgactttatagtaagataggatttgactgttgcacttgcatggcataacgtgctaattaggagtagccaaaataaaaaaatttaaatagagtgattttagatattctttcatcgtgaagtgagcatagctcaactggttaggttccttgtggtggaaccagcccacccgggttcaaatcctagatttgacacgggtgctcacatttacggctaattattctttcagtggtaggcgacgtacccgtcgacagcgaggtgcctgtggtgacttcgtcaatctcaagatatgtcggcccagtcttccggaggtgctcatagggggtccagtcttccggaggtgctcataggggtagggtgtgcgtgtgtgcgttcatagggtgagtgtgcgcacgttgtgagcacctgcgtttgtactttgtttctaaaaaaaaagatattatttcatcgtagtttatttatgagaattttcctgtgtagcttggttgttgtttaacatatactcacgttctgccatgggattagtagttattagtagttccatcccattgcttagttggcctatataatttatgagttgaggccctaactttcatggatgggcccaatgcagccgcccatctcacccatgcccagccaaatttaatccagccctctacaatctccatgcttcaacaaacagacaacagcactacagcaggccagcagggtggttcaaaaaaaaaagaagaagaagaagaagcagataacagctaattggctaagctgcgacaccttgtagattatggacctaacgctgaacgcaatgtgtttgcataggttatgcaagatagactatggacagatcgatcggctgaaattacatccccgactgagtgtttcagtttttccttaccaaggaaagaaaaattgtcaatatcaaccccttctccaaataagttgcattatattattactttcgtttggcagttggaaattaaaggagcaaaggtgaacaaaaaaaaatcaagattcaatgatgcactttcttcgatgaaatttggattggagcaacagctgctttcccctgcatattcgcagcctgtctactccctccgtcccataatataagggattttgagtttttactcgtagtgtttgatcactcgtcttattcaaaaaatttatgcaaatataaaaaacgaaaagttatgcttaaagtactttagataataaagtaagtcaaaaaaaataaataataattctaaatttttttaattaagacgagtggtcaaacagtgcaagtaaaaactcaaaatcccttatattatgggacggaa

SEQ ID NO: 44969 - DNA, 243 bp, Oryza sativa
ccccccccccgcccgtgctgcgcacgtgctcgcgctgacgacgcgcgcccgaccgcgtggggcccacgcgtcaggccgccgtcgccttcttcctccagccgccgcccggcttccctctctcccgtgaaccctactccttccctccctcaaatccgtgtgattcgctcatgggattccaaaattaaataggggaaattaatccccattgaatcctcttcaatcccccccaatttcccccttgaa

SEQ ID NO: 44970 - DNA, 1501 bp, Oryza sativa
aatcaggagttcggaagtcttcggaagagttcgggtatggctctagtagctttcctttcctcttttgtaagctttgtacttttcttagaatacccttctatatacatttatggtattgaaatactttccgagaatatgaatgccatctttacattatgttcatgttatactgaatatacggctagcttatctgggagatgctttggtgcgggtataatgtttgcttatgcaattactgtatgtcatgacgatgatattagagtagtatctggtagtttagacgtggtgtctagattacgggatatcattatttggggttatatgctgcggataagaggtgggccgctgatggtgacagctcagtacgggtattccttcgcgcctgtatataatcctaagttaattccctggggagggtattcctccgtatttagccccggttgtatggtcatgacgggatgtcgtaaggaactcggcagtcaggggtggcttctcgaagtaccaggagggcattggagagagggtattagctagtatatcagttaactagaatatatgtatattatgtgtattagaagtagaatagattttctttctcttttctttccacttagcttagataatatatattgagaatgagaagctaatgcttgtgtgtcactctacccttggattatcttaacccctgtttagaatatgattattacaagtaatatataaattattagtcaagttctctctacatgatcttcccacgggataaaataaatacgatacccttggaatactctcgggtgaaatgctacaatggtatattcgtgcacttgcagatgaactctataaccataatataccagaagtatttttgcgccattgctgggaattatatttctagtaatgttgttaagaaataccaacacccgattgagatgagggtcatctgtgatgggctatagtgaatgcccaattgagatgagtagtcatctgtgacgggcgctagttgtggctcgattgagataggtcatccgtgacgggctatagtttgactattcgtctgggtcaaagctatcgatgacagccgtttgcccgattgagataatttttcacatctgtgacttataggctgtgacggacaccgtgcccgattgagatgggggttgccaccctgtcggagatatgggcctgggggtatacaaaataaggggaatctaccttcccatcctgccacgtgtccttacagcctggtcctgcccccgcattccgcgaaccgcaggagcggccgggggggtcggggcctcagggtgccacgtcatgcccctcgggcccttgcaccgccttgccccgaggccctcgcccagccgccatttggcggttggagcgagcgaggagggagcccacgctgaacctcctttaatgcacgcagcaccccaactaccccctgtcgcatttaatgcagtggaacagacgtgcggcgtgctaaagtgacgcgcgatggtcaaga

SEQ ID NO: 44971 - DNA, 1501 bp, Oryza sativa
cgttctcgtcgtcgacgtcccatcggtcgcccggctcgtcgtctcgcggcgccgcctccgtcgtcggcaccgcagcggcgtggtcctcgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgccgcagccccatcatcgtcttcgtcctcggctccgcgtcgtcaagtctcgtgccggccgtgtctcgccttcgttcaaggatcgccgccgaagtcgttccctcgccgtccgtctccgccgcgccgttcgtcgttgtcgttcccacgcctcgtcgcgtggtggtaaggttctctctccctcgctgccccgtccctgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtcctcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggtttgcggtcgtcgccgaaggttcggaaggccgttctctctgagcaaggcaagtcccatcatccttgaacatattgaatcccagtttataaaattatgttgctttaaattattgcattatcgctttatttaaattcccgcgtgatcactgttttatttagccatgcctatttacctttgttatgaccttaatattattgttattgatattattaccttgttcaccctaggaaaataaaaccccaactagtgggtactctatttatggttccactagtatgaatttaggtagatgcttcgctgattaattaggtaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccgg

SEQ ID NO: 44972 - DNA, 1501 bp, Oryza sativa
gccacgtagggaggttgtacatggttaggagtactagccacatgctgtgtgagctgctcaagtcactgaatggattcattccatcggtgctcaatgcaaaccttacatttcttgggtcctctgcaaacttatggtactttgtgtcaaattccttccactatcgagcatctgcaggatgtcgaatcatcccatcctttttccgcttttcataatgccagtgcatcagttcggcatccctcgggttcgagaacaaacgcttcaatcgatctttcaccgaaaggtaccacatgaccagctgcggaatcttctttttttttgttgtctttgcatggagtggactcttctacatcgttaagggcaacattcggacactcagacgggctatggcttgttttgtatcgactactcttgcatgttgggcatctgtccaaatcctcgtactctctacggaacatgatacagtggttaacacacgcgtgtatctttcacacacccagtgacaacgagcaaataagcttcttcgcttcataggtgctggttggcaaggagttgggttgcggaaaaagtttcttcaacagaaccaacaaatcgttgaaactaatatcggaccaactgtttctggtcttcaatctcataagctcaagcaccatccgcaacaatgtgaaatccttctcgcaaccctttgcctcatcgtacaaaagatccttcgctgcctttttcaatgcatcgaagttatacaacccacgagcggacccagctacaacctcacattcagcatgacgcaacatctcttccaaatctgcaaaattaccatcatctacgctcacattaccatcaccggcatcatcaactgtattgtgctgactattgtcgccaacaatatcatcatcatcaacgggttctactgcatgcacttcttcttcttcagctactaccatgaaatccttgtcccagctgaacactacatcacgtagtgtcgcctagttgggaacttgtttgcttggggtctccatgatgtgaccaatttgtgtagcattcaacaaatccatgcgtcaccaagtgctgctcgattacagatggatcgatccaaattttctaatttttgcagtgcgcgcatggacatataatttcttttgttttcttagatgcagcactcttcttagctgctttcatgaatatgtcgactccttcgatgtatgacgcacgatctctctttatacatctatgctgtgtccgctatctatgcattaattaattaattgcggaaaaaataatacaacttagttagtttaaatattttgaacaatatgtcaatttaaaatcctactaattaatgtatataaccagtataatctagacaacataattaaagctagccaaatatctacatatataataagatggaaactagctacatacaactagaaaatttaccaaactacccctctttctcttcttcatcattgtctgcagtttagatctcctacaaataaatctatca

SEQ ID NO: 44973 - DNA, 1501 bp, Oryza sativa
cctagacaaaccagaaacaatttcattttaggacggtcagatgtagtatattactttctccgtttcagattataagatgttttgactttggtcaaagtcaaactgctccaaatttaactaagtttttagacaaaaatagtaatatttacattaccaaaatagttttattaaattaatagttaaatatatttttataataaatttatcttggatcaaaaatattattatttttttctataaacttgatcaaacttaaagcagtttgattttgaccaaagtcaaaacatcttataacctaaaatggagggagtacatattagcaccgaaggacaaattttagattgaaattggaggattccattcctttgttttttcttcgaaatataaaaataagtatgattggcttccaaattttcgtgcatcaacttaattaggaaaagtaaacatgaatgtgtatgtaaaagagttaatttggtaataatgcctcttttgcaacttttttgaatatattataacaaaattaatgttgtggctaggctgttacgtcctttcattttgaaaaaaaaaagaattcaaagtttggtgtgaagctaattaaagcaaaggtgtcgctgtattctttactgtttaagggagatcggagatcatatccgacgcatccttttcttttcctgaagagatagaagcatccgaggaacgaagcacagacgataatttgtacataaaacctttatagccattattttagtgatttaaaaatcaatgttgaaaataaactacaataaaaaccctcaaaattaactaagtataaataattaagagtaaattttactttggatgatattttgattaccgaaatttcactttgtattattatccttttatattcactttctaccaggtaatcgtacctttgttgtattttggaccaccatgactctcttctcaagcgtataaacaatttcaagtatgtcgatttttttaaataaactcctacagctgtatatagattatttctttatgtgccaagctagttaaatgcagatgagtaaaagagctaacggtggttcaaagtgtcagaggtaaaattacctggtccaaaataaaaatatgttaatctaaaccgaaacatcgtaataaaaatgggctaaagtgaaatttactcaaaattaaattttactagttaacttacggtccataagccaacaagaaaccaacgagaggcgaagtggcacaacattgctaactaacaagtatagtttactatgtatatacatagactatattaaaattagggttaattggatccatgcagtataaatatgtcaaattagaaaatgctactactattcccgatatcggttgggtgtcactataattttggaaaattagatccatgccactccgccgcgttttccatccactctccgttgacaccgtctctccgcgtcgcgcttggctccgccttattgcgtcccacacgcgcgcctactccgacagc

SEQ ID NO: 44974 - DNA, 1501 bp, Oryza sativa
tattctcaaaatatttaagaaaataatagacgaatgagagccaataaaggtataatttcatggcataactttgtttggacaatagttggaatttttttaactaaattggtgggttcagagggaaacatgaactagctagataatcaaagctctgcaagaatactaccaaattatatctgaaaaacacgaacactattctcagttatggtagaaaaaattctgcatatttgacaaatatttttacctgaggttatttgaaggagccccactgctagcaaagcacaattctaaggaactaaccaaatcatataggcttctgatgaggcctatattaggaggctcttgatctttatttcaaccatggttcaataatagttgaactcatacacacatacttctccaataatttcatacaaccatacgtctccaaaagaaaaataaattggtaatgcaatcatgataagctctaatgatgttaagcgctgaaaactgcaggaagaaatatatttaacttaatagtattgaaatatagaacattttgaattctgccagcgttcatcctaaaggtccaatggcctatggtcatatcatatctccgcacctaccgtggcatgtcgtgatgcgtgtaaaatattttgtgacccaaggactgatacccctgaattatgttttgttctcattcctaaaagctatcattaaccaataactattcttgaatggagcgcagagttgaaaagtaaaacaaacaagaagatacagaactcagccacagccgacaaacctcatgttctattgcctcgccgatctggcacgcagcctggatgactcggacacttccatcgccgctaccggtcatgagtagacccatgagcttgtgcatggtgatgacggccatcatatcagccgggagcatgttgaaatagcgggcatgggaggcccgcgcgccgcgctcacccacgagctcctgctcggcaatgatctggtctcgcagtggctcgaaccagccaagaaagagcgacttgacatagggcaggttgggcgccagcttctgctggcacatgtcagcaagcagctcgcggtactcctcggcggcctgctcccacgcctccgtctcaatctggatctgccgccggcgcagcatcgcatacttgtggtacccgaccccgtgcaccgccatagcctcggccgagtgcttccctctcccggacctcctcctatgcccctcctgccccgccgccggaaccgccatagcctcggccgagtgcttccctctcccggacctcctcctatgcccctcctgccccgccgccggagccggggcggagacgctcgggtccccgcgggcgatctccccgatcgcgtggtgcaactcgtcgacctcctcggaggagacggactcggcggcgacggcggcggaggaggacgcgaaccgcggcagcgtctgcgacggcgcgagacgctgtgaggcggcagggaggaggaggaggaggctgcggtggag

SEQ ID NO: 44975 - DNA, 1257 bp, Oryza sativa
gatagctcagttagcccctcgaacgcgcgtagacgccgccccgagctccgccgccgctcggcatggccttgccgccgtcggcgccccctcccggaggccgcctctcgtcgccggacctccacggcgcctccccaccctatctgatcccagaaacgaaacccttgagccccggagatgctcccgccacctttaattgagtcctcgtcgcccctcggtgatttcccctttctctcgccgccggccgccactgtcgaattccaccgctgtcgaactccctctagcgaatccgagccgttggctcgctccttctcgatgccctcgtcactccggtgtgctccccgaagaccaaatccgtcgcgcttgctccggtgaacatggcctccgtccgccatccatctcggcctccccttcttcctcctcccgccggcctgcgtggctgccacgtaggcgccacgtcggcgccacctcggctttgaccgagccgagccggtcagccgcctcctccctcccccctcggacgcgcggtccatggtgcgccaaccggctgcgcgtgggcccgccgcatccctggtccatccggtgcacgcgcatgaaccgcgctcacccgaaaccctagcaccgccctcatgcgccgctcccacggtgagccgcgccaccgacaagcgggccccactcgggaccccacaaggtggactcggcccaccggccctttctctccctcacttaccccgcgcccccttgggccgcctctccgggccggccggcccattagttcggccgagccgtgcctctcctcttgggccgcacccaagccgcccgaggaagtctaaatcatatccctccttcaatttctttccaaaaagggtttaataaattattaaatcctttttcctttagacagaaattccttaatccttagaaaatccatatcttctcaaccgctcatccgattgactccgttaaacttccaataattccgtaaaaattgagatctatctaatggtactattatctagtctaaataggatctttattttgggtcttgtgtagatttttaattgtttgcgtatagttgcggttaccggattttcgtcgatcgcgggttttctcgaagattcgtgaagcttcgtgaagacctcgagcaaggcaaatcaccctttgaccaattgctcctataattggaaaatcattattaatttgtttgcaacttgcattattagcaacacacatttatagcatgcttggcctcggtttgcg

SEQ ID NO: 44976 - DNA, 1501 bp, Oryza sativa
ccaaataaaaacgtagatacaatttgctcaccacccagtatcagtgcgctgctcttctggaatatcagttgatacaggataaccgatcagcctgcaaacccaaaaaggatctcctgcggttgtaccttcaaaagcatcaactggcgcacccaacgccaaggctatacctcgcatgatctttcttgaaagatctacaagtaaattttcataacaaatgctgtcactcataagtaacaaataataaatggatcaatagcatacatgcacaaataaagatttaaactaagtatagaagttaacctcttagaaggctgatatagttttccagcagtacatcaaaatttgatggatatttgggcctgcataaaaataaatgaaccggttatttgaattttgatagatctctgacctaaaatactcaaaggcagtctaccaaagttcagaacttcttcagtaatagctgaagtaattcaacaagcaataattctgtggtacctagtaccaactatttaatatgcttctagtaacaaaaatacattgaagtatgcaagtacaattgtagccataacttctattttctttactataattcataattctacccatattgtaacataatacatgttggtactagataaaatattgtaaatataaattttattccctcacattcttccaaatagaggtgtgctataagctaaattatttatattgtgagtattattaaaatatgcaatagatcaaaactggggtattgttttatatcaaagtcaagtacataatatctgtctcgcatatgtcaaataatacagtgctgtaggaaaaaaacagagatggagagttggatacataccacaaattagatcctaccattggtttagcaaggtctccatatttaccaggttcaataggcgtgtagcactgtgatgttttttcttccagggattaactcaggaacaaattaatggatgataaaaaaataataaagagaaaattaaacttacatcaattgcttcatgcatgtcaggtttacccttggtaatattttcaccaactctttggtaccctctgacagtaaagacaacaaagttatgttatacaggaaggaggattagaaggatccaatgtggaacaaggaaaaatgttggaaacttaaaaacaggttgaagctgtcattttatatcacacctgtatccactctgaggtgtcattttaatcttgagtttttcctcataaggaagctgaaagaacttctgtgtcacatccctaacttgcttcattagcgagtcagcaatcccatggcctttctgttagtaacatacagacaccatttgattaggattgatattgtgtagctagtctgctgtacccattgtagtaaactgatgctaaaaagtctgaagtaggctagtaagtaaataagtaaattttaccacataaaagaatccagcctccctgcaggcatcgtccaacatttgcacaacttgcagcaaatcctcgt

SEQ ID NO: 44977 - DNA, 1501 bp, Oryza sativa
gcctattctataagtatgtacgctttatttatgtttggatctgtatattaatttgtcgttttgtgtaccttggctgattcctagacagggacttaatacacaaaatactctagaaatttcggctaaatttctgggagtgactgtgcatgcaaaatgagaaatccattagcacatgattaattgagtttaaataatttcaaacttaaaaatggatttatttcatactgtaatggtacttctacatacaaaattttcatatgaaatgtatcatctagtagtttgagtaccgtgccaacagaaatcgatgaaaaatatgtattttaatcagaaaaaagaacggggcttagagtggttttgacaaacaaacagattgtgttgccactccgataatttcgtgtagagtcgtattcggagacatttaattgtattttttctctcaaaaacggaaacaaatatggcatcaatgttattgggtagatatgaaaaaaagtaagaaaaccgtgtatagatgcctaccaaaagtaggaaatactttttttttcacctacaaaaataaaaacttaaaaaatgcttttcataggcaggtcctaaagagagccacccgtggaaatcgatttacagaaacattcgtaattcagcccgtgcaaaaaccagcgatttctataggcacatggttgtaggtggatcagaaaacgctcgtgtaaatgggttatcagccacctgtacaaatgttttatgtagtagtgcgttttactttttctttttcttagaattcctctaatttattagaggtgacacatggcagcagggtttgtaagaacatcaccaacagcatctcgatatcatttcctatctggtattttggagatttttggttaaaaattgcatccaatagattctcaaccaactctcccaatccttccagttaccaattgagttcgctcccaatctgtctaagggcggcgaggcggcagttagggttgcatgcgagcgtgatctcatgagagcgaggagtgaaaactgatttctgttggaagtatcctaatgggcccacctttttgtttttaggaaaccaattatagctaatgtgttggagggatgttcttggtgatgcatgctcatgtttagtggattttaagaatatggataatatggagattgctacctatcggacgtatgacattttgcaaaaaatcggacggtgtttcaccacatgtaaaaaaatgtttcaaatgtttcatcactcattgaataatgtttcactaaaaaatgttttagatgtttcattactcgatgagaaatgtttcaccacttggaaaaaaatgtttcaatcagataaaacaatgaaaaaacactggttgcaacattaagactctattatgcaacatcgaagaaaacacatcgtacatcatgtgcaacatccgatgaaacatggatgaaacacacaaataaaatagagtgcaacaaacatatacaatatattgcaatgcaacatgatcgt

SEQ ID NO: 44978 - DNA, 1501 bp, Oryza sativa
taatgaccgaacaccctatacgaaaccctatataatacccaatatgaaacgctaaaactttacgcccctagatctaaacatcctcttaaagtatatttcatgataaaaacaaatcacaataaaataattaataattatgtgcttatactacatttcttggtaaaacgaataacaaaataattaaatcctatgagtaacattcacaggcctcactaacgcaccaagatttttaatttccaaacaaccaagaatttttggatgaaaaaagtggcacgaacgagaccagagctacacgaacgtgacaccgtgttgtgtcgaccaccaccgtcgtcttcttctcctcctatggcatttgaaattgacaaaaatcaagaggagacacaagcggacgatggacgatggacgaaaatcaagccgagagaagttgcgcgctgcggacgacggatctctgtttttttttgtccgctgtatgtgattacgagcgcacagacacaaagggtgtagctctcggtcggattacggacgataaaattgtgacgattggaaaattactaattttttaattagttaagatttgaatacttcagagcagatgatttttgacaaaagaaaaacattatgatcaattatacgtcgccacgccagctgtcacgagtaactaacaaatgaaggtcgtactatatatgtactcacgcagattgacgctcctgggatcagtaatgcccatggtctttttctacatatgtcattttgacaatctagcaacacacaacaataatcgtcatttgatacatattccatgaatgattgatctcttttgcatttgttcgtccctttcgttttcaacttggtactcgtaatttcttttaaagaacaactacttgcaattcccaaacatggagtactacatttgtctagcttccatcaaagtatatatatatgaaacagcaaccttcaattaatttagctctcgttgatcgattgatcgatcagtttgcaggctgtgttggctgcatcaggtcagcaattaatctagctagtcatctacggctagataacccttgcagttctcgtctacacacttctctttgcgaggtacgtatgtgttctctttgtcttgttaaagttaatttcgtaaatataatatagattatttgataaaataatggaattaaattatagattttgaagaattgtgtcaagctggaacctttttttaattctcaataattttgtcatgaccttgatgctagaattcttacagcgctatggctttgcagtttcgtgacatatatgcatgttcattgctaaacctgtagattattcgtagataaatcttcttgattaaatatatatgtttacaataattttattaaactataataaatacattcctgatcaagaagcagaaactttgcagagccgttgttcatcatggcaggcgagcaaggttcagctatggccaacagaggaggccgggcaaatcggaaagaaggggagg

SEQ ID NO: 44979 - DNA, 1501 bp, Oryza sativa
ctttaatttggctcgttgatcgatcgatcagtttgcaggctgtgtgtagctaagctagctagccatcgacagctagataacccttgaagttcacttctctttgggaggtttggtatgttctctttgtcttgttaaatttaattttatgaatagaaattctttgataaaatcatgaaattaaattataaattttgaagaaatgtgtcaggccagaacttttgaaattcttgattttgtcatgaaatcgatgctaaaacttttggctttcaacgctgcgctgatggtatgcctcgtcctgctgttcttgtggaaacgaaagtggctcatgatgggtcgagcagcggcgaacccaaatcctactagtggagatgtcgccaatttacaacacgacaacagtacattatagtgtaaataaatcgctgaattatatcacggttttacagatatgtatatgtatactagataatacctgcctggcgaactggtgataataggatgtaccaatgcttatttcctccatttagacactgcagaagttctgattgttggtacactttgtaccgtgtccttcccaaaatgcccttcatccactaagcttgggggaaaactgtggagtgtggacgcccctgttcctcattcatctctctacccctctcctgtcctcaaatggcttcgcccttcgggtcggagtcccgaaccccgtcgacgggctgtagcggcgacgacaaccaccaaatctggtcggtggtcctcccaacgacaggcagcagtgaagacgcggtggatctagaggctgccgttgtcgctctgcaatggcctcataaacatggtgcttggcttctatgacctgcgggattggcggctagcacagttgagctcctgagccagaaggtaggaggagcaggctggcgttttcaccatgtagcgctggcgcggcaagcaacgcggtggctgcgacggtgagggcacgcgtcgaggtggccatccgtcgtagatctcgggggaccccatcctgctagccgcactgggaaggtggcatcatcctccccgctacgctagcggcctagcgccagaacggtccagcccggactagaagcggttccagggcaagggtgcttcaactcctttggacgaaggaggcctcaggcgtgggaagtcctccaagatgcgccattcctctggcaagcgcgctcgtctctctcaggagtgtggtgtgtaggagactgaagacgatgggggcaatgttggaagcggcagaaaaagtacctaccccaacatctgcattgtgtactttttcctacagtaatatttcatttggtgggaggacgatgcatctcagtatcacacatcttagcacctattgacagtgcagattgtaggtgcaggcgaacccaagctcaaatctgtattttcctctctctctatatatatatatgtatatatatgtatgtatatttcctctctctatatatatatacagaatcattttcatatatctata

SEQ ID NO: 44980 - DNA, 1501 bp, Oryza sativa
gtgcacaggataacaaaggatggcatagtagggtctcatttgcataaaccgcatttaacaaatatttgagaatttaataaaacagttaagtaataattaatcaatattaatccaacgctatacaacataccctgttgtataggcccaaccattctgaacaaccatcccggctgcacagttctatctccaaaccaggaatgtaccattccaaaccaggagctaatcaaattatttccaattatagcatcatttactatggtgagaagggtgagactaatcacgaaagacattgttagacccgcccataaccgcgggcacggctattcgaatagttttactctgatcagaggtgtaccactgtaataccaccacgtgcctcaataccaccacggtacctcggaaaggagttgtgacaataccccttgcataacacaatccactgcagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaaaagtgagctaatgtttctaagcagggctaagcaattatatctaatatctagttgaaccaatataaataaagctcagctagtctaattataataacccaaggtatcaaggaataaagtaatcaagaacaaaagggctataacaaagaataggttaattccacccaatgacattcgaaaataaatgcaatagttgaatagaaacagtagctttaaacaggatcaacatgctcaaagggttgtttgggatctgtgtgacttgccttgctggccttggaactcttcaaattcttctccggcgaaaacagactctccggaaacaacagaatctaaacaaaaagaagcaaaatcaccaaaacagcacataaacaagcatgaacagtacatatggatatttttaacatgtagatctcaattttagaaaaatttagagacttgaaccaactaaatccgagctaagatgaattagttatgaatttttgaagattaaatcggattaaaacacttaaattgattttaattgaattatgacgtaataatgaattatttttgaaaaggaaaagagggtttattgcgtcagcggctagggtttcggtggaccgggcgcacggcggcggttcacgcgaacggacggccgagatcgatccatccaaaacggacggccgagatcgatcgggtccacggcggctcacggaagaggacgacta

SEQ ID NO: 44981 - DNA, 1501 bp, Oryza sativa
tttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttgtgtgaaaccttgtgccaccaaccttgccttgtttctcaccaccaacccgttctcatcttgtttgttcctaaagacccactttgtccctatgacattgtggtctctaggtctttcaaccaaagtccacaccttgtttcttgcaaagttgttgagctcttcatgcatagcattcatccaatccggatcacaaagagcttcatctacttgtttttgctcaagacaagaaacaaacgagtaatgttcacaaatcgaagcgacacgagatcgagtttgaacacccttactaatgtcacccaacacttggtcaattgggtgatccttggaaagagcggtgtgtatccttggtggcataggtggattttgtgccttctcctcctccacctcaacttgagcttgacttggcgtagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttattgtagacccggtatgccttgctatttgaggcataacctagaagaaacccttcatcaacaccgactttcaaatttggttagtctaacaccctttcgataaatataacacttgcaaccaaaaactcgaaaataggcaacatttggcttcctcccaacaattagctcataggaagtctttttcaagagacgatgcaaataaagcctattggttgcatggcaagcggtgtttatggctttgttgacataaaacacgaggcctgggagatctgcttaactccagtgcaggtccaaaactcgccttcgggtatgcaagtgtgctagttgatttgatcctgcaatcaacaagaaataaagacaaagaaatcatggttaaatccataaacgatagccgatcggctaggtgccgatgacatatcatttatcttcgggccgatgtcatatgtaaatcgatcggcagttataaatagataataaagaactaaatctactcgatcggctgtagatattaacaatatataatcctgatgtcgatatatatttaaatcaagtgattgggatagatcggtcgtcgtgccgagacagtataaatcacttagaccgaaatatatattaacaacaaagctatatatgttcatagcatagccgatcagatagatctagcatgtatcggctaatactccgatacaactccatgttaagatattaaaacaagcagaatataccaaacaaaagcttaatatacttagatgcaataaga

SEQ ID NO: 44982 - DNA, 1501 bp, Oryza sativa
aaaaaatcttctgttaattctataattatccttaactaaacgaattagttacgttaacacgttgaaaaaaaatctggaaaaaaaaaatctgcgcggcgtgcacctcgccggcgcgtacacgccggctagcttttctgcggcaaccttagccgatcatgcgttaacccaaaaacttgggtaatatttcttcaagtatttgccatttagtgctctgccataaacttctccatcaagtccttgcagtatgtaagctcctttggatacaactttatgaatttggaacggtccttcccaattcagcgaccacttgccgaatttgctatctcgagttccaatcggcaaaatcaactttcatacaagttcaccttccgaaaaatctttgggtactaccttcttgttgtaatgccgagcaactcgtactttatctttagtaacctttgcaagggctcgcaaacgtgactgaaccagatcttccctctcatcggccataaggttataatactcatcggctgttaaatcattttgtaattccgttctcctggagccaattctaacttcccatggcaaaacagcctcatgcccataaacaagtttataaggagggacttggatcgatccatgacaaaccatccgataagaccacaatgctttggccaaccgagtatgccattgccgaggataatcagaaatcttccttttaatcaacttaatcaagcttttgttagatgcctcggcttacccgttagcttgtgcataatatggtgaagaattcaataatttgatacccatgctatcggcaaactgaacaaactcatcggacacaaagatcgaaccttgatcggttgtaattgttttaggaataccaaatcggtagattacatgctcctaaacaaactgtatcgcatccccataatcaaccttcttcaaaggaatcacctctacccatttggtgaaataatcggtcgccaccaatataaacttatgtcctttactcgatggtggatttatcatgccgatcatatcaattccccaacctctgaatggccatggcttaatgataggatgtcacgccctgaaaatcgcctattttaataattcattctttaattcatttttagaaattattttaaaagcttacaagttgaactctaataatctaggaaaaatttcaacataaaattgagctagataaaatttcagtaaatactttgcttgtttatctattttctagatttttctgggaattatttgagcaaggaaagtatttttaataaatgaaacatcattccactaattattttaattgaaaaagtctttaaaaccctcccgtaggccgttgggccgtttccggcccaactcctctctcctcgcgcgcgccatgcagtccaagtcggccaaagccgagccgccgccccactcctcccctcagccgccgacatatggggcccacatgtcagggttgtcttcaacctccggccggccaagccgagaccgagccgcc

SEQ ID NO: 44983 - DNA, 1501 bp, Oryza sativa
tcaaagtcatacctctcctcttttctagagttctttacccattggcatggtataatctttttgctccttacccattcggctgcagctatctcagaatcatcatcctcatcgtccgacccatacatgtaaggacatacatgattaaccttcctagaattcttcctagcctctgcaaatctttgttcatgcaaggttaccttctgtgtgagatgggacaagctttcaaaatcctcagatgagaatttctccctaattggagcaatcataccctgaaaagctaaatcggctaactgggcatcagtcaaacttaagctgtagcacttattcctcatctccctgaatctctgaatatactcatgcacaggctcatcatgtctctacttgatcgatgtcagatcggacaatttcatctcgtgaaccccactataaaaatagttgtgaaactatttttctagatcggcccaactgttaattgatccatatggtaaagaagaaaaccaaataaaggccgatccagacaaagataaccggaacaacctaaccctcagggcatccacagccgatgcttcaccacactgggctaaaaatcggctaatgtgctcgtaagtcgatgtactatcttgtcctgaaaattttgaaaattctggtgccttaaaccgattgggtagtggaaccctctcaaaccattcaggatagggttgtcgatacaaatttccagcatctttcggcctaagcccaaactgctccttcatgacatctgcaatcaaatctgcccatggtcgttgttgaggtgttccttgaggttgctgtggcatagcctcccatacatgtcattcacactctcatgaggcaacatggagaatgtctcatattggatcttgaggaaatgaagcttggcatccttgtactcgcttctggcctcatggatctccgccaacttgttccaaatctcatatgcgatctcaaggttgctcactctatcgaactacttttggctcaaagagttgaacaaagcattcatggcttgggcattgagttggaggttccggtgatcaatcaacgtcaagggcgtgtcggtgatagcaaagcctatatccacaatactccaaatatggaagctcatagctttgaggtgagtagacattttaattttccaagtggagtagtttgtgccattaaacttgggagccttccttacatggttcacctcgttcgacatcttctttctaggcgctgaagcccaatcaagagagaccaagctctgataccacttgtaggatcgagatgtcgactagagggggggtgaatagacgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaaga

SEQ ID NO: 44984 - DNA, 1501 bp, Oryza sativa
tggtgagcaaaacccgttatcatcattgcctctagaagatcataaattcggacctaaatcgctaaagattcaatgacaacttcagaagggcgacataggccatcataagagacaataatgagagcatcacccttgtgtttccaggggcctccattcatgacacgataaaaatcaacctcatgatcaaaatcaattaggaatctattttcacctagatcccttgcagttctaaggttttgcaaaccccaagctgtgctcatctcatcaaacagacccttgacattataacgctgcgctgaataaaatcttgcaagagccaggaatttacatttcatctcctcctcaactttgccagatccacataaaaaacattatcttcttcctcaacgatatcctcatcatggttctcctcgaacaaaatgtcacgcccggaaattcactagtaatttccgaactaatttgtgcattaaatcctcgtccaggaatcagccgaggtacacaaactgacaatttaatatacaaattcatcaatataataacgttacatacttacaaaagaaaagaaaactgcagcggaattacggtctagcgaagctccggctccactcccataggcagctcaactggggtataagccaaacgtcttctccttcgcaacttgtcttcaactgaggtttgattgattattgcaaggtgagcatatgacatactcagcaagccacacagcaaatatacaagtgcacaaggataccaaagaatggcataatatagggctcatttgcaaaagaagcatttagcaaacagtaagaattgtaaaacagtagagtaattaatcatcaatattaatcaacactgaacagcacacccatgctacacaggcccaaccatcctgaacaaccatacccggctgcacagatctatctccaaaccaggaatataccattccaaaccaggagctaaattaattagcatcaattaccacattattattaatgaatagtgtgggactaatcacgaaagacattgttcgacctgcccataaccgcgggcatggctattcgaatagttttactctggccagaggtgtaccactgtacccacaagacacaacccaccgtcatggcaccgtgtccgcgcagacacgtcaccatgatgagtgattgtgacaagacccctcgcataactcaacctaaagcagtgcaccgttcctggatcataatcacccccttataaacaaggcatggactccccagcgacccccgtgggcttatctccaccacttctcagtctggtgttccgcaatgagccttcttatacaaaaggtaaagtcgttgcccatgctggcttgtggttggcacggttaatgtttcacaaccgaaactcgtgaaccggtccttaattgtcatgagcacgaccatcaaaaccatgtgctcacaacccaccattatcaagttttagtaagcacattaattaattaaccaatcacgattgaccatcgtga

SEQ ID NO: 44985 - DNA, 1501 bp, Oryza sativa
caatggtagtgttgtcgaacctaacattgctggcaatgcattgtaacatcctgaaaattcctgacaataaaaatcactaaaattttgaactttttaaaacttttgcatcatgttggatgttatggttgctattgcttgccaaactataaattgtcacgattgaagattaagctaaagctatacaactacgtaacaattataaaaataagatatttattatgaaccctatagatatttacgcacaacacaacaaagccatataaagagaaggttaattactaatttaatttataggtcaaatattaatattgtgactgtgtcatggcatccactcatataaaataattgatcacataaaataaattgatctttatatatagagattgaatgatgggagtatataattaaatatttagatcaatattgtgccaagtctcaatttcttttgtgaaataaatagattaaacctatccgtgtgtaaatacattgttaatacaaataaactcgaccaatgtgccattgtattaatatggtgatattagtatattataattaataattgtccaagcctacaagttatataggataattatgttaaaccaacacatggtgaaaacgaataaataccaaaatcccaaaagtataggaaatcataaaaggtatagtacaatttaaaaatttggacaatattaattttgaacaaaattcacatttgaatacttcatattgtcgttaaaatgcattggtgaaaatataaattgaaatagacctttttcctcaatttataaaatcaatcaaaaaccctaaatttacagcctggctctgttcattgtgcgccaggtgttcgactcggttctaacccggccaaacacccagcgcagcatccgcctccccgtgcacgcgcacgcgccttctctgctcgtgcgccgcattgggcgtgcccgtgcgccacaccgcgtgggcccgccgccgaccgagccaccgaaaacccgcgccaaagccgcgccgccacgggagcgcgcatcagcaacgtcgcgtcgcccatcgtctcggagccgaggggtaacggccgcgacgtcacccccacaccacccctaaaccctatccaaccgccctacacccgaaaacccgccctcaccaagccgccgctctgccatcgccatgtgcgcgcatcgccgtcgccacgtccgccaccttatccgaatgcggatgccgggtccctcctccattgtaaccagcgggtaaaacggagccttcctctctagctagggctagaacacacagtataggggtcatagatgcaatgatctgctacagaactttaatggaaaaggaggaggaaacatagccgcgtcaacctccctaatctaggccgtatagacagccattgagtgcaccagctgccgatcctatcctccacgccatcctggcttatccccaagccaatcccccccataaaaactccatccctatctgccttttcctcgaatacatttcatcg

SEQ ID NO: 44986 - DNA, 1501 bp, Oryza sativa
gattactttattccttgataccttgggtttttataacttgactagttgagctttacatattggttcagctagatattagatgtgattgcttagccatgcttagaaacattagcacactattgggataacttatgacgcattattatttaatgatggcttaatgatagttcacgatggttaatcgtgattggttaattaattacttgccaactaaaacttgataatggtgggttgtgagcacatggttttgagagtcgtgctcatgaaaattaaggaccggttcgcgagctactgttgtgaaactttaaccgtgccaaccacaagccagcgtgggcaacggctttatcttttgtatagcatgattcattgcggagcaccagactgagaagtggcggagataagcccacgggggtcgctggggagtccatgcctctggtttttgagggggtgattatgatccaggaacggtgcactgttttgagttgtgttgtgcaaagggtattgtcacgatttccccctttgcagtgccgtggtggtacttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatcctcgtgcacttgcatatttgctgtgtggcttgttgagtatgtcatatgctcattcttgcactaatcaatcaacctcagttaaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacaagcgtgccctccaaagaaaaggaaaagaagtaaaacaagacaggctgcctgcaaagtaaggatgacagtgaagaggaaaggaactaggtgggaagtaattcagtttgttgaagaacacacacatcctctggttagaaagttttcacttaagaaatttctaaggtcacatagagcaataccgaaaaaggaaaaagatttcatcacaatgttgcacggagttaatctctcaactggta

SEQ ID NO: 44987 - DNA, 1501 bp, Oryza sativa
tcacaggattttttgtgcagcacacaagtgccatacctcaccttgactttcaactcagaggaggaagcaagggctcactataacaggtatgcaaagtgcgttggattttcaatcaaaatcaacacttcaaggaagtcagccaaagatggagaacgtgacaaagtaatgtttgtttgcaacaaatgtggtccagaagaaaaaacgggtgaagcgttatcacatcctgatttttgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctaaaattttctcggatttttcagacctcaattcctaaatgatacaaagaacagttcaataattattttatcattaattataattgttaagtgcttttcttgtttaaaaatccttaaattataaatttttgtttaaaaggaattattagaaatgattttaaaagcctaaaagagaagatctaattttaatttgttaaatctcaatataaaattgggctagataaaattttgttaaatactttgcttaattctataattcctagatttttctgggatttatttgagccaaggaagtatttttaataaatggaattgcatttcatgaataatgtaaattgaaaaaggtttttaaaagtcttcttttggctttgggccgaaagtcggcccaaaacctctcttctctctctccctcggcccaagtcggcccagtccgccgagctgccgctctcctctctctctctgtcgctgacaggtgggtcccacctgtcaggttcgtcttcctcgcgccgccgccgctgcccggaaccctagccgagtcgcgctgctgccgctttccaatccgctcgatcctttccttctccggtgaaattgatagaggggaaatgatcttctcgatctcctccaccttttctcttttggaatcaccggctaaaatcgtttggaaattcgtggattcgaggtcgattcggatcggtctctttcctccaaaccccgacctttccttctcgtcgccggcagccgtgggccttcgccgccgcctccttgcccctataaaaggatcccctgtgtctcctctacccgtcgccaccctcgccttcgtctctcgccgtcggaagcgccctagcgccgtgagatcttgtgccgccgtcgtcgccgtcgctccagccgtgcgccgccgccgttccggtcgtcgtcgtcgctcggggaggtcgccatcgtggtcgccaagtcgtcgccgtcctcgtccgccgcttcgccgccgccgaagaccgccggagcaccgccgtcaccgtcgacccgaagaccgccgccgtttcttcctcgtcgccggcgccgtccgttgctcctccgccgcttcattggtcaccggtgagtttgccgcaatgcccg

SEQ ID NO: 44988 - DNA, 1501 bp, Oryza sativa
cggattcgtttggaaacgctcccgcaaccttcgccggcgcatcaatggcggccggatcttccgcggccgattccccctcatccggccgctctctccccctcccaacactatttaaacgttccccgtgcctccctcctccgtttccgccactcgccgctctctctccccgtcggaatcgagctcgcgccgtcgtcctctctctccgccgtcgccgccgagctccggtccgccgccgtcgtcgcctcggactttctcccgcctcggcgtcgcctccttcggctccgccgcgtcctcgccgacctcgtccacccctccgtttcgccagccgaccgccggaacgccgccgttcccgtcgacccgagccgcgccgccgcctctctccgcttcggtcgccgtttccgttgtcgccgtcgacccggggtgagccgtggaccgccgtttcgcttcccccttccctcccctctctcgggcgccgctccgccgcgctggtggtcgccgccggcgaccatcggggtgcgagcgcgccgcctccccgtcggccgtgccggcgaggccgccttcgggcgcgccccgcggctgccaggtggggcccggccgtcagccgcccgcgccctcgggtacggctgacacgcgggacccacggcgccggccggcgtaagccgcgtgcacccggtccaccgtggaccgtgaggctgccgcgtgggccccactcctgtggacccggtccgcgcgcccctcccctcggctgacgcaataaatccgattttaaattaaaatttaaatgaagaaattcgcaaatatccatttaaagagcatataagcttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgagcatattgaatctcagtttataaaattattttgatttaaattaatgcattaccgctttatttaaattcccgcgttatcactgttttgtttagccatgcctatttacctttgttatgacattattattgctattgttattattaccttgttcaccctagaataaacaaaaccccaactagtgggtactctattcatggttccactagtatgaatttaggtagatgcttcgctgtttaataggacaacattaggtggtttttataactttagactttgggaattctcatatcatttggacactatggaatggttggcttatgttggaattggacacacacctccccctctattcaaaacccccaaaatggttttaggctgggctcgaggtgcgtggttgggttttgctagtcgtacctcgggtactataaggattaa

SEQ ID NO: 44989 - DNA, 1501 bp, Oryza sativa
aaaaggtaaagaaggtgtgggtgagaaaagaagccaaagctccggaggtcgtcactattaaggaggaatctcaagatgttcaagtacctactggcacagttattaagaccggaccggaccggtggtcagaccggaaaaaaccggaaccagagcccccgccggtccggtccaggtaaaagatgttcaagtacctactggcacagttattaagaccggaccggaccggtggtcggaccggaaaaaaccggaaccagagcccccgccggtccggtccaggtaaaagaccggtatgcaattgagccggctatgaaccggctagaccgcccggtttcggagaaaaaccgctattaaaccgggaataaaaaccgctttgaaccgggctcttgacggctggcgacgaagcgcgtgcatggccgcatgggcacgcgctggtgggggagaaaaatgagtgaaaatacgcgctagggtgaattagaacccaggaccacatgggaggaagctaactcaccgaaccaccacgctaccaagcgccttgtgtttggacagaatgattaatatatttaacacgtattgaaccggattagaccaacggcctaaccggttgaaccagtgaaccattgaaccgagagcctcaccggttcaattaccggtccggtcttaataactatgcctactcgagatgcggcgaaaactatacaagcggagaagattgaagccgataccgttactgtccacatcggcggtctgaccgaggcgtctggccggtctgatcgccagactacggccggtctgaccaaccctcctggccggtctaaccgacggcttgcagccggtctgaccgggcccagaggccgatcagaccgaggggcattaaaggtgagcgggaaaattgagagcaacacaggagcttctacttcgcccaaaactattaagaatcattgtttagctcctggaaaacaaccacagccgaagtggataccttctggcttatctcgctctcaaaagaggaggctacagcgtcttcgagccataggtcaaaaagaaaaagacgccgaagatgtagagaataaaacatgtaataatttagagcctcgaacgacacctaagcgagtgtggagacctaaagaagtaaaagttaaaagatcggtgatttcatggagtagtgatggattcaatttgatgagagaagaatcatcggtcattaaaaaaagggtttgttggaaccatgccaccctaattttgcaaaatttgagatatgccacccgtatctcaatgacatgtaggacccacatgagtcaatgacatgtgggtcaggatggcatattacaaattttgcaaaatttgtgtggcatggttcaaattttcccttaaaaaataagtctccttcacatgatgctgtggatgttggtgcggtgttcgtcttgcctttgaaatcgtgcagtcgagaaagccgattttgcttggggggcaagacattattatgcttatgaaggaaccaaga

SEQ ID NO: 44990 - DNA, 1501 bp, Oryza sativa
ttgatgcaaggcagcagaagaagtagaggcggcccgagccacagctcccgcggtcagctacgccggcttcggctccaaccagtgatgatgaagcatgctcacaaggtgttcgatgaaatgtattcgaggaaaaggcagatagggatggagtttttatgggggggattggcttggggataagccaggatggcgtggaggataggatcggcagctggtgcactcaatggctgtctatacggcctagattagggaggttgacgcggctatgtttcctcctccttttccattaaagttctgtagcagatcattgcatctatgacccctatactgtgtgttctagccctagctagagaggaaggctccgttttacccgctggttacaatggaggagggacccggcatccgcattcggataaggtggcggacgtggcgacggcgatgcgcgcacatggcgatggcagagcggcggcttggtgagggcgggttttcgggtgtagggcggttggatagggtttaggggtggtgtgggggtgacgtcgcggccgttacccctcggctccgagacgatgggcgacgcgacgttgctgatgcgcgctcccgtggcggcgcggctttggcgcgggttttcggtggctcggtcggcggcgggcccacgcggtgtggcgcacgggcacgcccaatgcggcgcacgagcagagaaggcgcgtgcgcgtgcacggggaggcggatgctgcgctgggtgtttggccgggttagaaccgagtcgaacacctggcgcacaatgaacagagccaggctgtaaatttagggtttttgattgattttataaattgaggaaaaaggtctatttcaatttatattttcaccaatgcattttaacgacaatatgaagtattcaaatgtgaattttgttcaaaattaatattgtccaaatttttaaattgtactataccttttatgatttcctatacttttgggattttggtatttattcgttttcaccatgtgttggtttaacataattatcctatataacttgtaggcttggacaattattaattataatatactaatatcaccatattaatacaatggcacattggtcgagtttatttgtattaacaatgtatttacacacggataggtttaatctatttatttcacaaaagaaattgagacttggcacaatattgatctaaatatttaattatatactcccatcattcaatctctatatataaagatcaatttattttatgtgatcaattattttatatgagtggatgccatgacacagtcacaatattaatatttgacctataaattaaattagtaattaaccttctctttatatggctttgttgtgttgtgcgtaaatatctatagggttcataataaatatcttatttttataattgttacgtagttgtatagctttagcttaatcttcaatcgtgacaatttatagtttggcaagcaatagcaaccataacatccaaca

SEQ ID NO: 44991 - DNA, 1501 bp, Oryza sativa; identical to SEQ ID NO: 44946

SEQ ID NO: 44992 - DNA, 1501 bp, Oryza sativa
ggcccaaagccaaaagaagacttttaaaaacctttttcaatttacattattcatgaaatgcaattccatttattaaaaatacttccttggctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaaaaatttataatttaaggatttttaaacaagaaaagcacttaacaattataattaatgataaaataattattgaactgttctttgtatcatttaggaattgaggtctgaaaaatccgagaaaattttagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacaaaaatcaggatgtgataacgcttcacccgttttttcttctggaccacatttgttgcaaacaaacattactttgtcacgttctccatctttggctgacttccttgaagtgttgattttgattgaaaatccaacgcactttgcatacctgttatagtgagcccttgcttcctcctctgagttgaaagtcaaggtgaggtatggcacttgtgtgctgcacaaaaaatcctgtgatggcgctgactgtgcttctgaatcatctgtgccagagtgttcacttgaaattgtgttggcagtagcagttgttgcgccagttgcaacactagtatgcattgtgtctgcatgatctgacatttcttcaaatagttgcatctcatcattggcttcaaatacttgcatctgatcattggttgcaaatacctgcatctcatcattggcttcaaatacttgcatctgatcattggttgcaaatacttgcatctcatcattggctacattgtgtgctcgtaaacttccagcatcatcagcagtatacatagtttcaaagtcaaaagtgttgtccaaatttatagtaggaatctccatgctagtgtcagttggatttacagggaattatgtttcacttctgtcttcatcatcaattagtaaatgatgtagtggatgttcattttcaccagaaactaattccgggatactgttgaggtcaaaatccatttttgctgcatgtgtttcagactattagtaagtttatacagagcattcattgaggtaattcagtaattggggggagaagtaacttgcacatcacatgaaagtaaagcttttatttttttcagaggagtaattttgtcagacaattacatctgtggtatagaaaattacttgcatgttttagagggagtaacatttatatgttttgaagtaagccagtacagtttggaagtaagttacatgcaacaggatagcaac

SEQ ID NO: 44993 - DNA, 1501 bp, Oryza sativa
atttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcgattgttacatctattttggagtatcccataagggataaccactcagatcagaagctattcatatgagctacgcttggtctatattacccggaagatttgttactcgggagcatgttatatgcgtcatcctttaaagggtatcgaaggcatatttttttgcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacgtctgttaaagcagtgtgcgcatggcgtatgcccaatactttggaaatttctttattcacaacatacaagcttctttatagctattttgctatgtgaattttcaataatgtagccaactttaggttacactcatcatattttacaaagcagtcggtatatcacttggatcatattattcagggattcacaccgcatatgctacatattaatattaaatcgcttggttgactataattatcaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatgacgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttatgtttcctt

SEQ ID NO: 44994 - DNA, 331 bp, Oryza sativa
ataagccgatgcaatgtccagataacttatcggctaacaccccgataaaacactagcataaacctatcggcttaacaagatctatattatcaacaacaatctagaaggtcgaacctaaccgacacagcacgaaattgtatatgataatttaatactcgatgagccgatagatctatctaatatgatggatataacaaatctatttagaacaacattgtgattctagagatatatcggctaagacagaagatcggacctaactaagacagtcctaactaaactgatgcgtctctaaacacaatgcaattagagatagagttcataaatcagg

SEQ ID NO: 44995 - DNA, 191 bp, Oryza sativa
atttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacat

SEQ ID NO: 44996 - DNA, 1501 bp, Oryza sativa
gtcattaatggaacaaagtttcacggatcggagtttactactcgggtacttttgcaattattaagagcagaaaataaatttatctcatctctatgcttttgatttattccgaataatacttggcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaatgaaataaatgatgacttagctttgtcgtattccctcgatgacagcagaagtagccgatgtgggaataaagcagtccatcaatggtgacaaaaacaccagtcagcgctagtggaaccaagccagtggtgtagatgatgaagcccattaacagcggcggagtccgccaaccgtataggcaaaaacaccagtcagtggcggcagaggcaggccggcggtgaagtcgtagacgcccaacagcggcggcataataggccagccgtgtaggcggagacaccagtcggcggcgacggaggcaggccggcggtgaagtcgtagacgcccaacagcggcggcataataggccagccgtgtagacggaggcaccactcggcggcgacggaggcaggccggcggtgaagtcgttgttgttatcagcaatggcggtggcgaagacaagccgacagagtggactcgcggccgatcgaccggaaagctgagacgcctcgactccatgaccagcattaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccgaagcgaaaacgaagtcggcgactcatgaagttaattccatcgtgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacat

SEQ ID NO: 44997 - DNA, 956 bp, Oryza sativa
ggccacgaggcggcgccggcgtcgatggggcggtcgcagccacgcggtagagagaagaggggcggcggtggcgagccggcgatgaacgcgaggggagatgaagggcagtgagagactaacgagtgggtcccacaacatttttcacccgagtttgccacactggcatgctacgtgggcaaaaatggcaaatagttaagggaccacctcttaagagggggaaaaaattaagtgcaaacctaagaagaatatttggataattgccaaacctaaaagtggtaaatagttaaattccccaacaaagcgatgtgtttttcctagtgtcaaccgaatatgactgggctatctgttcgtttctaatgaaaagagtggatgaaattttggatacttgtagcacgcttttcaaactgttaaacggtgcgtttcatgcgaaaattttctatatgaaagttgttataaaatataacattaatctatttcttaagtttgtaataattaaaactcaattagtcacacgatattaccgtctcgttttacgtgaaacacttaatctttatctacatcttcatcttcaggagattcgggagattaatagtacgggacttggctgagtttggattgaattggaatccaaaaatcattcgatttgtttaatccaaaaatccaagaaaaagttggatttccaattggagggggcaaaatataaaaattcactgcctagggtttaatgtaggagatcgaagaggcgtctcctcctcctcgccgtcgtcgctcaccatcttcccccgcaaccaccgccgcgccgccgccgatcgcctctgctctcaacgcacccaaggttagtatccatcagcttcaccccgcgcttcctcctcctccgccgcctccgcctccgccgccgcaagaagagctagcttgcctctttccccccagatttgatccgatccccccaacctgct

SEQ ID NO: 44998 - DNA, 1501 bp, Oryza sativa
ggaagtaaaagacaagcaaacaactatctatggaatactccctccatcccaaaataatccaactcctagctacaaatttagacatacataaatattgcttgcacttcagtaacaatgcgacagcatcctgaattttggacaaactgtttataacaaagtgaagcacaatacatgaccatgaaaagcgctgcataccagtaatttagaataaatttcagaataggggataaataatctgggttgcctttaaccttctgttaagagaaggcccagaacaatcattctgaaaatagggacagaagcagagaggtatactgtcaatcacagaaccacctgacaaacacttcctccattctaatcatatattacaacaaaaaaaaattaatttgacatagtactataattatcagtacaaactgagcacaacgtcctgcctccagaaatatagtgcttcctactattgcatcttgatatactattgcatcttgatatactattttgttataaaaaattaatttgacatagtactataattatcagtacaaactgagcacaacgtcctgcctccagaaatatagtgcttcctactattatcagtacaaactgagcacaacgtcacgctgatatactattgcatcttgatgccctctttttggttccatgacaaattggctcaaatcgcaaattggctatggtcagggcccctgattcagggacatgagaaaaataaaaacatgctgctctggttgatcaaagagaagcactcagtcctactcaggggcggatccaacgtgggtgcagggggactcgagtcccccatacacccataagacccatggatacccccggagcacctccttcaattttttcaccataaatgataaattaaaggtccctaaatggctggagattgaagaaactgtgtaattgagtcccctccaattttttgttcctggatccgcccctggtcctactggaagttcatttaggtttctaaaacatggattaggaaaaataaatatgaggttgtagtcaaaacatacaaactcttgccaaatacaattcctggcaagttaattttcaaggaaccacaatagtcaccgacaatactaaactaagtcaatgttattgctattgatgccactatgctccctcaacaccgcgattttgttatgttgatgctgttccattgcaacggagcaggccatcagagttatgttaatgtaggattatcttcagtatccaaattttgatcaagggcgcacaaaataaattttgcggaaggacaacaggttatatgtcagttaatggaaacaaagcttgcaaagagataaaataaacctatctatcatataaacagataagcaccacaaaggtgctcccaaaatgtaaagagtaaactgactacggtacctgatttaggaagagaagaaagaatacccatatcccttataaattaagctaacagctcttagactcatcttgtggaacactacccctt

SEQ ID NO: 44999 - DNA, 1501 bp, Oryza sativa
ctattctaatttttcctttcacaataatatataggattattgtgcagtggaagctttttctatgataaagggaggatataataaaggcccagctagctttcatcaacaaattagccagataactagcttgaacaaagcaaaggggttttttcttcgaactagagttattgctacaagaaagaaaatgtaattaatattggtacgtactgatgaacattttagatcaaatccataatcaatactacagcacagagtttcccaacagttgaacaacacaaaactactttttgtagataaagaaaatggtttatcggcaaaaaaaaactaaatatttgattaagcaaaaatattttgcagacaactatggagtactatatttgtgaataagcaaggatcaccaaacaaaaacatgttttggatttcatactagaaatttataattaaagaaaggtactgtttgaccactctaagatcaaatccattatcaaaagtacaccaaacattcatagcataaacaaattattaagtaccagtacatgattcagatcatatgctacaaaggcacatatatataagatttcgttctgtatcatgcagaattgcagattgaccatgcaccacccatgagctggttcagttcaccgcagcggcaccaccggcggctggaggcggaggcggaggcggagagtcgccgccattgctatcgccgccgtcgtcgttctgctgctgctgcaggtaacgggatatcagctttgccctcaaagcttccatcttttcaatcctaaaccttatcaccagcgtcgacccatgtccttcagagacaagcctgtagcattcatcctctagctccctgatacgaccatcaatcctgctgatctgcacatatatataagccatccataaaataccatcacgatctgctcattaacgcatgaacatctatcacaagaaatggatgaaatcgatccatcaaatcggaacaaggatatatatataaacctcatgctccaggcgtctcgggagctggtccagcagcggttgccgtcgcagtggcggcctcggtggctgcggcggcagcggaggcggcgccgccggagctgcagcctggttgttgttcccctgaggcgccgccatggattagagcttgcttgctagggatagaagataagttgggtggatgagagaagagggatctgtgttggggtgttcatataggacggaaatcgagatggctgcattaactcatgattggctgtcaccactcgccaaaagataagcattaattgtattacaaatttgagaatcaccagtcattatcttcctgttttggaatttatatttaaattagacttaaaaaaaaatactcggaagttacaatgggtaaagacaatatgagagcttagtttcagtttacaatgtgtaggcaatataagagctttgagttttatcgagcggaacaagagctattatgggttaattattaaattgaaatattaggatc

SEQ ID NO: 45000 - DNA, 1501 bp, Oryza sativa
ctattcatttgtagtattttctcgtatgtttatttgttgttgtttttgtgtgtttatgctagatcacagcgatagaatcgtcggaggggcaagagctaggtggaccaagaaggctacgctgacgttagcaaattaaagcccttgttctgcaaggcaagtcatgacctactccttgcactatatcaaacacctacaaagctagcctgctatagttattttattttctaattatttctgaagagtattaatcttgttagattaattaccatctatttgtttaatatgttatgattcttctttgataatgtcataggatggttccttgtaaactaggtataggtttaaattcttgagagtaatgttgtagtggctaatataacaaaaatcatcacacacacttggatatatcatatacctgccatcatgcaaaggcatgtcaagccaatacacattgattagtgggttactcacctagagtgacatagaaaattatatatatatatatatttttatttatttatttatttatttatttatatttatatttatatttatatttcttttaccgttcattcgtagtattttcttgtaggtttattattgttgtttttgtgtatttatgttagatcacagcgatagaaccgcagagctgcaagagctaggtggagcaagaacacgacgataacgttagcaaagcccttgatccataaggcaagtcatgatctactctttacaatctattatgctttaattatttatgaagagtattaatcctattaaattaattaccatctagctatttaatatgttatgacttttctttgataatttttgaaccatagtcattccttgtaatctaggtatataggttagattcttcagagtaatgttgtagtggctgataccaaaaatcatcacatgcgtttggatacccgccataatgcaaaggcatgtcgagcgaatatgcattcattagtgggttactcacctagagtggcgtggaagattcaagatccacgcggatggttgttttgcatatatgctatctatgattgcatgtatgggtctatacttgtggtggcatccgtttggagccggttcaagtttcttgtttgattttaatttttaatgtattatggatgcccaaatttttcctagtaaaattaattgtgtgttactttggaaagaaaagtaggaatagtagcaatccacaatgcaaaagtagccctctgcatcatgtgagttctaatgcttatagctgcagttgtattctgctgctagtgcatgtgttaacataacaagaaatctctccctccctatcaaaacaaatccagaacatgatatatcttcatgtgagcaaggtaaacattcatggaaatcacattgtaagcaccacattgtttttttaggataaagacatgtcagttttaattaatgctatgataatcatcatatgccctcctggttgctcagatcgattgctaacaaggaaacagatgat

SEQ ID NO: 45001 - DNA, 1501 bp, Oryza sativa
acactaaacatacttttctaaagataaaaggaaactaacaaactattcctaattaatagataacttgtcatgttacatcctccttgaactcggtctcttctagataagtttccttaaccgaatcctccaagaatccgactgttggcgacttgataattctcatcggctgattccgagatgccgaagctgatagtgactaagccgatgatgatttcgggcttacaccattttggcgttaacacccatccccaaaccttcaacctctccgtgcggcaggaagaatcgtctcccactgacgtgcctaccgtttcctatcgcggctagcgggtctctcttctccggcacgtagagcctggcatgcaagcagcagcagtgcctgattgaggaaaaaaacatggcacgacagcggccatgcctacaataagctaggtaggtcatgtccaattaatgaaaataacgagataaattaagaaatggacacaactcattattcaactttaagtgccttttgcaatcacggataattttgcaatcagttaacacaaagcacaaatacttgaatggagaagtttttgaacgaaaagaatggagaaatgctccgagtgcatccaatgcggccagcgggaggcttgccatcgcggcgaccaccataacatggattcgatctatagctagcgacgaaccaggcagtgagcagcagtacggccgtgccggtggtgaaggacggcatcaaggcagcttgggcctgacctgagcgctaccccaccgttgcctataggccagccggactctgaccctgcttgagttccgcccagtttaatgtctagttagctgcatgattcgatgaacatactacatgcgccggtgatgcggccggcctgctgctcactgcatggttcgtcaatggagagggagaagatttggggatggggatcgatctaggaaggagcacggagaagaggaaacaaggtaaggggtcatctggaaatctgtatagaggatgcgggcgtttttctaaaaagaacaccccacctacatcgtgtccgtcagatcaggatcggagggtttataacagccgagtgcatgagtgcagaaggttaggtgtgtgcataggatatgttgcccagttgaaaagaggaaagctggaacgggcacaagtgatattccattgtatgtgcagcagcatgcacacagagatggcagcaatggcggagaggctccacctccgccaccgcctccgcctccaccaccagcaggtgctgcagctgctgcgataaactgaaccaacaggacagttgatctgatcaatacatgcatgatgcagaacgaagtgtgtactagattttaacttgtttatgaacgtttggtgttcttgtgataagggggtgtggagattatgggtaccccatacccacacggcatggttatccgactagttataggggataacttatatctatgtaatatgtaacagatcatgacttgggtgttatgtttcctt

SEQ ID NO: 45002 - DNA, 1501 bp, Oryza sativa
ggcagtgagcagcagtacggccgtgccggtggtgaaggacggcatcaaggcagcttgggcctgacctgagcgctaccccaccgttgcctataggccagccggactctgaccctgcttgagttccgcccagtttaatgtctagttagctgcatgattcgatgaacatactacatgcgccggtgatgcggccggcctgctgctcactgcatggttcgtcaatggagagggagaagatttggggatggggatcgatctaggaaggagcacggagaagaggaaacaaggtaaggggtcatctggaaatctgtatagaggatgcgggcgtttttctaaaaagaacaccccacctacatcgtgtccgtcagatcaggatcggagggtttataacagccgagtgcatgagtgcagaaggttaggtgtgtgcataggatatgttgcccagttgaaaagaggaaagctggaacgggcacaagtgatattccattgtatgtgcagcagcatgcacacagagatggcagcaatggcggagaggctccacctccgccaccgcctccgcctccaccaccagcaggtgctgcagctgctgcgataaactgaaccaacaggacagttgatctgatcaatacatgcatgatgcagaacgaagtgtgtactagattttaacttgtttatgaacgtttggtgttcttgtgataagggggtgtggagattatgggtaccccatacccacacggcatggttatccgactagttataggggataacttatatctatgtaatatgtaacagatcatgacttgggtgttatgtttccttgtatattacggaacggcctaaagtcctgatttaggaaaccgataccgtattggttaaggtttctatcttgtaatcctgccccccatcctatataaggtgggcaggaggccctctagggggcatatatgagacaacctgatcgtcagatcaatacacacccggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacgagcacgatggaattaacttcatgagtcgccgacttcgttttcgcttcgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattaatgctggtcatggagtcgaggcgtctcagctttccggtcgatcggccgcgagtccactctgtcggcttgtcttcgccaccgccattgctgataacaac

SEQ ID NO: 45003 - DNA, 1501 bp, Oryza sativa; identical to SEQ ID NO: 44993

SEQ ID NO: 45004 - DNA, 1501 bp, Oryza sativa
attcatgcgttgagaacacattttacattaatatcttatgaaaacacaaacatgtatcagtacttcgtttttcttttttggagttactgttaaatgctatcccctctaacaaaacttaaaggttgatacaccctttataactagttagtacttttgcacggaatttgtgagatacttggacttggtactttatctgaacctgttctggtctgtgaaccagcctaattatcatctataccatctaatacatgttgagatagtgagattctgaagtatgaattgatatgcttggtgttgcgatgacaatattctgtagcaatatgaatcagtatgcttggtgttgagatgatgaaattctgtagtagtatgattcaatatccttggtagatttaagagtagaattctactctcccgttttttaatgtttgacaccgttgacttttatagataattaaatttgtccattcgtcttattgaaaaaatatataattattatttatttgttgtgatttgtttaatcattataaacacattgagcaagacttacactattttaatttccacatggatataattcaatcccactgactagctgagtgctgagacccgatgtatcggttgatacccagttcctatgggctcgaggagagaacatgttatgtggaaaatacaaagtgaactggaatgggtctgtagaccaaaagagctaggattgctcgacttgcaactcttctcttgtgccctacatgtcagatgtctttggtacgaatggacatagccgaacaaaccatggctagggttaccagttctgtgtgatgaagacattgcactctttaatgttgcaatagagatcacttcagaaatggtgccaagtatatagacattcaaaccctcagttgtagtaccaactctcttccaagtgttgatggcgggggggagtacatgatagtcaaagatacactcaccggccagcaatagatgggtcgcggagttacaatccctactcttcaccactttgcagcatttccatgaatttgtctatctttggcctttctgcacatggtgcacctccaacaaataccgatgacacgatccgatggaaattcacagatattacatccggcacaactgatgacgaacaggaacaagtgtctaaggtcgctggctccattctaagtacggcccagcaacggcctgttcgtgtaactaggcccaacccgaagtataagggtggaaactgggttaactagctgtatataaaggagagagagagaatcgggagggaggacatgtaaagacagaattcccaactcaatacaaactcaatctctctctacaactctgtctttctctctgcttctcttcctctattcctctcaaactttctctgattctctgaaaatatcttacttctcttccaagttggtaacatttggtatcagagccgcaatcctggagaaacctcagttcaaaactcgtcttcagatccaagtcgacgaca

SEQ ID NO: 45005 - DNA, 1501 bp, Oryza sativa
atgaagctttataatcaaggaaatcccgggaccaaagaaaaaaacacaacaaaactctaattggactttgtgctgccggtccgactgtccggacaaccgcgatctgactgtggttcattgtacagtatgaccagctacacaacggtgtccagacaggccttcgcgggaaaggctcgaccaaatttggctttaagttgctataatttgatcataatgctaattttttctatcaacgactgtatagctagttttcttttatatatttcacatgttggttattggtgttgcaattaattttttataactgttacgaccctgttttggcatgctctagctccagctccacctcaccatgatatgaagtccaaccaaacagtttcaacttcactaaaaatgggagtggagctggttggagtgctctcataaaataaagtagatagatggagttgggtttaggtagctccgcaagtccactccagacccaactcctgatgttaaatttaggagttggagtcctaccaaacatgctctacatctcattgaaatatttattttatcgaatggtaaaacattgaacaattcttgccaagttactaaatactttccgataatttgccgatgatcggatgtccaactgtccatcatatgaaattaattcatgcggtcaattggactgatgaatgtgcatcatcacggaaatgcttgtacccgaacgtttgagaggagatgaaacgtcagacgacacttaattaaggcgagatccactatcgatttaagtattgcccatcctatcctctcatcctgttctcacattttcttcaatggtagagaacacacgaacggagctagccattgttgccgtcgaccatagcagcgatgacgagatgacatggcggagcaatcatcaccgacggccatagcagtggcggtggcagggtgacggggagaggacggaggtgccagacttggtcaccggcgaccatgacaatggcggcgagaagagatggtggagtcatcatcaccggcagccacggtggtggcggcggcgacggcagcagggcgacgcggagagaatggaggcggcaaatcctggccaccggcaccgccatcaatgagaggagattcggagggataaaggaggtcaaagtgatgcaacaactagctacagtcgagaagctcatcgacgaggaatgtacgtgagtttcgagagatggctgggtagaagaaggtagagttagttttgtttttttttctagagcttgacgatgtttcaatccataatttgcttttgttgcacttggttgtgtttggatgtttcattatgtttttattggagtagttttcgagtgttgcatctattaaaacttttatccaatcgatgaaacattttgtcaagagtgatagaacattttctctccaacaaaacgagtcggaaaatgccgaaaaccataaagggcgccttagcatgggactatagttggccatatggcccaaggcctga

SEQ ID NO: 45006 - DNA, 1501 bp, Oryza sativa
ttactaagagggggtggctatcaagctagaaaagtggatgggtttagagacaaggaattttatacaggttcaggccttcttaataagaagtaataccctactcctgtccggggattgatccgctgagtgtataattgatcgtatgatctgggagaaaaatcgtgtccccaagaggcacccggacccctccttatataggggaaggggtccgtattacaaagtacagcccatatccctaacggaataggtagttacagataagatacaatcgtaaccgactaggatcctgcgtatttccttgacatacaagtttggaatttaacccgagtccctttgaagatattctatctatacatggcaccccatattcagtcagatatacacgccatgcaggtatggggtatccataatctccaccgtagcccctgagacctttacaggcgacgaaatagtcttctctcgtaattcaaaacgataatccgagtgtttcaacttcttctgccttggtctcccgagtactaaagtcaaagactgtgaagggctgaaaatagaaaaaattaggtgcatcgactagatgcacctaattaggtgtaacccccaactatgtgattagttaaataaaaactaaacatatagtcaaaatgcatcaaaacatccatccgagtggtttctcaaccaaatcacccaagggatcatatagctaagcatatgcggcatctgataaaacatccagccgactgctttagctttaatgcgccaaaaaagaaatatagaagaggcccgagtgagaaacactctaaagctctataaatcaacacacatgataaaaatccgagtaaaaactctaaaaaagatccatcaaatgtggtatgaagcatgataaatgacgagtctaaatagcctaagctatgactcacaccattatcaaggtaagcatataacatgctaagagaatgaccatttaaaatcagtcatctcattaagacccgaatagctttgtagcctaaaaaggccaacaaaattaatataatacttttctgttgggcacctttttatttgcattgtagaaattccaaagaattatctaactgcatcaaaaaggatttgagcagcactgggctattctgtcgtgagcaaattttgccaaagcaaaaacatatgcctaagtccctaaggatcacaaccaaccacgcagacaataaaattgggctgaaggtactgcttaggcccaggcccattagcacctcccgataccctagcgaaaaaaaatgctaaaatagggcgccgtttcgtcttccccgccgcgatcctctccattttccccacttcccgctacagtacaaacactgcgccgacggagactagggttcgcaaatccacaccattccacccttctcgaagcttagtgctcttgcatagatcttccgcacatccaccgcaccaatctcctcttcactcgctgccgtcctcgccccaaatctcatcatccatctcgcaccca

SEQ ID NO: 45007 - DNA, 1501 bp, Oryza sativa
atgtttaaaggtgtcggttctatgtttttccatcgtatggaggtgggaaaagctccgacacctatgagctgttctctatgaaggtttttgtagtagtgagcggtagtgcatctgtgttgctaaccttgagcgcagggttaagccaaacggtatatttgtaaacgaaaaataatttgtgaataaaatttcacaggctgaaaataaacttccatgaaaaaactcctaaaatcaactctaaatttagaattgaaaatttaaattttgactgataaggataagcataagcaaaaaaagataaagctgctagttcagttgtttttgttttagcaggaaagctactgccacactcaactacgctagggttttgatgcaagacacccaaaacaaaaaggagtatcaacgaaactgccgtatgttttttgagtaaaaaactttcagatgtaattatagtataattgtagtgtaattacatatgtggtttactatattgtaactgcaatatactccttccgtcccataatataagggatttaagagggatgtgacacaaagtgtgtccagattcattgtactagattatgtcacatccctccaaaattaagggagtaacttatataaaacttacattcaactaaaatttggttagctagcactgagatcttatgcaacacttgtaaaaatttctttctagcaatttttctcccttcatgcataaatctcgaggtgatccgatggtttcaaatctgaaagttttgggggcaaaacaaacttggtagcacatccaaacataaaaactcatatttttgttaattattaagaaaccacatccttactgtcgggcctcttttccttcttttttttttaatttttttccctccagcccaccacaccatctcagtccaacccaccccttccacctccagaagctagcccagccagccgctactgcctactcctgcttcggttttctgctgttattttctctgataagttgtagctatgataactctaattgtggagattatggataccccatacccgcatggcgtgtatatctgactgggtatggggtgccatgtatcgatagaatatattcaaagggactcgggttaaattccaaacttgtatgtcaaggaaatactcgggatcctaatcggttacgattgtatcttatctgtaactacctattccgttagggatatgggctgtactttgtaatacggaccctttcccctatataaggaggggtccgggtgcctcttggggacacgatttttctcccagatcatacgatcaattatacactcggcggatcaatccccggacaggtgtagggtattacttcttattaagaaggcctgaacctgtataacattccttgtctctaaacctatccacttttccagcttgatagccaccccttttagtaatgccgaaatcttgtttcgacagttgacgcgccaagtaggggtagcgtcaagttcttcgccgactagggcaa

SEQ ID NO: 45008 - DNA, 1501 bp, Oryza sativa
catagttgggggttacacctaattaggtgcatctagtcgatgcacctaattttttctattttcagcccttcacagtctttgactttagtactcgggagaccaaggcagaagaagttgaaacactcggattatcgttttgaattacgagagaagactatttcgtcgcctgtaaaggtctcaggggctacggtggagattatggataccccatacctgcatggcgtgtatatctgactgaatatggggtgccatgtatagatagaatatcttcaaagggactcgggttaaattccaaacttgtatgtcaaggaaatacgcaggatcctagtcggttacgattgtatcttatctgtaactacctattccgttagggatatgggctgtactttgtaatacggaccccttcccctatataaggaggggtccgggtgcctcttggggacacgatttttctcccagatcatacgatcaattatacactcagcggatcaatccccggacaggagtagggtattacttcttattaagaaggcctgaacctgtataaaattccttgtctctaaacccatccacttttctagcttgatagccaccccctcttagtaataccgaaatcttgtttcggcactaataaagacataaataattttttagcttttattactatctctattccaaaatatagcaacttttagctatgaatctggacacacagttatccagatttatagctaaaaatgcttatattttgggatggagggggtatacaatgtatcaactatgcatatgtgtactaactactaatatagaaattgatactgcaaaaatacattacgtttccgatcgacaaaaccgggtgccaagaggcacccaccgtgacctttcttaatttttgtttgacaatttacatgtcttaagacttctctctgagtattgaatgacttaattagacgaaagtctttcaacatggcaattaagtcgacaagttgtcacatgcactagctactggttttgttctcaacgttttcacgaccaataactcctccgcttttactgttaatggcagcatgatgtatcgtagaataaatgtatctattaattttatagtttttttagataataattttatggttatttaaaacatttaaatttgagactcgaatatactgtatcataaaatatggctacattttcaagtttagtctagctatattttgagacaaagatagtatatataacttgtaaatacatcctacaatcatgcattttaatttcaaatttatttctatatgtacaaccagacaagtagcaggtatagtacattatatatgatcgattggattcaacggatccaaagcaatagatcacccctaattacaatagagtactgtaaaagggaaatgtttcatatccacacaacccttctcgtctcgtgtatacaatgtatgtacctattaaaaaaacatcaccaaaaattgtagaaaaagttgtatatgtactt

SEQ ID NO: 45009 - DNA, 1251 bp, Oryza sativa
atttggatcaatggcatataagggaagagccaattttcaatggcatataagggatcagaccaattttcagtggcatataagggattctctcaagtaagagagataattgaattcaaattcaaatttaaatcgggtatgtaaacttttgacttataaactttgggtctataaactttaggtgtataaactttagatgtatagaaatactatatataaataatatttgaattcaaattcaaatttgaatcggatataattcatattcaaatttaaatcggatatgcaaacttttgacttataaactttgggtctataaactttaggtgtatgaactttagatgtatagaaataatatatataatatttgaattcaaattcaaatttgaatcaggtgtataaacttttgacttataaactttgggtctattaaaatttaggtgtatgaactttagatgtatagaaatactatatataaaaaatatttgaatttaaattcaaatttgaatcggatatataaacttataacttataaactttggatctaaactttagatgtgtaaacttgaggtgtacaaactttaggtgcataaatttactaaaataggaaagtaatacggtgcctaaaaaggaaaccacgtggaggagagggggtatcagttgatccgatctctaggggcgatcgatcgccccatagccttttcgagaagatcatggattgacatgtgggccggcccaacttatacaattttgttttactagcaaaagtgcccgtgcgttgcaacgggaagcgtacagataagaaaaatatgcaatcaattaaaatacaaattcgttgaaaatttttggtatttttaagtagatatgtgtataattaaataaatttacaagtaaagaaaatttgagaaataaaataacatggttgaatttaattttattaaattctccatgattagttacgctctttagaattttattggaatttttagagcttaattgctaattttaataatacaaacatcatttaacaattatttaatttgaaaaagaaaaataatccttcattttaggtttgattcgaaataaacacattaagtaactataatagtaaatgctactgaaaaaatgaagtactaaaatgaacttcttctctttttcttcggcctgaggggcctaaaatagacttatttttcggtccttgccggtcggcccacggccttttcctcatgcgcgggcgcacttcccctccccagg

SEQ ID NO: 45010 - DNA, 1501 bp, Oryza sativa
ctatcaacatggtttgattatttaatatttgatttgtgatttataccacagggtttaataattgacttgtactttatttggcctggctttcatgtgcataaatattttatgggattgataataaatatcgtatcgttgtaaatcgtaactattgctcgggtataaatctttagattgattttttttccattgcgtcgatttatggtttggcaagcaataacaaccataacttccagcatgatgcaaagagttttaaaaagttcgaaatttcagtgatttttattgttgggaattttcaagatgttacagctgcccccggccgaaccaaaaaaaggggggcctcccgcgtccatgaaggaggagatcaccctctaacacacgttagggatgaaactggttcggattgtttccgtctgtccgaaccaatttttagattcaaaaaaattcggtcggaactatccaggatttttcggattcggaaacgaattcggatttttttttctcggataccaaaactaatatagtaaggttgatatccgacggaaactatgcgggatttttcatcggatttccggtattttagcaaaagaaagatttttcaacaaaaaaaaaaaagaaacccttaaaaccttagccggccaccttcgcgctgcccactgccggccgccgcgtggccggcgccagatccgcgccgctgctgctgcccgccgctggccgtcgcggggccgagagctgaacacctccgtagggcggcggatccgacccctcctgagggcggcgccaccggatccgccgcctgccgctgccgcccaccgacgccatcgccgcgcatcgtagttgtcgccgcagtcgagcccgccgccgcagcccgtcgtcgtgacccggccacccgaaggccggcgccgccggattcgctcgtcgccgtcagccgcacgtcgtcgcctcgcgccgccgagcccctaccgtcgccgtcgcctcacgacgtcggatcctgcagctccgggaccgccgaccccggatccggccaccccgaggctggtgtcgccgtccgccgcacgccgtcgcctcgcgcagccaagccccagtcgtcaccatcgtctcacgacgtcagattgggccgctccggggccggcaccgtcgaatccgctcgccgccatccgtcgcacgccgtcgcctcgcgccgcggagcccacgacgtcggccaccccaaggctggtgtcgccatgccatccggcgcacgctgtcatgggaggaagggtggcggctgggagagtggtactgtgggagtggccgggtagggttaggtttatatatccctctatctaaatgggccaacgggcctaagaattagctaataagtctgtatgtactcccttaacttcgaattaaattttataatactaaatgaactcatatgaaaaaagttgtcaaaaacaaacttgtagaatttattaagatctaccaattttcttttagtcatttctctatacgagtttgattg

SEQ ID NO: 45011 - DNA, 445 bp, Oryza sativa
acgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggacttaaccaacatagcatttatgggatacatatatatttggctaatcggtggtttagtctatcaaatggctattgaaggattatggctatgtatgcatctatataaataggacagttatatactagaggttctgttgttagatggatttaggatcaatcaaacaattacagtgaattatttgtattattattttattgatggaagctttactttaattatgaacatattttacttgccattacaaattataaaagggctaataattatcca

SEQ ID NO: 45012 - DNA, 1501 bp, Oryza sativa
gatatcaaaaaattccggcaaaaacatcttcaatttttacaatagtagagatagatttatatccaaaagtattttttcataaggcgttaatgttgtggctattgataatatatatactatgtgaataatcaaagtacaatattaaagatagtataaaaagacaacacgctataattttttccgagcgggtatatttgtgttaatttacctttatatatgaacagccaatatgcttagcatacgtgagtagggatgaaaacggatcagatacggtcagaaactagctctatcatattcgttttcacattttttttaaatcggaatcggaatcggaaacccggatatgaaaacgaaatcgaatattgtcggatacagatatggtgcgaatacgaagcgaaacgaataaggtgacgaatattaatcggaacataaaacccctcaaactaagcatcacaactcaaaaaagaaatataacccgttattttttctaatataacatatcaacttttccaaattttagtgttaataattttgttatatccgattttgtggttgagggagaacgattcaatagtttatcgcactcatatgggcgtcttaaggagctgtatgtgaaaataatatttaaaactagtttatcgcactcatatgaacactaaattggatgattctttttcataaatatttctaaaatcatgctctaacgtgttattgtgttcttactgctattattttggccatagtttcttgtgactttgttttatcaatttaaaatttgaatttcaaaaaatagcaacttcagataatattttgaagcagtaaataattttagctgaaaaagtcatgaacataagagttgtagaattcatcaaaagctacaacttttattttggtcatttcttcatccgataaagggatagtaacattgttcacagaatttatatatctctcttacagcttatgaaaccatatgtgtgatatgtacattttgtaaacaatgttactatcgctttgtcggatgaacaaatgactaaaataaaagttatagatcttgatgagttatataactttgttcttgatgactttttcagttgaaatcattcaatatttgaaaatattgtttgaagttatcatattttaaaattcaaattcaaattgtttaaacaaagtaatatatttgaaaaatgacccaaacaaaagttgttgatcttgatgcgttgtacaactttgttgttgacaatttttccatttgaaatcatttactactcgaaaaattatttgaacttcttatattttaaaattcaaaatttatatagttcaatcaaactcgtatagagaaatgactaaaagaaaattggtagatcttaataaattctacaagtttgtttttgacaacttttttcatatgagttcatttagtattataaaatttaattcgaagttaagggagtacatacagacttattagctaattcttaggcccgttggcccatttagatag

SEQ ID NO: 45013 - DNA, 1501 bp, Oryza sativa
gtttttgacaacttttttcatatgagttcatttagtattataaaatttaattcgaagttaagggagtacatacagacttattagctaattcttaggcccgttggcccatttagatagagggatatataaacctaaccctacccggccactcccacagtaccactctcccagccgccacccttcctcccatgacagcgtgcgccggatggcatggcgacaccagccttggggtggccgacgtcgtgggctccgcggcgcgaggcgacggcgtgcgacggatggcggcgagcggattcgacggtgccggccccggagcggcccaatctgacgtcgtgagacgatggtgacgactggggcttggctgcgcgaggcgacggcgtgcggcggacggcgacaccagcctcggggtggccggatccggggtcggcggtcccggagctgcaggatccgacgtcgtgaggcgacggcgacggtaggggctcggcggcgcgaggcgacgacgtgcggctgacggcgacgagcgaatccggcggcgccggccttcgggtggccgggtcacgacgacgggctgcggcggcgggctcgactgcggcgacaactacgatgcgcggcgatggcgtcggtgggcggcagcggcaggcggcggatccggtggcgccgccctcaggaggggtcggatccgccgccctacggaggtgttcagctctcggccccgcgacggccagcggcgggcagcagcagcggcgcggatctggcgccggccacgcggcggccggcagtgggcagcgcgaaggtggccggctaaggttttaagggtttcttttttttttttgttgaaaaatctttcttttgctaaaataccggaaatccgatgaaaaatcccgcatagtttccgtcggatatcaaccttactatattagttttggtatccgagaaaaaaaaatccgaattcgtttccgaatccgaaaaatcctggatagttccgaccgaatttttttgaatctaaaaattggttcggacagacggaaacaatccgaaccagtttcatccctaacgtgtgttagagggtgatctcctccttcatggacgcgggaggcccccctttttttggttcggccgggggcagctgtaacatcttgaaaattcccaacaataaaaatcactgaaatttcgaactttttaaaactctttgcatcatgctggaagttatggttgttattgcttgccaaaccataaatcgacgcaatggaaaaaaaatcaatctaaagatttatacccgagcaatagttacgatttacaacgatacgatatttattatcaatcccataaaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcac

SEQ ID NO: 45014 - DNA, 846 bp, Oryza sativa
tatagacctagcggattagatagccgagcggaggcagtatccctgcatagatggttcacccctgagtgaggcaggtgcgctatgatgggacagccgttgaggtagggccgagaggcgtgccctacatcggtgtcgccattggtaggactgccatgagtgtgtgagagagagaacttaacttgaaccataatttaatatgtgtgagacttctctttcccggaagcgccagaactcctcacactgctagaaacatggacgcctagagtgcatgaggatttaagttcatggagcgggtactgccagtgcaagcttatctaaaagctttgccgtgacgtgtctcatgtgttgggacgaggctcatgtgttgggcagtcacggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacattctgagaggagggaaggtggacatcctcagaaaaccatgacgattcaatggcgggaagctatccttgggatcacaatggatggtggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttagg

SEQ ID NO: 45015 - DNA, 409 bp, Oryza sativa
gttgtctttttatactatctttaatattgtactttgattattcacatagtatatatattatcaatagccccaacattaacgccttatgaaaaaatacttttggatataaatctatctctactattgtaaaaattgaagatgtttttgccggtattttttgtatatcatctatgtatgagtcggtttttaagttcgtttgcttttgaaaatacatatccgtatttgagtcggtttttaacatcgtttacttttggtaatacagaaggaaccatataagaaatttgtttaaaaaaactcgcatgctaacttgagacgaccggactcttaagtgctgctcatgattttatatatatatatatatatatatatatatatatatatatatatatatatatatatatatgaaaaa

SEQ ID NO: 45016 - DNA, 1501 bp, Oryza sativa
cgagcgatcaattattttcagcaattagatatattttgaggaaaaccttaaaccgtcaaactaagaaaaaataaagcacctaatcattagttttcactcgtatactaaaaattagaaacgcaaagtccccttcacattctgctcccctcacatgtgcacatcacgatccacagttgacccatgcactttgcatgtcatccaaatagcaatgaaatacgagaaaaaaaattgccagcatatattatatcattataagtcactctataaacatatatagctaaactaaatcaatagtaaccaaacaaatcatagaagcatgtaatacattacattccaatataatgatgcatgcacagttagatatatttagttgtacgattgtgtttacgatcggtgcgtgaagccccgcatactctacatgatacattcatagatgtgtttcacagcacggaatcttattgaagaaatccataccatccaattcatgtgtttattgttaataaagaatgaggacccacatcagtcttaactacttaatatatcaccaagggtgattgaaattttctcaaagttgagatgaaaggtgtaatgctctatcattattcataatatcacaaattttgaacttatatttgcagttgtattaaataaaatagaaaaatattattagagagtaaatctaaccaattggagaaaaaagttagaaaattttgcttcttacatttcacttagattgaaaaggctactgccataacaattgcgttagataattgaaacaactaactaataggttagaaattttacctaagcaatgctgagaagaaaatttatggagaaattatacttttgaagcatgccagatattctttgattagtattccgcactcataagtgtctcaaccgtagcctatgatgcccgcccgcgcgaatgcgcgggctaacttcctagttttattaataagctattagtttagttataaataaattgaagctagtagttggctatactatactactataaaatgaaatcaaatgaagtttcataaatacactggcagacttaatataataaaatatatgctcatgaatggcatgcacgcagaaaaccgacaccgttgcatggagatgcatgcaaagagacacaagaaacacgttgtcatggatctcggtgcatccgatccacaatcgtaggcgttgtctgactttgatcacgcatgaacgccacgtaacgcaacggatatgcctcgctgcagccgtagaatataccacatgaaatcacgagcagtcaagctcgcatgtgatgtgcaacccggcccccctgcagctcatcgatcgatcttacacgtggtagctatccatcgattaatttcatcgtctcatctctcgccgcctgtatatataaagaggcctcactctcagctactccactcaggcactcatcgagctacattttgctaactatccagtaccaagaacggagctgcaaggaagagacgtacga

SEQ ID NO: 45017 - DNA, 1501 bp, Oryza sativa
tggtttggcttgcgagcttaacgagctagctcaagcttttaaacgagccgagccgatgtctgtggagtgatatatttcatattaatctactttgtcgattttttgaattgttttcataatcatttagttgatatgtaaaatccgggtggacattcatccaagtaattaaaatccatctccacatgtggggctcattttttttcttccatttgaatattctaacatggaaactagacatagattgatagtaatacatcacaactttcacaacatccaatctgcacaatcagcatgaggaagacgtcatacccaagactatcttcattaaagccaaaaaaaacctctctaaggtgaggacacatgttcttttccagttttaaataaatcctttttcaaatctataaattattttttaacttcaaaaattcataattttctatccatgactctgatctactccgttcaagtctttattttttctgaattgagatctaccaaatggccctagtagttatattaataataatattttctttttaggagtttatttggttttttctgttttgcgcatagttgacaccgacggaatttattttggatgaggatttttgaagattttgaagatgaggacagaagtaagttaccatgtgatcatattgcttctactttccaaaatggtttctttgcgaaattacattgctagtgcgtatgttaatttgactggcctttgttcatgtgacaaatcaacagatgtacccaatatatgcattactactgtaggatgttgataaccccaaccctttgtcgctttcaggcgtagtaccaatggtcccactcacaccaaatttgtttgtcgatgcgggaaaatgggttgtgaaaccattttaaaatccaacacgtagtgtttgcatgttcgcaaaataaaagtggtttgcgaaaacttgcgatataaagcgagaccctttgtactcgcatatatggaccgattccaaggattggtataagaaagagagtctcatcctaaatctcagagtctctactttactattagattatacaacctcgtcagactactctgtagcaaggctgtaggggttgtataatactccatccgcttttatatttcttgacgttttggacaagattgaggtcaaacaattgtaactttgattattaataactttaaaagtattttctttaaaggaactagaacagcacatatagatttgtccttcaaagtaatataagaaaagtaaacatgcactatatattataataaaaacatagtaaaagatatattttggtgaccgtatcattgtcgaaaatgtcaagaattatggaaccagagtgagtacattattaagcatgaagctttactagagatcaaggtagaagaagggtaagaaacgtcaaaatatgtttgcgcttgtatactgaagtgtaaagaaaataatttcttgcatcttggaacaatgctgtgtcagctactaagttagacagg

SEQ ID NO: 45018 - DNA, 442 bp, Oryza sativa
agttgattccacttttactaaactagcaatgtggtatgaaacatacatacacagcttacatgcatgtaccacacatttctaattcaaattgggccgtgatgtcacactgtcctaatcgatctcttaacttttgcccgatgttataattaggaactgaagacttgacgaagtcacgcgaggatcatttccgaccttgcacactgaccctcgtttgtacctcagttctattaattaaggggcaaaacgtacagtatagtgctagggtataagtttcgcctcgttctttttaatcactagctctattagatttttatggacacgcttccattttctgaacacggtacgtaccgttgaatccaacttcttaactagttaattaaaaaatttgcaactttccgttcgtcacatcaattattttttatttgtaagtgcgaccgagcga

SEQ ID NO: 45019 - DNA, 313 bp, Oryza sativa
agttttagttggcatattaattaattaaccaatcacgattaaccatcgtgagcttccattaaatatccataagtgatagtgaagcatgatttatcccattagtgagctattgtttctaagcacggctaagcatctattataagcatctagctgaaccaaaccaatatataaggttctagctaatcaaattataacccataggtaaataaagtcatcttcggccataattaaatgggaaaggctcaccacccggtgacattcgaaaataaatgcacaattaaaataaatagagaatttaaatgtaggatcaaca

SEQ ID NO: 45020 - DNA, 998 bp, Oryza sativa
ggttgattgatatgcagttctacacatgttaggctagaatgggattggttgcatcctgacctgatggccgatacactactcctaaagaagcagatcgttcttcttttgacctttatcgatagatattagcttagctagcatattatatctctccatataaatacgtaagtatataatcatagaaagctctacatgacaccaaaatagtgtaaattggttttaattaaacatgtgtctgccccgcaaaaaaaaattaaacatgtgtctgagtaatattgttttgaggtgaaatattagagtgaaacatattaggatacccatgtctgggttttgtagttggttattattggtatttgttacagttaccaataaatccaagtgtatgaataccgctgcaacactccacctaacagtatttcaaggatatcgaataatagatgtgtatatctacaaacatgattctaccatacaaatggtaggcttaaactagaggggattcctatgaattaattaactaagcttaaactaaataaaaatctatcaattggtgtccagttcatccctggtctaccaagagatctatgtaagtaaacgtggggatagaagggatgatggacatggttgtcacacctgctgtctatcatactttccgtggagagtcacgtagatattaatttaagtgcctacctcactataaatttggcgtctatgtggcaccttctgtctgccgtacttactttccgttgagagccacgtagctattaatttaactgcctacctcactataaatttggcgtctatgtgacattgttcatcgtgctatatgtctatgagagaatatgattagaaaaataaataaaagaactcaacagaacccacatgttatgattagcttaaataaaaataatattgtagaacctagtaggccagcggcagagggtaatcgatcacttgagcaccgccgtgggatgttgcttccccattatcgcaccactagc

SEQ ID NO: 45021 - DNA, 235 bp, Oryza sativa
tttagccacagtacgcgtgcgttgtgttcgtctggtttcctgctagcgatcgctggggaaattcctaacaattggtatcagagcacggtttaggaagtggactcgtgaccgcgcattggaaggcgtcttcttgccgcgtcgtcgctcgtcgtcaccgatcgtgcacactcctcatgactccggcggccgcgccacgggcagcggcgggggtgaccgcgggctggtgatccaccgc

SEQ ID NO: 45022 - DNA, 1501 bp, Oryza sativa
tgtgggtgtgtcttgttgagtacggtggttgtactcagtcttgcttaatttttcccaaacccagaagaggagcccctggatgatgaaggctttggtgtttagctcgtgcttgccgtcaaacgcctgtggtcgtcgccctagtcttccgctgtttcccgtttgtctttgtgtgagctgggccttcgccgcccatgtaataattaactatttacgcttccgcttgttaaactctgaattgtatcaacttttggtgtaccttgcctcctgggacaaggaataatacacgcacgtaaggaacgcccgttgggttatttccggtcgtgacattttagaaggactggatctatgtcaaaatcgcgtgcacaagggcgtctcgggaccaatcagacatgcgaaaaattgtgcgcaaggacgttgtgggcccaatcgtggaagcgcgcaaaggcgcgtatgaaaaatgggcttaatcgctggcctgatcgctgcatgtggcaaggggcacatggaaacgtgcaagcccaaataattcacgcacgtctcagataagagggacactttggcgtaagaaaaaagaaaaaggttttgacagaaacataaaattaaaaacaaaacataaaaattaaaacgattcaaacacgatgacgtgccgaaattccggtgaaaacatcttcaatttttataatagtagattgaagttttaaaatttttataaaatatctataagatggtaatatgaaaccattgtaaaaaaagagaataaaatattttctctcactattaccaatccttgaactcaggatctcttggacaaatcatttttgtcttcaataaactaaccaacttaacccgtgtcattaattgtatatttgtgccttgagtattgtttaacaaacttaccaaattattttgcaaaaaatgtattatttaacagtttgaaaagcgtgctaatgaaaaacaaggaagttgatgtttggtgttgaagaaaagaacagagcctcagaaatatctctacagagttttaaatatttgattaaaatgcctttacatattgttgacggtcgttatcgatcagtttcgatcgtcaatattaccaaaatagaagagaactagtgatgcttgcaatgcataaatatgttagaataataatattccactagtattaggtatactaaccttttgcagagaatgacactaaagtggaggagaatcgacatcaacatggaagataaatcagtctgacgatgtcgagaatcagacttatgcatgaatgggccaagaactcagaattaacacgtcaaactgggccaaaattcataagtctacaaaaaggagcaacagaggtggccgccagccgaaaggtgggctggttgggccggcccctagttcgaccgaacctccctcgcctccgttggatccaggttttggctggacggttgagatgaagccccaatgacggttggagggtattaccgaccattccaaccgtcacaaccgtcatagt

SEQ ID NO: 45023 - DNA, 687 bp, Oryza sativa
aaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgcatatatataaacatgagcagagggccatggcaacgagcacagtgaacttgaagagtggaaaatcataaatacatataggaggagaacttaattatcttcttaataa

SEQ ID NO: 45024 - DNA, 1501 bp, Oryza sativa; identical to SEQ ID NO: 21280

SEQ ID NO: 45025 - DNA, 1020 bp, Oryza sativa
ccccttcagtaagaaaagatttggagaagaagtcttaggtggagtcttggcttataccccagttgagcgcctgtgaagatgaagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagaggataaaacctaaggacatattttataaataaaactatttgcgaaagttcctttttctcctccccctaatgctatttgcaaaaggtttactcccttcttccttcttcggatttcaactagtactagatggtcagctttgcgaagaagaagatgtcgtcaattgtctgccgaagctccggaagaccgcagggtccgctagcgaagtggaggaagcagtgaagccagctgtgtagaagcagtgaaaatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcatcaagaagagttagttcctttaaggtcctgtccctagttctggtctattctttcctggcttgtttcctctctcacctcaatccctgtaacagatgtttaacagagaaaaaggaaagaatgtcagcgggtatgcctccagtaactcaagttttcaactcaatccaccactagcctcaagagagttaacaagggcacacccttggtccattccaagcatgctgcttagtccacagctaccattggttggaagtcaagaccaaaatcagtatgtgtttgatcgagcatttg

SEQ ID NO: 45026 - DNA, 1212 bp, Oryza sativa
gaagcatgatgaatctattcaagactatattcagagattcagagatatgaggaacagatgctatagtttgtccttttcagattctcaattagccgatctggctttccagggtttattgcatccgatcagagaaaatttttcggctcaggacttcgaaagcttggctcatctggcccagaaagttggagtgcatgaacaacggttttaggaagctaagaagattgtcaaaaagatgaatagtgtttattcttacaattatgcttctgattccgattatgaagatgagtccgaagtagcagcagccgaatggatcagaaacaaaaggttactacatgtctgtgggtgaagccatcttccaaggaggagaaatatgattttgatatcaccaaggcagataaaatctttgatatgctacttcgggagaaacaaattcaattgcctgcaaatcatgttattccatcggctgaggaactaggcaaaaggaaatactgcaaatggcataatactggatctcatactactaatgagtgcaagctgttctgacaacaaatctagttggctatacaagatggtaagatcaagtttgataactccaagaggctgatgaaaattgagcgtaatccttttcaagtaaacatggttcatacaactgggaagacagccgataagaaggattatcggtccaagcaactcaattctgcaaggattatcaacaaatatcagaagagacatgatcggcatgaagagaaattttatgaagatgatgatagctttgacccccactggagttgtgaatttttcagattttgctggaatgaaggtatgaggctgccatctatcgaagattgtcctggggcagcaatattgtagaaagttcgagccaatcttacaatagaagcaatcggctgaggcaaacaagggttcctgttcatcaaagattgggcccagtgaaccaagatcgtgaccaagaggacgatgagggcaggaaaactcaatggtgtccttctagtatttttacaaagaatcagaagagaagggttcaaaggttgaggaacagggagcactttcaggaggttgagcaagagatcaaccatcggctgcagaagacaaagccgaggtaggagtggcgtgttaagaatctagctgctgtagccgatgaacccaaagccaatgaagcaaaaagattggctaaggggaagagtgttgtgactg

SEQ ID NO: 45027 - DNA, 435 bp, Oryza sativa
ccttcttttgttccggtgttagtttgtctatagtgacagaaacgatgtttccctcatggacttcaaacccactaggctttgggatattagtcttggaagggacctccgacttgccacccgaagacggtgacggtggtggtttttcagccatgagagaatgttgttgcaactctaacttctaatcagtcccactgggcgtgccaaaagcgtgttaatgtaaaaacacgaggcctgggagatctacttaactccagtgcaggtccaaaagcttgcctttaggtgtatgagcgtgccagttgatttgatcctgcaatcaacaagaaataaagacaaagaaaccgcggttaaatccataaacgatagccgatcggctagttgccgatgacgtatcatttatctttgagccgatgtcatgtgtagatcgatcggcagtca

SEQ ID NO: 45028 - DNA, 240 bp, Oryza sativa
ctttttagggtttttgtttttataaaccctttttaactttgtttatttcttaataattattatttgtgctctgaaaattccactaaaatttgagggctccttttagaccaaggagaatttaacaaaaattctccgggccacatttgaatttttcttgtacgtattttaatgtttgccaatttcttttcgaattttaattaattctagtattccttttagaaaatgatttttaattcggga

SEQ ID NO: 45029 - DNA, 1501 bp, Oryza sativa
gcctgaatttcactagatcgcgtctttttgaaatgatatcttaggttgtttgcatgacatgggtactactagattgctaccaggttaactggttaagtctattattgatatgaaggattatttcagtcagacttacaaactgaaagatttccaaacttgtcagtgacttacaaaaatgtgcaaatgtatctgttgtcttccattaatccaagtatatttctccctggggcactgttgatattttacgcaatcttgcaagtatcaactggacatgacaggccatccctcctaaataaagttacctcatttgtttctcatcaatgggatatgcatcaagtgtctaaagatggcattgtcttggagaagaattctgatgggggtaaccgattgcatttccccctccagttttgaaattatatttttgctatcacctatttactactttttaatttttgttttcagtgctaattttataatcaatgtaagtattttattgcaaaattgaaagatcggatcatcggaggaatgttccgctttggtgtatgaacatgttacagttgtattgaacaagcaattaggtgagcaaggcgaaattagagcgaagaagaacctgttggcaccatggctaagggcctccttcactggaaattctgagcatgcttggtcctgcaatcctgctgatgaaaacagtcgaaatctatatgtaaccctacctccccaccatttgcaatgccctacttgtagattgtatcagctgataccatcaatgccactgtaggtgattattgatacctgactcgctgtctcattttgcaaagatgatccagagatttgaaaaaaaaacgtttaagtaaggcaatgcatcagattagcacatcatgtcaccatactggttgcgcggcgtggcgccgcgcatgttcccttctatttaaccaataaatacatgattcatttgcttctccatgcttaagttctttgaaattagtatagattaattgataatacgaaatgatggctctaactcccattttgccttctgatatgatcagtaacctatatgatgaaacatgggttatgaggttatctagcttgttcagaatgaatcaaataacttctgtgatttttttcaatataggatcttcacgaagaaattgcttttgtatcttgctcttcatgaatgaattacttttatgacttgttcttcatgaatgaatcttgacaatgaaaaaatatttgattctgcagatgcacgcctctttctgggatctatagagttctttcggggttctatagagttctttcgggatttctggtgggcatcaagcaattttttacgtgatcaagagattactcttttcctgctgaatattaaagcaaaggtttgttcacatctttttttttttaccgaagtttttcagatccattatttgattaatccaatttgatattcaatttttttcctcaagggatgactgacttctcaattttttgtttactcagt

SEQ ID NO: 45030 - DNA, 1501 bp, Oryza sativa
ggaattgtccgaaataccctccaaccgtcattggggtgcaatcttgtacgtccatgccaaaccctagcctcaacggtggagatgggggttcggccgaaccatgggctggcccaaaccagcccatcttcggctggcgacttcctctattgctccactccacagacttgtgaattttggcccaatccatcgtgtcaattctgagttcttggcccattcatgcataagtctggttctcgacatcgtcgattgatttatcgtttgtgttgatgttgattctccaccactttattgtcattctctgcaaaaggttagtaaacctaatactagtggaatattattattctaacaaacatatgcattgcaagcatcactatttctcctctattttggtaatattgatggtcgaaactgatcgataacgaccgtcaacagacgacacacctcgaaccctaccctctatgctcaggagtacctagtgccgtacttagcacatctttctccctcttaggcttgaaagatcctttcttctgtgcactggataaattctctcttttatcggcaacgccctgcagcttcggatcttcaaacgatactttgcctttatccgtgatcttaggagttccagctcttacccagttcctagatctctatgaccattcctccattggtaccggaaggcccgccttccttatttcgtcctcctcttttgtccactgtgtcagggttatggatatcacatacctaatagtagttgactaaatctcggcaggacttaccacataccatgtcttatacggaaactaacctcggatatggatggagttccagataaggaaagacaaccagagttccacatggaaatgacaaggactacttggattgtatccatattagtttccctagttctacttagaaaaggggacacctatgggtataaatacaaggcccctaggaggagaggagagacaatcaacatacacggacatacacggaataatagatcaagatacgagatcaacatacaaggtaacatatgccaagacaagccgccggatatcgacttcagagataggtatggctagtcccctacggtgtctccggatactgtcaggagagacatagcgctgtctctgatctcgctgggcacggattcgaggaggaagactaccctgttgtcaactatgagtcagatcttcagaccgccatgtcgacaacagttagataggctaccccaaatattgtactggtgtgattatggcgaataagagcaacaaccggcttcggccaacaggatgtagggctattacctgacaatccaggggcccgaacctgtataaaaatccttgtctccatctcttttacctcagtctcgcttatatcctagtaccaacgatcctcatactatgtaaataccggaatcgcgacatcaaacgtcgacagtggcgcgccaggtaggggatcttttggtgcttcaaggtttcgacgagatgggtttaagaga

SEQ ID NO: 45031 - DNA, 1501 bp, Oryza sativa
agcaagttcttttctcttctcagaattcctgaaagctgaaacatgaacttctccttatccttgtcaatctcctttgggtcatatgtcgatatcaactttggaattatacgacgaggttccaaaggattagacttcggttcggatgtagtaccttccggtatgtgcacttgttctaccagagcagattggggtgtaggtggagatgcttgaactaagggcggagtcgggggagcatgctgttgagctggggaggtgggagaggcttgaactggttgtggagccgggagagcaggctgttgagaatgggagggtggtggtgtaggttggtaagccgatgacctaagcggtggtggtgtaggttggcaagccggtgacctaaacggtagtggtgatgccagatttggaggtgatggtggtccaggaggcgacggtgaagcagaagcggcaactgtccttgcttgtgatgaggatggagttgaagatcctgctgctggaacggccgcggtcaggattatgtctctgcggtgccacaacataaactgattcactgcatcaccgagaagttcaatcctctcaggtgcaggtatgtctagttccaaggaaatgtggtctctatggaccttggcgacctgtacccttgcgtaatcctcagggattaccgtgttgtgtaattgacatccgggtatcgctaaaccagttgcaacctccttagtctttctagcgcggccgataggtacgacgagactgcacggagttggtccagttataccatccatagggaagggagttgtctccactgatcctacactactgggtgcattagttgtttgctgtgtggattgtgtgggttgctggccatcagggaataaccttggaaaggctgtcgggtttttagctaccaacgagtagaagtgttccttcacttgcgcatagattttgtatgatagttgttctttgtatttgtctctcttcttataacttggtgcgtcatgtggaaagcctatcttccaacttggctttgaggacaaaccccttacacgtccagagtgttcggcggtccccaacgccacagtaagctggtctcgctccctccgtgggacaaactgtcctgctctttctttctcgacgatctgctgcaaattagtagtcacttgttctatgtccggagtctcgaatagtatgtctccctcatccgagacttgacctgtgctgcgcgcccaaacccagttcttactacgttccaccatggggtctaccagtagtggtttgccggccgctgcaaatctttgctcggtctcccgccattgatcgacgtgcccagcgtatccacttgaccccaatctatggggatatctatttttcttcgcgagctcggacatttttttcctcaaagccaatgcttcagctgttgtatgatctgcaacaaacgtatcccagtcaggctgcgatatatgtccatattccgtgaacggagggagattcttctgagtatgaacggagg

SEQ ID NO: 45032 - DNA, 668 bp, Oryza sativa
acttttttaccctgaattcattcgtgatatgttgtgattcggctttatgtgtgtacccaactattgatctagggattggtactgataaacacaaaagatttccgatttccaaaatcgtgggtcgacaaataagagcccagaagtcttcactcattaaaagcagctgacatgggcgcccttcatgtcaggcagcaagatttgacaggccccatcatcaagatgacgtgcgcttgctttccaagtcaagagacaagacaggcatttaatgcaaaacacttcttcatcggagctaggtttttgggcccatgtggtaaccccttgaggtattaaaggaggtccaggccaagtaaaaggggggagggatcgaggacgatccatttgacgctctagagcagtctctagccccggatgatcaacaccacattttactccaacaaggagatcttgtaatccttcactcaaggagcatagcacagaagtatggtattacgcttcttagcggcccgaacctgtataaatcccttgtgtctcttttatctcgaaaacctcggatctcacctgctgccctcggccaaaccgaaaaagggggatctcatgatctcccgctagagaggatcacctctcgatagttggcgcgccaggtaggggcgcgttcgttatttttgagg

SEQ ID NO: 45033 - DNA, 1501 bp, Oryza sativa
tattttattgtgacttgatttgtcatcaaatgttctttatgcatgacataaatattttcatatttgcacaaaaaatttgaataaaatgaatggtcaaacgttggttgaaaagtcaacgacgtcaatatatatggagggagtagtttttaagctaaatggaactataaattaatatttggtcaataatagctaatgtgtttttaatagttgctttgattaagccatgcttgtgggttcagctgtgcgcggcgtggcgccgcgcgtccttctatataccagggtttcaaaaaccgctgggggcccggttaccgccacccggcggtacggcggttaccggcggtaaccgcggtaaccgcgcaaaaccgcgacaaattttcaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcctatttttttttctttttccaatttttaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgtgcggtacgggtaaccgtacccccgcggtacgggcggtaaccgcggtaaccgcgcggttaccggcggtttttcacaccctactatatactaacactatatacaaccattacaatatattattgcaccgtaggagttataattcgttcgaatcatgtgcggtatgtgtatgtactgctgatggaatatactccatccatcctataatataaggattttgaagatttgtgacatattttagattcatggttctagaaagtgtcacgtctctccaaaatctgtcacgtctttccaaaatctcttatattttaggacggagggagtactaaaaatttcttgtattttgggacggaaggatcagctacacgaataaaaaccaaatagtgagtccggttgccccaaacggcttagatgaatagatgcgctacggtatatggtctcatcttttcgcttatacttattagctaaaatttaaatttttaattttaaatttaaagttgattttggggttcttttatcaaagtttatttttaacatttgcttttacatcgctaagaacatgtatataaaagttttattcacaaattattttccgtttgtaaatatgtcgttttggccgtctcggacccttttactttccgtttcgctttagtttcctgtcgctgtgggcacgcttgggacccttttaccctccgtttcgtcagccttcttttccttgggaaacgtcagtatgtattggtgaaaccattgactgactgtatattaatatacagtcgccgggccggccggcgtagggg

SEQ ID NO: 45034 - DNA, 239 bp, Oryza sativa
gggggagggccacgtggaattggggcgcaacctcctccctttaaacatgatacccccgggcccatatcaccgacatggaccaactataaacataagcaccgctttatttgaactgtccccaccctccgctcctgacgacgatgccgttgccccctttcctcccgccgccggccatccgcctccatcccggtcatgggcaacccttacttcgacctctccccgtaatccacccgtaacga

SEQ ID NO: 45035 - DNA, 1501 bp, Oryza sativa
aattgaaatttttgttgctaaccataagcataagcgaaaagatgagacttcaagcataaaaataaaataaaatttaatgttaggtttaatgtaactaatctggtgttataagaattgctacatctccctataattttgatcaaatatataagagtttaactcagagaaaaaactcaaaacatattataagacataaaatgaatcggtattgtaatcatcaaaaggaaaaagtaaggtgatatgattttataagagaagaaaaggagggagataattttgaccgtagatctattatctatgggttaaaaacaattaaggcgatgtagcttaacgagagaagagagaaaaatcgtttaactacttagtgcggataaactttatggatatacagaataggatttgctatgttttgctatgtgatagtcaaacatggtgtttggtgaaggacgaggagagctacaaattggacgtccgatgttgtaaaaacatcggatggtcaaatgtttcagttgaccattggtgcaacattaagttatacatgatgaaaacaaaaaaaactctgaaacatacataaattttgtgaaatacaatgagaacacattgtgaaacgtatcgttatcacgtatgaaacattaagtttttattgtttgaaacatatatttttctttcatcataatataatcattgatatcttgttgcaaagattcaataataacgaaatcaaccgcggggcggggaggggggggtgagcgtcccatactttttcggttatacgtggtgaaatagaaaaatatgttattgaaacatttaatttttttatgaaacataaagaaaacccatgttgaaaatattgctaccgcatctgaaacatttaattttaacagattgaaacatatgtttttctttcatcggaatgtaatgatgtgatatcttgttgtaaatatttaattataacaaatataatggtgtgatcatatcatagattggataagtagttcaaaagaaaaattattttgaagatcattatagcatttatggatgtgtatagtggatagggaggaagtaatttgcctgtccgattttttctgcgtcatacgtatgataccaagcatttccggtgaaggacacacgaaaaatgtaattacgcccatggattcccaaaaaatgtcattctttgccacagaactccacctataatactttgtcatatgagttttatttttactcctcatccctttttttatagtagaaatgaaaattatggggagttcatgtggaattaaattttagggttgatttgatccatgccattgcaaaagtgagtcattgtatttcgtctatttgtaatcgtgccactcaaattttacaaaattcgaaccatgcaatcgtcgtcatgttttccatcttcttccccatctgcacgtggggcacacccatcatattcatcttcttcctccatcctcccctcttctctttgtttctctctccaccacttcttagt

SEQ ID NO: 45036 - DNA, 1501 bp, Oryza sativa
aattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacagcaaagcttttcgataacctcgcattggcagtacccgctccatgaacttaaatcctcatgcactctaggcgtacacggtttctagcagtgagaggagttctggcgcacccgggaaggaaagactcacacatgcattaagttgtaattatgtttaaattctcacatggtagtcctactgatggcgacaccactgtagacacccgcctcgcggttctaccaatggctgccccaccgtagagcccctacctcacacatcaagaaaccactatgcatggatactgcctccgctcagctatctattccgctaggtctatacccatacgagaagtgcggttgtacgggggtcgtttcatgcttaacttcatggctcggtccttaattgaccagggacggtactagccttttccggacaccacccaagtcctccagccgccccagtcgaaaacagttgttttactttattttcctttcacaaatcatgtcatcaatatcatggcaatgtggcgctcatgtctccacatgccgcatctcaattaccttcccaaaggtaattgcccaagcatatagcatttgataaatatgagtatgcatgaatctaaaatagcattcctaagcaagtgtcatagttgactagggactcgtacgtatctatggttacaaagatttaaaggtgaacaataatcaaggcatggtataatcaccagtaggatgttcatcattgcatgcaagtttatttgtaaacaaaacaatttcgcaattgggatcaacatgttcaaggaatagtgatgacttgccttgctcaggatagtccttattcttgatgtaattcttgatcaaccttcacctcctggaagttgctgacgttgcctcacgactaaccgatacacaaggtctataatacgcgagaaaaaccaatattcaaacaacaatcaaatatgcgcaacaaaatgtactattcgtgtttgctaatggattccaatcttgctaaggtttcttaatctttctattgtcaacgtggcctatttaggagttaaccaacatagcatttataggatacatatatatttggctaatcggtggtttagtctatcaaatggctatggaaggattatggctaggcatgcatttatctacatagcacggttatacactagaggttctgttgccggatggattttggatcggccaaataattactgtgaatcatttgtattattattttattaatggaggctttattttaattatgtacatatttcacttgtcaaaataaattgtaaaaggttaacaattaccca

SEQ ID NO: 45037 - DNA, 1501 bp, Oryza sativa
caatatgtttcacactaaagcacgagtattatttgactgataaaccctaatgttttgttttttttcttcgtaatcctagtttgattgtaaaaaaaacatattgagaatttcttagtaaattttacaacaaagcacgggaaagcgtgaggaatcacctagttatactatagttatactagtttcattgtttgtcgaaccacagtgaagaagaatctattgattaatagcaccgggcttgaaatcggtgcatttatacgcactcatgtgactgctgcaagcctgcaacggacaataattaaaatgaatgaaaaaaacgaacggtacggagtttacttactgttactggattataacaagctggtctgacattgcgcttattcttctccgtatcgtcattgactttgtctacaactagttattgtacttgcatcctataaccacttactccggagcaagattattgcaacaagtacttgtcaggcccaacttgcctttgtaatgtccagaatcttgataaatttattccgtatatatagcgcccctacgccggccggcccggcgactgtatattaatatacagtcagtcaatggtttcaccaatacatactgacgtttcccaaggaaaagaaggctgacgaaacggagggtaaaagggtcccaagcgtgcccacagcgacaggaaactaaagcgaaacggaaagtaaaagggtccgagacggccaaaacgacatatttacaaacggaaaataatttgtgaataaaacttttatatacatgttcttagcgatgtaaaagcaaatgttaaaaataaactttgataaaagaaccccaaaatcaactttaaatttaaaattaaaaatttaaattttagctaataagtataagcgaaaagatgagaccatataccgtagcgcatctattcatctaagccgtttggggcaaccggactcactatttggtttttattcgtgtagctgatccttccgtcccaaaatacaagaaatttttagtactccctccgtcctaaaatataagagattttggaaagacgtgacagattttggagagacgtgacactttctagaaccatgaatctaaaatatgtcacaaatcttcaaaatccttatattataggatggatggagtatattccatcagcagtacatacacataccgcacatgattcgaacgaattataactcctacggtgcaataatatattgtaatggttgtatatagtgttagtatatagtagggtgtgaaaaaccgccggtaaccgcgcggttaccgcggttaccgcccgtaccgcgggggtacggttacccgtaccgcacggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaattta

SEQ ID NO: 45038 - DNA, 1501 bp, Oryza sativa
aaaatttgatcagtctatgctaggttttaggcttgtgaaaagaattgtaaaattagctttatgcaaaagaacctgaagccattccttgaaataccctctatcatatgcattgttattgtggtggcttgctgagtacggttggtactcacccttgctattcatatatcttttaggagagtgttgaagagaagcccttgtcggtacgcttgcgtatccaacaggatgatcggagtgcggtcttgttctaggtctcgttccccagtcgactgcctgtggcatgttaaccgggcccttatattatgttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtttacatccatgcttccagggcacatcgctaccaattcccctagtccggccaggatgtcctttggttccgagcgcctttgtgaggatgtcatcttcacgcctctttggcgtggactcaacatcgctttgtgaagcttgttcagcaaccaagcccaactagaaaaaaaaagagtcgtttatacgaacttctactttatacgaacggaaattagttaggttaagtagtgaactcaccagttcctgatagacgacagcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctacttgccgatgtaccatgcagtgcctagccgatgcgggtgctcattccgctgttgcagtaggcgatgtgcctcgcttgattccctaaactcttgggtgttcttgagagagcagaattcctcccacaccgcttcggttatttgagggtattcatcgaatggcgtatgattgccgggcgggttgacaaactcggtgaagagcttcgacttccaattcttccaacctttgcccatcttatggaatgccttccacttgagataatctatgtgtaaaaaaatgaatatggggcacaggggtagcagcagcaacagtaattcatcaaaaaagaacaagtgtacataaaaaaaagaacaagtgtagataatctgttcttatgcattaaaaaaagaacaagtttagaggtatttctgttctcgagcattcatcactggccatttaacataaggcaaccataggcagcagcatgagcaaacatagacagcaaggcatccaaaaaaaagcaaacatagacagcaaggcatctgaggtatttctaaaacagcagcagcaagggtatataaatcatgtatataaacaacaattcatgcaattcacctattcatagacaaca

SEQ ID NO: 45039 - DNA, 1501 bp, Oryza sativa
tgtcttcatttcgatgtcgtgtggcttcgttcttgtcaggattgttgtcaagttatatgctttcttgaaggcgcaacgctcgttcgcgcatggacgcaaccctcgcctgattgctggatacatggatcaactgaaacaggatatcatgagcagcagcagcagcagccaccacgcgcaagctgtaaatgttgcgttgccactcttagtcatgggggaggatgagcagcaggtggaggaaggccctcatggctatcgatttagagacaggaagggaaatgaaagcctggtcaccatcggtaaagttcagatcatgtcatcaacggatggtgttttgagctcatggccgccactcaaagatctgtgtttatcattctcgctgttcaagctgctgcggcgaagatttgcgaggtgtgtagttgtggaagaaggatctgagattggcccaaacatggtgtgcacattatttgatagtgacactgaacctgaaagaattgtcagtattgtcgcggatgagctatcttttgcatgtgatttttaccattcatcgctcccagtatcctgttcagtcttctggttattcgtattaaacatcttattctccttcgccggcacagcatgctgcttatttattgcaatacgcacgattcaacatgtggtttcggtagcacaggttgggccaatgtcatcagatccattctaccatcagataacctgtgtgttgatatgcggtaagaatgatcaagccaaacagttcggatcgattttgtttttcatggtgctatcattcctctttgtgatagtactaatttttgatgaggtatgggagattgtctcatacatgtgctcaaattggaccaaagttaccttgatttgctactacataaccaaacccacatggcagcaatctcctcgcatgcggagattgattcgttgcgtactacaatttcgatgcaatctcttgggctactggagtgacaaaatgggccaaacctccctaatggataccaacatgaatataggtccaattgttagaattaaacaactactcggactgccagtccaaactaagcaagtgaagataccaacagaggtgaaggctgcaattatcaacactctcaaaagccaaaactggagaccaactgattgtattacatcactccaacaaagccatatcggcaagagtttttcatgggcttgcaaaggagatggcacatctgatgttattcttgtatggcacattgcaacttgtatcttcgagatcaggcattcgactgagcctttgattgcagactcaattagcaataagatcaccgccacttatctgtcacagtactgtgcatacttgctatcatctgcttctgagctactgccagatgacaaggcatggtcgaagaaatcatatgaatctgttaagaagattgtcgatcccattttcagtggccggaatgataaacctttggaatatgagtacatattactattgttggttgaaaaatccagg

SEQ ID NO: 45040 - DNA, 515 bp, Oryza sativa
cgccaatgttacaaaatctttttattaccatccaaacggaaacgaaaccagaatcgcagccatatcttcccttgtccatccgccaacgccacgtcacctcctccgctatcccgcgcgccgcgcggcgtacatacgtcttcctcacctcacctctccaccgcctaagcctctacctttctcctgctccttctctcgtcttcttcctccacaactactctctcctcctcctcctcctctactacacgcttcatcaacaacacagaagcaagaactagagaaaaaatacgaacgattctcttctccaaccaacgctgtgttaatccggatgggctccaccgatcggaaggtgcgtgcgtgcgcgcgtgcggctctctccgttgtttccctagcttgtgtaatctgagttttgggtttgtgtgttctgggctcgatcaatttctcgttcaattttttcttggttggtgatcatcatgtaggtggtggggatcggcgtggcggaggaagggaggaggagc

SEQ ID NO: 45041 - DNA, 1501 bp, Oryza sativa
tttgctacaatatattataaaatcttgacatagaacaatctagaaatgtgtatttgttataagatactccactttagtgatgattcgctaaacacactatgaccattacttcaatatttcttgacagaaaaatttggaatgcatgcctttaccccatgccatgttatatgcaattatattttcgtctcaaattgcaaatatcaaatcatttcaaggatgattcatataatgaaaatatccaaaaataaacaaaaataaaaatggacatgaaataaattgaaaattgagcaaatgttgctagatttaaaacccactctaaatagttagaatgataaaatatataaaaaactaaagtacaatcaatcaaacaattgatattgttggatttttttgagtagtaagatatcctgctggggagttaagatatcctaaattttcttataggaagcaactcctttgtttcgacacaatattttctcatcaattcaaaaccgtatcttctcaaataatttatttttgaatttatatgttgtaagggtaattataagaaaataaccagcgttcaaagcacacaaaataaatttaattttagtttagaatataataaaaaaatatttaataaaaagccacccacacataaatattcataataaaatttcacttacattatacaagaagatgtccacacgtatgcacgggctacctttctagtttttataacaggtaaagttaaaaatatagatagtcttaatgtattcaaatcatattttgtttttgtttccgaaatatcgaaccagcatcattgatcaatttctaaaaaatcgtctgcctagggaaactagactaaccgatttcatccctcgtgaatactagctgaagtggccatttccacttataggctataagccaactataagcttatgtagaggaaagagaatttaaaaaatggagagggttggctctcatgcaagagctagctattcacatacttcaagataaatacattaaatacataggtgagagatagagagaggaggagaaaaaaaaaagataacattatagctcatttactatacatgttaactctaatattagctataagctcatagttggctctattattaaacttgctcttagaaaagcgggtgaaaaattgaagtcgcctccccaacaagcctgaagccctatacttcattaattaattatactatacagcgattactagaagctaattgtattatcctacatatgcccaaataaaatattggtgtacaaggaaattgactaacaaacaaatgccctagcaccgaaattcttctcaaggagagtatgggtctgtttggtttatagggtttggtttgggaaaatgatcctatccgggcgaccgatgcacgaactaaatatcgagcagttactcccctcacccacttcttctccattccctcatcctcttttctctctctttcttcttctctatccacacaaattctctttatatagg

SEQ ID NO: 45042 - DNA, 564 bp, Oryza sativa
aaatgagacccctacatcggaaaaaatgctttttctagtagtgttagttgtactagtatagcaagcagagaatgacatgatcagtgaccactaagccatgcgtgcaattcgaaatagaagcacagcaaactgagcaaggctagagcggatcaacaacctcacggagcccagaacaatagcggcgtagggacggaggacgaggttgaccggatatgactgttcctgctgctcgtgcctggcttcttgcttgaccggattgaaggctatgctatttcttggctgcttgggtgtttgcttgaattgacaacgatgcttgctgctgctagctgctgattggcgaggccgcgaagatagatgacgaccgcggcacacgggcggcaacaaaagagagtgctagttactagttactgcatctaccaaatttctgtaattaactgagtaggaagagttggaacagataatatctgatattgaactaactgaggagacagatgctatcctttgggcctttggcctctggcttaatctaactgctttttcaacaaattcgctctatagattgct

SEQ ID NO: 45043 - DNA, 1501 bp, Oryza sativa
cgaaattgtagtacgcaacgaatcaatctccgcatgcgaggagattgctgccatgtgggtttggttatgtagtagcaaatcaaggtaactttggtccaatttgagcacatgtatgagacaatctcccatacctcatcaaaaattagtactatcacaaagaggaatgatagcaccatgaaaaacaaaatcgatccgaactgtttggcttgatcattcttaccgcatatcaacacacaggttatctgatggtagaatggatctgatgacattggcccaacctgtgctaccgaaaccacatgttgaatcgtgcgtattgcaataaataagcagcatgctgtgccggcgaaggagaataagatgtttaatacgaataaccagaagactgaacaggatactgggagcgatgaatggtaaaaatcacatgcaaaagatagctcatccgcgacaatactgacaattctttcaggttcagtgtcactatcaaataatgtgcacaccatgtttgggccaatctcagatccttcttccacaactacacacctcgcaaatcttcgccgcagcagcttgaacagcgagaatgataaacacagatctttgagtggcggccatgagctcaaaacaccatccgttgatgacatgatctgaactttaccgatggtgaccaggctttcatttcccttcctgtctctaaatcgatagccatgagggccttcctccacctgctgctcatcctcccccatgactaagagtggcaacgcaacatttacagcttgcgcgtggtggctgctgctgctgctgctcatgatatcctgtttcagttgatccatgtatccagcaatcaggcgagggttgcgtccatgcgcgaacgagcgttgcgccttcaagaaagcatataacttgacaacaatcctgacaagaacgaagccacacgacatcgaaatgaagacacggtcaagtggaaaaataattctgaagtggtgaactgaaatgtaagaggtccagatcgcacgaacaagcagctccgcgacgggacgatgaacattttgacctccatggtcatcagcagcagctatcacgaagctgtttgctccgaaaatcagcgcaaggatcgcccatgcttccaggaagaacgcactcatgtccttgcattccttgacgtcttttggcaggccgcagttctcaccgccgatgtcggagacgaggtaggagactacaggcaggtacagggtagaggctccgaggaagacgaagcgggcgaaaccatggcgccggtggcgacggctgtagacgcctgatcctacaaggatcgtcaccacggcggcagcgaagatcaactgacctcgcgtgcgccacactcgcgcctgcatgcgcttgtagaactcatccaaccctgtgacgtcgcatgcttctcgaggccctgacattgacatcgttgagctgttgtttctttatctgttagatctgcatatacatgattcattcaagagttgcctcaaaaact

SEQ ID NO: 45044 - DNA, 1501 bp, Oryza sativa
gccggcctggtcgaggatctgcggggtgtagtagagcacgccgttgatgccggagaattgctggaggatctggatggtgacgccgcagaagagggcgtggcggacgcccggctcgagcagctcgcgccacgccgggcccgtcgacgccgccgccgccaccgcctccggcgggttcgcgaacgccggctcggtggggctctgcccgatcaggacgtccttggtgtacagcatcgaccggctcaccagcgccgccgcgtggacgtacgccgtggactgcgcgtcgccggcggcgcccgagtcaccgccgggcgcggcctcggactcctcgtgcaggtacatgcgcttcaccgcgccgcgcttgacgccgtcggggcccacgttctccgtccacttccacgccagctgccacccgccgccgatgcccatggtgctcgccgtctcgacgccgccgccgccgccgatgctgctgtgccgctgcatcgccacctggccggaggcgggctcgttcttggtctccacgtcggtgctctgccgcgacagcagcggtgcctgcaggccgccgccgtcgtcgtcgtccttgccgtcgtcggagaggtactcctcctcctcctcgtcgaggtcgtcgtcgccaggctgcacgttctcctcgtcccagctgctgccgccgggcctatcgttgacgctaagcatgctcccgaggttggggaacagcgtgctccccctcatgctgcggtggcgccgccgccggactccggcagccgctcgtggacgctcccgagaagcgccaccacggggtccttcatctgctcgtacatgctgccatggcgcgacgcctgcagccccagcgagctccccagcatgctgccgcggccgccggcgaccggctgcgccacccacgaaagcccctgctccggcccgtacagcgtgacggtgtccctcgcctgctcgttctcgccggcgtcgccctcggacgggccgacgacgtagtcctcgatctcggtgtcgccgccggtgccgaggccctcgacgagcagcgccatctcgccggagacgtctcgcggccgcgcagcatctcgagcacaaccctggcctccttcatgcgccccttgctgacgagccaccgcggcgactccgggaggtagaagacggtgacgaacaggtagagcagcgaggggacgaagaggacgccgagcatgatgcgccagttgggcgagggcgagagcgtcatggcgaagatcatgcagtaggacatgaacatgccgccggagccggtgaactgcggcagcgtgttgaggcggccgcggatctccggcggggaggtctcggagatgtagacggggacgagggtgacggcgaggccgacgccgaagccgtcgacgaggcgggcgaggaggaggacgtagacgttgggggaccagagcatgatgaggccgccggcgaagtagaggagggaggaggcgatgagcatggggcggcggccgacgaggtcggagacggggcc

SEQ ID NO: 45045 - DNA, 1501 bp, Oryza sativa
gatggcatagtatagtctcatttgcataaatagcatttaacaaatatttcagaatttaataaaacagttaaataataattaaacaatattaatccaacgctatacaacataccctgttgcataggcccaaccattccgaacaaccaatcccggctgcacagttctatctccaaaccaggaattaaccattccaaaccaggagctaaacaagttcttaacagcatcatttattatagtgagaggtgtgagactaatcacgaaagacattgttagactcgcccataaccgcgggcacggctattcgaatagtttaaactctggccagaggtgtaccactgtacccacaagacacaacctcaacatcatgtcaaccatgcgtcgcgatacttaataagtacccgaatagaaattgtgacaataccctccatataatacaattcaaagcagtgcaccgttcccggatcataatcacccccttataaacaaggtatggactccctagcgacccccgtgggcttatctccgccacttcacagtctagtgctctactatgaaccatactatacagaaagtaaagccgttgcccacgctggtttgtggttggcacggtaaatatttcacaaccgaaaatcgtgaaccggtccttaattgtcatgagcacaaccatcaaaaccatatgctcacaacccaccattatcaaattttagttggcgaattaattaattaaccaatcataattaaccatcatgagctatcattaagccatcattaaataatagtgaagcataagttatcccaatagtgtgctaatgtttctaagcatggctaagcaattatatctaatatccagctgaacccatatataaagctcaactagtgaagttataataacccaaggtatcaaggaataaagtaatcaagaacaaaaagggctatgacaaaacaataggttaattccacccaatgacattcaaaaataaatgcagtagttgaatagaaacaatagctttaaacgggatcaacatgctcaaagggttgtttgggatctgtgtgacttgccttgctggccttggaactcttcaaagtcttctcttgcaaaatcggactctccaggaacgtcgaaatctaaagagaaaagaacaaaatcaccaaaacagtacataaacaagcatgaacagtatatgtggatatttttaacatgtagatctcaattttagaaaaatttagagacttgaaccaactaaatccgagctaggatgaattagttatgaattttcaaagattaaatcggattaaatcatttatatggattttaatggaattatgacgcaataatgaattatttttgaaaaggaaaaggggattattgcgtcagcggctagggttcacggtggaccgggtgcacggcggcggtctacgggaacgaacggccgagatcactctaaccaaatcggacggccgagatcgatctagtccacggcggttcacgacatgacgatga

SEQ ID NO: 45046 - DNA, 208 bp, Oryza sativa
aaataggacccatttggccatctttattgggccagctcaacagccgagagaggctgcggtgtgagctgttacttaattttgcggacactatagattgccaaatgtgtcgcccggtatggcccagccctggcacgaccgaggcacgtcctgagattggtcggggcggcacagccgaatcgacaggccaaaccgtgcttgcgttgctagg

SEQ ID NO: 45047 - DNA, 951 bp, Oryza sativa
ttacacagatcaaggctaatttgcgaacaatctattaaaactaattaatccatgattagcacctattcattgtaccactatattatcaaataatagaagagtaattaggtataatatattcgtctcgcaaattagcctccatctgtatattctgttttgttcaaacatccgatgtgatagggactaaagtttccttgtatccaaattaccccttaaactcatcttcaaatctctcattttatgagagcgttttacctatctccacacttattttatgtggagctaaatcattttatgagagcgctttacacatctccacttttattttagatggagctgaaactgtttggctgagctccaaccacagaagaaatggagctgaagctgaaactgtgtcaaacaaaccttacttgtcctgatgatttctcacttggcagataggcactgagtttcaattgctgatgggattaacgtgaaagcttcttgaggttataaggctgtgttcgcggtaggttaagctgggaactttccctccaaacacgcaaaacgaaatggttcattatcacatgattaattcagtattagttattttcttcttgaaaaatggattaatatgatttaatttttaaaccaaatttcatatagaaacctttttaaaaaacgtaccgtttaatagtttggaaagtgtacgcacggaaaacgaaggaggtgaagttgggaactcaaattaccgaacgcagccaaagctgggtatatataatttttaaaagaggttttatatggtggtgtttgggaaggagaaactaaactttagtccctctcacaaaaattttagtccctcccatagggacttttgcttttgtgagagagactaaagtttaggtggtgtttagatccagggacttaactttagtccctgtctttagacactaatttagagtattaaatata

SEQ ID NO: 45048 - DNA, 1501 bp, Oryza sativa
ttgtaagaagaagacgcatgcaaatgtggaaacagtttttattttatatgcgaagaacatataaaaacatgtacatgttgcaacaatttctgttttatttgtgattaccattactatcagctgtgtcacatgatcagcaatagtgagctcggtagttgaggtctgctttgtagcagtacccagtcagacttccatgtgagccaattaattggagattgcacaactatatatgaagctagcaacaaataattgtaaggattgtggtaatattcatcctatataaataagggaaaagaactgtgatatgtgctctgtaattttcactcttcccaaatacaacatggaaggggtgcaattcctcgacttgccctctaaaacacctactgaagattattgtagacttattcttaggaacttgaggcaccgggatagttgccatgagatggttttagcagatctgttcaaacagcacctcttcctggccttgagctgacagtaacatcactttggcttttagttctgctacttcactgccttgaggttcgattattctgctggagattcctgctggcatctcttacatttgggcatcttgtcgtggctatcgtcccaggattattctttagagcttattcggttaatccccgagagtgaaggattagaggggattgggcagagatgcttacctcatggtgttgggcagcaaatcctgatgcattactcattcagacagatgttgaactgggagaaaaatgtcaggaactgaaagatcttgcggattaactaagaagggtgatgaacagaataactgtattcccgatcaaaataccgtgtgatacacacgcatcacagaaaaaatcccacgctctatgtttttccgcttgatcattttctatagaagagtcgtcttcgatgtgattgattgccctgccaaacaaaaaaaaagaagatgactgaacagttgtccgttctgcattatgtgataattgcttttgatcataagcggagtgtatgcctttcattttaaatatatgtactatgagaaagagaggtaattttgctttctatgttccttgcttagagtatccacattcagttgttttacaattgctaaaaaactatcgcaagttttttgagcaaaaaacaatcaaatgtaactatagtgtagttgtagtgtaactataatgtaactaggaacgtagcccgcgcattcgcgcgggcatgtattatagtttgtgtttcaaacactataacgacagaatataaactggagaacatttttagaatataaatcggaaaggaatttcgtacatatgtacgagcatcttatttgttattaaaaaaagaataatacatcactatatatattgtaagtgaatttagattatcctaaaaaaaagaaatatattaccccaaaaatacatgggagattttaatatactactaatatgataagaatgcctcttagatttaaataaaaatcccgatttctgtgtatgaa

SEQ ID NO: 45049 - DNA, 1501 bp, Oryza sativa
cattttttatccattattttagacgcttgcacaatcttcaataaacatgtttcaccatttatattttctaaataaattagaaaagataaatgatgaaacacgtttattgaagactatgcaaacgttcacgtcaaaaaaatattcattcaattacactcatctgtataaatttataggctagtgtaagataatgacatctaaaatttatagtcaatgcaatataaactcacttgtaattacaaaatcttctaagaattttactataaaaaggtaattaacgacataataaaataaattattatcttagtttagaggccagataaataaaatcaaagtaagatatttattaatctccatgaacttcatcaatcatgtcaagaataagacgcaatcagtaagctaaacatcttgaattcaacctcaaatttcagccatccaactatattataaaaatatgcatgggacgacattgtttcacttggcggaagagtggatcagtcatttgagctggtatggatggcaacagatgaactagacaacatctatggcgggtccgtgggttagaggcgttcaatatataaaagatggtaaccaggaaggctcctgagtggtcgtggggctaaggtcgccagcagcatggatttgatcccaagggatggcacctagtggaatttccactctaaagcaagaagtacgataggttaggaggtagatggaggcaggcggtgttgtagattcatgggaggaagggatgccatggcaatggtctatgcagatggagaaaggagcattgtagagaatcaagagcacacaagtgggtgggaaacagaggtaatggcttagagagagaaagagaggggggagaggagatatgatggatcagagagaggaaagtgcatgagttagggctttgtgttgagagatgtttataaattagatggagacccaccatttcatgttttatccaagtgttctaacgatgacttatttagagaaaatccatgaggtgatctatatttcttatataagagaaccattgacatcctgacctcagtatcaaggacgaatgtccatagataaaaaaaaatccaggttatcaatctatttggcactttgtctatttccttccaactttctctagatacccttgttaattacctaatgtggtgggtatattatttgtattttgtaagataaaatacttttactggtagtgactacattcgtgtacataaggctaaaacataatatatatatatatatatatatatttgaaccaaatagtatatgatcgactagataattcgctatgttgtccaagagtaactttacggtgatacagtattctataccaatattattataaggagatattaactgttgatttatgaagtctactaccacagtacaaaaattaatctactatatgagtggtttggtagtataaataaatatgaagatttggattataaaggatgaatggtatggattgattgtactg

SEQ ID NO: 45050 - DNA, 1501 bp, Oryza sativa
actacttgtagtttaaatttgatttctacatgttatatcaaattcaactgtgaatatacgtatgtgaatatacgtataataattagagttaaatttgttatttttgttaaaaaattgtagagttgaatttatacctgcacgttgttagagtgacatattacatattaaaccacctatctttactagttgattcagtttaggctagttcttctaccttctgctctgttctctacctccaaggtcctatctgtctcttctcgtttcaccgaagacaacgagtggtgaccacatcacgaactgcgccgctgtggccaactcctatttgaggggttgctgccattgaggtgaacacattactgcatcgcccccaatcagtccatggtctgatcctcgtaggggatgatgcaggacaagcccaaccacgatgagagccatcttgtggctgttgcacaaatcggacgctgccacccaaatccatcgcaatgatggtttccttgcaatggaggtgctccagcaacatcacatattcacatctaaattcatgtcgtggtagttgagctcgagctttacctccacttggcaatggggaatttcttctgcccttatcttctttatttctgtcaagtgcaaccaaggtccttaggccatttttcaatcacatggcattgatgctggtgctggcggagttccagcgcaagcacggcactggcaggtggctgctcaacctgctcacttgtagtggtggttcttgttggaattaatggatgggccttagtccactcgaagattaattctttggaaaattacaaaagcccacctcatgggataacatgcatgtggagtttagtaccaccttgcttattctagagagggggaccttcttaaaagggaggatgccctcctagccacttgaaacatgtgtggtggagagaagagggggaacacgcgcgtgctcgctcgcctcgcctaacaaggcaggcggcgcgcgtgcacgacgttacgcgtcaaattcggttacgcgcagtggagatcgtgcaggcgccctgatcaagcgacccttctttatataaaccgacccgccgtcttcacgcaacacacgcgaaatcaatctagggtttgcctcctactctgtgctgcgccgtcgctcgtagattactccatcccgctcaccggcgtgcatcggcgatcgggagagcaggtctccggaacctctgccttcgacgtccctgcacgccggcgatcgggagagcaggtctccggaacctctgccttcgacgtcctgcacagccggtctttctaccacctcggtacatgtttaatatgttgcgcatatttgatctgttcatgttttactgcttagtttacatgtgtagatctaatgatgcgttaatgctagtatacatctgcaatgccatgatttatttatgaaatatattaaatcattatatgcttataatctcaacaatccaaaaaccttattataggcactgtgattttacta

SEQ ID NO: 45051 - DNA, 421 bp, Oryza sativa
taggcagcgtaaagccacgaaccaaactcatactaagagtcctaaacaccttaggaaaccctctagtacaagaaagaaactttacataaccaatcgtaccaaatttggactccttctaaattcgactccgcatcccatacgcacacaatacctccatcgtatgccatatggaatctccatcaaccacgtgcatcaactctagcattagtatcccgcataatatctgaccaccatggacaccgtcttaccaccaagccaactcccggtccatcaccgcaaatactcacccgaggcatcgagccacctacacatgaaacaaacaaagaaaccatattctgagaccaagctatccccaacttgactcattgttagcaaacaacagtattatatacgtatagtatccatctagaatccataacca

SEQ ID NO: 45052 - DNA, 1501 bp, Oryza sativa
taattcccatcactgtttcaatgggtccaaagccaatcacatgctaggaaaaagatctaagcaattcaaaattacaacttccaactgaaataactaaacaaccaaaccttagtatttgcttaataatctaaaaatctttatatttaaaaacgaagggagtatgttataaatatgctagatgtattggttatttttaaaatgtactggcttggatttaagagcatttcacataaattagaacttcttaaccaataatatcaaatttttttaatatactaacaatatactaagttgagagttttatgatttttatgcaacaacttcatgtttattatgtccaaggttttgaaaaaaaaaatctaattgcatgtcttgtttaatactccctccgttctattttaagtgcagccatgagtttccgtgcctaactttgaacgtccgtcttatttgaaaattttttgaaaaaaattaaaaacgtaagtcacgcataaagtaatattcatgttttgtcatctcataacaacaaaatactactacctccgtcccaaaataagtgcagttttgcactattcatcttcaacgtttgaccgttcgtcttatttgaaaattttttatgattattatttttattgttattatatgataaaacatgaatagtgctttatgtgtgactaatttttttaaaatttttcaaataagacggacggtcaaacgttggacatggatttcgacgactgcacttattttggaacggtggtagtaattaatttttttttttcaaataagacgaacgattaaagttggacgtaaaaactcatggttacatttaaaatgagacggagggagtatgaactttcaatatgatatacggttataataaaagtatagtacatatcaacggtaacatgacatttaaaatatcccataatttatatagggagagagattctagaagaacttttctaaacaaacttttctaagggggacatgcctgaatgcactgattctcttttttgttttatgtcccctcggcagagtggtggatggatttgacgggacagagctgcacaaggtttcttttattgtttgcttatctatttatcggttgcaattaaaatttgaattttgaagataattttagtgctgattttaaaatttttataccgtagtttatttttcaatattattttttaaacatttattgatacaaatgaaagtagttttcctcataaacttttttttaattattttgattattttatcatgacttatcggttgtaggcgtagctcagtgcttatgtcagcagggtctgaataggacgggcgctagtgtcggatctcggatgagaagatccacggtcaagctggatgaccattcacagggtgagctatgtgcgaaactgatgacacttcaccaactttattaccagtagttttatatgatatgatacctgaaatctggcttccaatgctgtcatgtaacctaagatggataataaag

SEQ ID NO: 45053 - DNA, 1501 bp, Oryza sativa
ctatgatatctgcccctagataagttgatgagattaagaccctggtgaacttgtcagtgatgtgcacgtgaaatctacccgcaaagaataggaccacttgcattgcgaagctcaagagcacaggcacatatttctccatttcgtatctcatagcacctgttgattagaatagcatacaatatcattcagtgtgacttcggcaattggaagaagcaatgctttataaatggcagtacaatcaatccataccattcatcctttataatccaaatcttcatatttatttatactaccaaaccactcatatagtagattaatttttgtactgtggtagtagacttcataaatcaacagttaatatctccttataataatattggtatagaatactgtatcaccgtaaagttactcttggacaacatagcgaattatctagtcgatcatatactatttggttcaaatatatatatatatatatatatattatgttttagccttatgtacacgaatgtagtcactaccagtaaaagtattttatcttacaaaatacaaataatatacccaccacattaggtaattaacaagggtatctagagaaagttggaaggaaatagacaaagtgccaaatagattgataacctggatttttttttatctatggacattcgtccttgatactgaggtcaggatgtcaatggttctcttatataagaaatatagatcacctcatggattttctctaaataagtcatcgttagaacacttggataaaacatgaaatggtgggtctccatctaatttataaacatctctcaacacaaagccctaactcatgcactttcctctctctgatccatcatatctcctctcccccctctctttctctctctaagccattacctctgtttcccacccacttgtgtgctcttgattctctacaatgctcctttctccatctgcatagaccattgccatggcatcccttcctcccatgaatctacaacaccgcctgcctccatctacctcctaacctatcgtacttcttgctttagagtggaaattccactaggtgccatcccttgggatcaaatccatgctgctggcgaccttagccccacgaccactcaggagccttcctggttaccatcttttatatattgaacgcctctaacccacggacccgccatagatgttgtctagttcatctgttgccatccataccagctcaaatgactgatccactcttccgccaagtgaaacaatgtcgtcccatgcatatttttataatatagttggatggctgaaatttgaggttgaattcaagatgtttagcttactgattgcgtcttattcttgacatgattgatgaagttcatggagattaataaatatcttactttgattttatttatctggcctctaaactaagataataatttattttattatgtcgttaattacctttttatagtaaaattcttagaagattttgtaattacaa

SEQ ID NO: 45054 - DNA, 1501 bp, Oryza sativa
gcatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcacccccatgtgcgcaagaaagaaagtgatggttttctcccaatccatatttcatatggtgttttgtccttatttctgttaggaactctgtttaacacatgattcgaggtcagcaatgcctctccccaccatgccttaggtagtcccgcggtgtccaacatggcattcaccaagtgtgtccaacatggcattcaccaagtcagtcagtgtgcggttctccctttcagcaatcccattagactcaggagaatagggaggcgtcctctcatgtataatgtcatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacacctaattcatttcacaaagatctgaatgtaagagttctagaggtgccaagtttctctcctcagcagccttgtaaggcttgcaaggttgctttgattgcacacaactatggcacttagaacctttgacaatggaaaacttaggaattaaacacatgctggaaagtcgagacatcaagccaaaattaatatgacataaacgtgagtgccagacattagcctcatcatccacactgccataaatatggttcatagactcaaattgtgtttgagtgcagtaccgaaacttctccaagatggaggaagtttcgcaataatgcacccggccacaaatttgtcgggtaagacacacttaaggagttcgaattccttagccatggtttgtatcttatgagcctgttcgactacagaacggttgtcagccatcttgtagtcgtgaaactgctccatgatatacagatcattgctagcatcagtagcaccgaatttagtattcagtgcatcccacaactccttagcgtcggtcatatgcatatacacctcgaccagacgatcgccaagaacgataagaatgcatcccacaaagagagtagtgacttcctcgaattgcttctgctgttcagtagtaagaactccttcaggtttgccagtactcacccagaaacatttcatagctgtcagccacagagtgaccctgatctgccatctcttaaagtgcacaccggtgaatttatccggcctcagtgcatcggcaaaaccagccatagtaaaatcacagtgcctataataaggtttttggattgttgagattataagcatataatgatttaatatat

SEQ ID NO: 45055 - DNA, 1501 bp, Oryza sativa
ggcggtttaggagcgtttgtaggaagtttaatggacttttagtatataatagaagatagatagatagatagatagatagatagatagatgggttacgagtaaaatttaaagaggtgggctaaaggaatgagatatgcttttatgtcattagtgcatatctacatagcaatagtattcagatatctgtactatttttgtccgtcggaaaacatttgcgtttgtatcaaaaaaaaactagatgtaccttgtatctgtgtgcagattatctgatattattggctttgaattgtatctgtaatatttttcgtgtagctgatggaaacaatctgaaaaagtgatcaacaggaacaaaattcatggcggccttttttcatttagagaaaaagatgtttaatcaaaatgtttcacaaatatacaacattcatcaataacccactgcatgaaacgtcaagtctcaacgcgaaaaatactatacaataacaatagtgcaatagcatttactaccggttgaaataattcgcttctcgtacatgaaacactaaattttatggtagatcatgttgtaatgattcaattacaataaatataatggtggaattggatcataggtcggacaagtaatttaggaggaaaaaacattttaggtttactataataagccgtatctttattttaaatgcatgcatgaatgggaaagagatgtgctagaccctgatttctgcatataaaagtatcaatttcaagctagcaacatatttgaattttgtttggttgtgccattaagatctcaatccaatcctccaagaaatttgatcccctccaaattcaaaaaccatccaaattcaaatttgaatttgttaaatatgtgatccaaattttgggcccacaatatattcggattagtttgctagtaggagttcctattaggtgtctttctatttcccttatatgtagtattgtaagccgtacgggaaggggtgacgtttccattgttattcccctacgattataatcaactcctctatagtgatcattgccggtcggtgcccgtggtttttcccgcaagggttttccacgtaaaattcgtgtatccgttgtgcatataggattagagatcgatctacaccacgtcgccgccgtcgccggttttgctttcgtcgtcgctgaatcaatctgttcggtgcagtaccccgtcgagtccgagtcgctgccgtcctcacacacccgcgcgagaaaagcagaagctgcagcaaccgcacagccgtgaggaggaaaaagggccggcctactgcaactgtagggcacgcgacccgaggaagtcagggactacatcgttcctgttgagaaggaatttctcgatttttttctgctaagcgcaccaaagcttgtgtaccaggaaatctacatacttcgctttgtgcacacaggaagtgcacccaggtttcgtgtttttgctaggtttaccctaatttcttacaagcaaattcaggattaattctca

SEQ ID NO: 45056 - DNA, 1501 bp, Oryza sativa
aacttcctacaaacactcttaaaccgtcttaaaccgccatgtggcactcctataaacgtttctaagccgtcatgtggtactatctaatctcaccattgatttttacttaaattggtggacccgttattctacaccattaggttagatctattattgcgaaatatagaaacgatactaccgttctcaggtctcgtacgtacgacgtacgagtagtaggtgcaatttaaatttcaactgttcacggaagggaaaaaaaccatactacttcacaaatataatataaatatatatagttaaactaagatatataagaaaaacatagaatacccaataaatgttctttaaacaatcttctaaattattttgaaattatatatccaatttgtgatcatgttgtatttctttaattaaattataaaagttatattatagtcctaaatacaccatggcacatgaggctgacatatgtatgataatttttcaaaaaaatacatcatattttagggagggaaatatcacttcacaaatatacaacattaatttaaatctgcatatgtaaaaaataaaaacaacacaatttagttgtgtttttcaagtaggtctgattaaattataatttatttgagattaagattctcaaagtagctttatacttttagaactatttgactatatatatttgtcaaaatataaataataacatgatgctctggttattatcgtggtgttatgtctcattagatataattttttaaaaataccatcgaacgattgacctcagtcatattcaaaagagagtattctatctatataataaaaaaaatgagttgtaatgatcaacaacataaacaaatcgtgtctacactgcaccacaaatctactcaaaacatttttaaaaactactttggtcacctccatcttctctttgttcttccctaaaggacaccaaacatggacaacaaagtttattatggtgtcgcaagtttagtatggaatatacggctaagttaagacagtcccagtggagaccaccattgctaatagtactcaactttctacttaccaatgcaaaactccatgagtcctatttcattctttggttttccaaaagtctaaatcctatttgtagtcactatgtgctatattaaattttttatcggaaccaaaaagtcattttaatacttattgcttgcatgttcattggttttgtcacatgatgaatgagttgactacaccttgatcttagtgaaaaagaaatataacttagacttttggaaggagggagagtacattaaaattatgctccaagctggtcttcaggagcatggctatatcgatgcgggacccatgtttcaaggcaatggagaaaggaagtcttggtggctatgatcgactttacccatgatgatgtgaccatcaagtatatgcatacatccaagcacgagaaatataaaacatggctaaagaatacatcgagtgaatggaggatctacaagatatt

SEQ ID NO: 45057 - DNA, 1501 bp, Oryza sativa
gaccttcgctgcttgcctccggtttgagcctgtcgcctaagttcttggtttcggtagatctggccgaaggccctttgtggtgtacctccaacagggttaattggttttaaagcataatttagtggtgacaatatgagaatttatatgtcactcgatcaaagtgtatttttaatctgagatatattcttattattttataacatttaagtagaaatagtgagatgtaacttcttttatcattatttttataaaacattcaataagatgcctgcgcatctacgcgggctttctttctagttttagaaacatgttaattgaaattaaggtagaatttgttcttgaccagaagaacgggccctaaatttatcaatgcaaactgacttagcaaggctaataacgacaattatcacatcatgcgtttacatgtacggttggatccatgccataacaaatttaccatattagaaaaatgccacccctattcgtgatatcagttgagtgccactggaattttgtaaaattggatcaatgtcatcgccgtcacagtttccatttttcacatggaccaaaataaccctgaacgtgggacccacacatcagtttcatcttcttcctccatcctcctctcttccggagggcatgacgatcctcccgccgcctctctccaatgggaacgactgccctcagcggcggcgcgcggggagaaggctacaaccacagcggtctccccccattagatctagttgggaagcgaatcggtagcctcgtgggcatgaagtcatcggcaagcccaatctccccaagtacactctcccattccgccggcgagcctaagctgctcctcgttgatttcatgggcatcgctgatgagtaggaacgacatctagtggaagagctcattgatgacgagggaaggaaatgccatggccgcctcaccctgtcgccgcagcccacggatagccatggcccgtcatcgccggcatcgtcttgccctctcgctgcatgaggacatccatggctcgccgcccgccatcgctgtctttccctcttgccgccctcacacatccatgcccgcctgctaccatcggagtcaccttgcccacgcgctgctgcggacggctgtggcttgccacccgttgttgctgcctttccctctcaccgcccccacacatccatgcctggagaggagaagagcgcctggccgacgaggaagaaggagaggagaataaaagaagagagaataaggagagcatgacggaaaatatgacgacgatggtatggatccaattttgtaaaattttagtgacacccagctgatatcgtgatttgcaaatagtaatagtatttttctaaatagcaaatttgcaatgataggatccaattaaccctaatactagtagtagtaaaatagtactaataattaaatgttcatcacttcagtcttcagtggtaataaatagtcgagcccagcacaggcctcaggggaagcgaaactatggcg

SEQ ID NO: 45058 - DNA, 201 bp, Oryza sativa
  unsure (1)..(201): unsure at all n locations
tgacaagtacttgttgcaataatcttgctccggagtaagtggttataggatgcaagtacaatacctagttgtagacaaggtcaatgncgatacggagaagaataagcgcaatgtcagaccagcttgttataatccagtaacagtaagtaaactccgtaccgttcgtttttttcattcattttaattattgtccgttgcagg

SEQ ID NO: 45059 - DNA, 398 bp, Oryza sativa
ttttcttttccaaaggatttgataaatccttttcctttagacagaaaatccaaataatcttaggaaatccatatctccccaaccgctggtccgattgactccgttcaacttccagtattcacataaaattgagatctatttaatggcactactaattagtctaaataggatctttcttttggtcttttgtttaggttttcgattgtttgcgtatagttgcggttatcggattttcgtcgatcgcgggttttctcgaagattcgtgaagctttgtgaagaccttgagcaaggcaagtcacccttgatcaattgcccctataattgaaaagtcattattattttgtttgcaacttgcattattagaatcacacacttaacttgcttggcctcggtttgcg

SEQ ID NO: 45060 - DNA, 1501 bp, Oryza sativa
cgcctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcagtattttcaaaaataaaaatcctttgttatttgtgaaaactgtctagtctctctctgtcttgctgcttcatttatcgtcaaaatctgatctttaaaatgttgtttctctttttgtttttgtttgtagatggccggcagcgtcacccgtcgtggtttggacatgactggcttcgtcttggagctgcggggcatgtgcgtggtcctggggtatccacatggagtggactaccaggccaggccgcttccggatcaggagggtgacgacgcggagccccacgctggttgggaggtcaccgcagtgatcctctctggctctcccgagcggacttcgctggcagtcaccgcgggtggagactccttccccgccgcttgccagaacgccgctctcctcgccatcggcacccttcaccagcgctacccggacgagttgcagcactcgccctaccgctaccaccctcgtcgcggaggagcctgcgactacgccaccttccgggatgctagctcggaggatgacgctaccatcgtgcacctggcgcgcatggtggaggcgtacgacgcggctcgtatcgacttccatcagatggtgcgtcgcgggatggtcaagagcaatctgatgatcctggagctgcgtcaggagaacctgcagctcaagaagaacctcgacgcagtggaggcgcagctgcatcagctcaagatcacccagggagagatctgccgccccaagcgtcgccgtgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagccttcggcgttggtagcacggagggtgcgctgttgctcaccttccgtcctggcccgtcgcagcagtagacgagcagttagtaggcttgcgcgtgtgtttttctcgtttgtcttcttgttgagtcgtgtggggcatggttatgccggtgtgtggcataactatgtcggagcctgtcttattttatttgcctaaacaacttgaaccttaatgaaccaatttaatagcagtaataaatgtaagaataatggttgtcgtgggtggttagttttaattgttagctccttctctgtttgctggttctgtgtggggttttcagatggtgacgaccaggagaaacgctgctaccggtgatggcaatcaacctgaa

SEQ ID NO: 45061 - DNA, 1501 bp, Oryza sativa; identical to SEQ ID NO: 44333

SEQ ID NO: 45062 - DNA, 1501 bp, Oryza sativa
aaccctgacactgcacgcaccgacaattcgtcgagcggcttgggcgcgtcccgcccggccgccaccgccacaccaccccccgccttcccccgcgacagctcggcgttcccgggcgacgccacgagcgcggcgatgcgcttgcacgcgctctggacgtgcgccacgaggacgacgaggtcgtcggccgcgccagcctggcccatgtactcgagcagcgtgggcggcgtctccgccgccgcggtcgccgcggccatgccgtcggctgctacggcacgcgcccgggagacgggcgagcggcgcgcgagcggcgagtggcggaggagggggaggaggagggcgcgagagggaggcggcggtggcgggtaatttgaagttggcgggagcggagcgcggtggagggggaggagggagagagaggataacggcatagtgtagccagtggtagtagtggttggttggttgctggatgatgcgtggctcgtgtggatattgccctccacgtttcattgcaaaaattggaaaaatatattacaaaattttattttattttttaataagacgtttcattgtagtattttttaagacatatttaggcccgttttgcacggctttatcttcagctccatcactcttagatcataagcttaaccaaacttcactcaaaaatagaatggagttggctgaagagctctcacaaaataaattagataggcatagctgcgtttaggtaacttcaaaatttcattctagacctaaaattaaatttcgaagttagaaccattcttaaaaaaatatctaaaaatctaccattcgatcattataaggaatcatacctagaacattggcgtcgcttgacaatgctttttctcaaatgctaacatttttaaatgtgattgttgagaataagtttaggtagaatttttttaagagcgccgaaaaaatccactaaaaattaatcttaaactcaaatcctaacatttagaatgagaccagacttttagaaatagcagtgtgcaagagagctggcttacattaaaaatagattaatatgattttctaaagcaacttccgtatataactttttttaaaaaaaaattacactgcttagcagtttgaaaagcacgcgcatagaaaacgagggagataagttgagaaagaaggaagaaaatctcctttaaggctatggtcgtccttctttcccaacacacttttttttccgcccacacgtttattcaacctgctaaatgatatgtttttttttcacaagtttttttataagaaagttgttttaaaaatcatattaatccatttttttaaatttattagactaacatttaattaatcatgtgttaataataatatttgttttccgtatgtggaggtggagttcctaactcaactcagcaactactccctccttccctaaatgtttgacgccgttgacttttttaaatatgtttgaccgttcgtcttattcaaaaacttttgtaaaatgtgtaaa

SEQ ID NO: 45063 - DNA, 1501 bp, Oryza sativa; identical to SEQ ID NO: 18583

SEQ ID NO: 45064 - DNA, 401 bp, Oryza sativa
aggtgtaataaacctcttgcatgatcactcaataagcatatgtgtgtgtgtatatgtacactgtcttgtttgatggtgttccaaaatggcataattaataatatgatatccgaatttatttgtagaggcatatgactcagcacctgctaactgctcccagagtccaaaaatgtaataacctataaccaaacgattttgctaaaaattaggcgcaaccggagtttcttttgtttttctttctctgttttatttttatttttcatcctagagtctccaataggcattgtgccattatcaacttataatatcaatatttattcgagatggtggtgaaactcatcctttataaactgcaatccctcgtaaaaaatatataaaaattagctataatacgaatcagg

SEQ ID NO: 45065 - DNA, 378 bp, Oryza sativa
tgcataactgctagctatctttatttatttgacaactgtagtattattttccatgaatttaagagcttagtggctgacatgcaacatgttgaaagtttgttttctgacacgttgcaatgttattggtttcctcatttcctgtattgcattacttgcccctacttaatggagctgaaaattccattgttgaatattatgtcaacagtggctggtcaagttttctttacacacttgttactttatttctcttgtagaaataaacatcatattaaatgcttgaatctaatagtttacaagatattgtctgtgaggttttaattttctttgctactatttaatctatttctaatgcaagtgatatcgaacattggaaatagg

SEQ ID NO: 45066 - DNA, 270 bp, Oryza sativa
tccgcatccttccaggtacctcttaagccctgtggtcttggttctctgagggaatgtccccgctctcgccatcgacttcctcctcctgagtatcaatccactgatcaggttcctccactgcgtattgtgattcgactccgctggctgctcaacggaggagctctcatcggagtcgacactaccggataccgagatgtctagcaccgcgcgaggagagctctgatcggtgcactcgctgctgtcatcgttaccggccttcgaatccatctt

SEQ ID NO: 45067 - DNA, 820 bp, Oryza sativa
ttgattgctgccacgttttagagcaaacatgatccataaactttgccgactttctacaataaaatagtccactgcattttcattgttcctttcaatacacatgcttgagtataattttgaaatttgatttttttaaaaataatttcaggtataatttttactcgtcttcatcgcaattatgaaaagagagttgggtaacaaaaaacaagcgaataaacttataaatttggttctaaaattgaaaatctgaagaggtggaattgtgagaaaaaccagatcatcacaaaatcttccaaggcctcacctaaaatagagccatagcaaaattagcaaaggacaataaatactccactggaagagaggctctctaatttgagagatatttatcctccacacctaccaaccctactgtcactaataaatcattgtttattacttaatcacacgacatcaacctcattgtcccctaacagcaacatccaatcccatgcaccacgacgattaattactgaacaggaggaggagtagtagagtacagagataacacacacagacaaagacacatccaaatccattctttctccaccaccaaccagatgatctcctcttctcttctccaagagaaaccattccattattacaaagctcatttttctaattacaaagtccatttctttttatgttttctgaataatttttcttcttctccctttggcatgttgctgtaggtcccctacaaaggtctagaggtcactagtagtacacactcctacaaaaggttgtaccaccacaccaccagcctcattgctctcattgcatt

SEQ ID NO: 45068 - DNA, 1501 bp, Oryza sativa
ggattcgtccgattttgtgcccgcaaagttcgccggcgcaatcaatggcggccgagatctccgcgccggtttccatctcctccggccgctttccctctctcccgacgctatttaattgttccccgtgcctctctcctccgtttccgccgttcgccgctcgccctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggccgccttcgggcgcgccctcgcggctgccaagtgggcccggccgtcagccgcccgcgcccgcgggtgcggctgacgcgtgggacccacggcgccggccgccgtcagccgcgtgcgcccggtccaccgtggaccgagaggctgacgcgtgggccccactcccgtggacccggtccgcgcgccctctccctcggctgacgcaataaacccggtttttaattaaaatttaaatgaagaaattcgtaaatatccatttaaagagcatataaacttcaaatggccatatcttggccaattgaactcggaattggaccgttcaagtctctaatttttccttaagaagtcaagaacccatttttgtgctttgtttctgctgttatgtggagtttattagagtaaaagcctttttcttttccgttggttgtgtagacgctgcagcttcggaagatccgctcttcgtggaagtcgaagccgtcggttgggaaagcgagcaaggcaagtcacatcatctttgagcatattgaatcccagtttataaaattatgttgatttaaattattgcattatcgctttatttaaattcccgcgttaccactgttttatttagccatgcctatttacctttgttatgaccatattattattgttattgttaatattattaccttgttcaccctagatcaaacaaaacctcaactagtggacactctactcatggcaccactagtttaattttaggtagatgcttcgcaatttaattaggtaacattaggtggttttacaactctagactttgggatattctcatcacctggacacactggaattgttggatcattgtggaattggcttcacaccgccccctctattcaaaatcccctaaaatggttttaggctgggctcggggtgcatggttttgatagtagcacctcggccacataaggaccggt

SEQ ID NO: 45069 - DNA, 1501 bp, Oryza sativa
ggttgggaaagcgagcaaggcaagtcacatcatctttgagcatattgaatcccagtttataaaattatgttgatttaaattattgcattatcgctttatttaaattcccgcgttaccactgttttatttagccatgcctatttacctttgttatgaccatattattattgttattgttaatattattaccttgttcaccctagatcaaacaaaacctcaactagtggacactctactcatggcaccactagtttaattttaggtagatgcttcgcaatttaattaggtaacattaggtggttttacaactctagactttgggatattctcatcacctggacacactggaattgttggatcattgtggaattggcttcacaccgccccctctattcaaaatcccctaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctagtcataaacaaaagtacacggattggagatggatgaagtcgggggtcgatagacattctccagggcaaatgaaggttacacgagctgcggcccggtagtcgagatgtcattggcagagggttggtgccctgctgctaggggctcagtcttgcctgcctgtcccgggggtttcggccgtaggcaggattgggtcggtactcttgtctatggctaggatgggttggaaactatgtcacgtcttccgtctgtataccatggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatgtggaatggttggcctaggttggcttaggacgagctgggacccagggtcgggttgccagttcggtctgaatcatcataggccttgggttaaggcaggttcgtgtgggttcacggccttgattaataatattgtatagttctaggatcgggtttacaaattggctttgagcaactaaatgtctttaaatgctgtttactgcaaccctaacccctttatattataattcccttgtactcccttgcatttattctgcatttatgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcc

SEQ ID NO: 45070 - DNA, 249 bp, Oryza sativa
atctgtacagccgggtatggttgttcaggatggtcgggcctgtccagcatgggtctcctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgttgagtatgtcatatgctcattcttgcaataatcaatcaacctca

SEQ ID NO: 45071 - DNA, 1501 bp, Oryza sativa
aagggtgagtacgggagtactcagccagccatgggaaataagtgtttaatgcaggcttcagagaaaggctgttgtttttgcaattgattttatttgaactcttttctgaaacaactaagtgagtgcttctcaaacgacacggatgagacagtgcgtctcgtccggtcggagtatgtgcaatgtattagtcttttgaattgaccaagattggcacccggccaacagctttcaaacggccacccgggcctggctgatcccatcagccgcaaattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatcgagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctctccgacaccaccccggcgaatccacatgtctcttagcatcatggctcccccgataagctagttactcagccaggggtgtcccattccacccatgtggtcgtacttgtcatgtgttcggatgaaattccaaggaaatggtccttaagtgcaagaacgggaaaccgtacacccggtacgttccccggtccgcgattttggaaattcatttagttcgcaagcaccgacccaggtgtcgggttttccaagtcttttgtaaaatccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgctaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcaaaatcctcgcactgcgggtcttcgggctccgaaactacacgcgaaacgggacgactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaggagggagggaaattacacttccctcgggcggctagggcgcggcccgagagaaaggggcggctcggccgagcttaa

SEQ ID NO: 45072 - DNA, 234 bp, Oryza sativa
ccatttaccaaaccaactcgctattctaatctccatctatccctcatcgtgttcctctaagaaaagccatgaagaactccctcgaaatctccaaaaacatccaatcctttctctcaaccaaaggtgtttgattcgttacaaatcttctctagtgagcttcgccatattataatcctaacaaccgtatctacggatcataattaactcagtcctcttctttattttccctttcca

SEQ ID NO: 45073 - DNA, 523 bp, Oryza sativa
cagtggcaaagccgctaacggtttggcgggacttctagaaagtaaaaaatgaacccaaacaataattatgttcgattttaaaaatcccaataacaataaagaaaggaggcaacggatggacattagaggagtcgagtggcagtgtttgatgggatttctaaaaattataaaaacgaaacccactaagacaataaactctaaaaattataacatcaaaattttaaagtttccaaggagaatgaataggaaaagtgatagatcgagcaagcaaataaagaatagggtaacttttaaagactataatattaaacacgaggatgatatggtttgatttttaaaagttttaaaataatgagataactattcaataaaatttaagtaaaatcatattaaaaatagataatttcatatggatgctagccgcgcaattgcgcgggccacccagctagttaaaactaaaaacatctcgaaacaaagaccacagcttctcccctgcatcccaaactgtgtttttctccatagg

SEQ ID NO: 45074 - DNA, 266 bp, Oryza sativa
ccactaaatcggagctagatgaattagttatgatttttaaagagttaatcggaataaaacacttaaatcggtttaaatgaattatgacgcaataatgaattatttttgaaaaggaaaagaaggtttattgcgtcagcgggctagggtttgcggtggaccgggcgcacggcggcggttcacgcgaacggacggctgagattcgatccaatccaaacggacggccgagatcgatcgggtccacggcggctcacggcggacgaccccga

SEQ ID NO: 45075 - DNA, 226 bp, Oryza sativa
tctatttaaagcccatttacaaagaattaaataaatttcattcaatttatggacaattttaatatgtagatctttattttatacaacttttgcaacttgacccacattaaactgagttcaaatgtgaatttttaaagattaaatcggattaaaacacttatatggattttaattgaattatgacgcaataatgaattatttttgaaaaggaaaagaatgattattg

SEQ ID NO: 45076 - DNA, 1501 bp, Oryza sativa
ttaatcgggttaaagtttagcagaactgatcggatgtttatatttttcttttcagccgcaagttgatgaggggcttgctaatgggcgcgggtgcgctagctgcctaactggcgcagccacgcacgtcccaattccacctctcctcaacgctaataacatgattagcattgatgacgttaattagcgctaatgataattgttagtattagtttttttaaataaaataatacataaatagaacttttaactcagatttggaaaactttcaacccggatttgaaactttcaacccagatttaaaaactttcgactcagatttggaaaactttcaatccaaatttgaaaactttcaactcagatttaaaaactttcgactcggatttgaaaacattaagtcaagatttttgaaaaacttttaactcagatttgaaaattttaaagtcaagatttgaatacttttaatccaattttttaaaaaaaattcaacttatattttgaaactttcaaatctcgatttgaaaaaattcaagtcaaatatttgaaaactttcaactcggatttaaaaacttttaactaaagatttgaaaactttcaactcagatataaaaacattcatttgaaaattcgaaacatttaactcaaatttgaaaacttttatcttaaaattcaaaaattcaactcaaatcttaaaaacttttaactcaaattcaaaactttcaactaaaattgaagatgaaagattcaacttctaaaataaaaagatcgcagaaaaaaaggcaaagagaaacgaaaaaggcacgtacgttaggtttaggtttttcgaaaaaaaaaatatggacgtgaacgccgtctgcgtgcgtacgagccagcgctgtgggccttatggcctaaacgcgtgccgctatcacgcacgcgcgaattagctctcgcgagttgatgagaccctgtgtcgtgttaaaacttgaaagccccggccgccagccccaagcccccgaaggcccgaacgtatcagattcctagcacaattcaactgtgcccaaaatcattgtgcctccagcctcccctggaggaggtcgcccgcccgccacctgcgccgatctccctcgatcccgcgagatcgtccgtcctgctccttccgccgcatccttgtgagcatcttgatcatctctctacaatatgcacctgttctcgtatttgcgttacccctagcaagcttctgctgtaggtctggaacgttagatccgctcttggtttattccaatctggatgcaaagagttcgttcctttcccatacgagactaatttcgtctaataatacacctatatcaaaataatccggtatatattctcaccgtattgtggtaccttttcagctaatctatatttctatatatgtattgaccctgtttaattcagaactcgacatttaacttccttgtcctgatatacaagcaacttcgttctgccgtactctcttttttttcggcgaatttgagcttga

SEQ ID NO: 45077 - DNA, 1501 bp, Oryza sativa
aagttttttcgcacgcatagaatctgtatcctaatcagaagctaatggggcctttacttgggccgatatttgcacgactgaccctccaactattcgcattttgcatttcgatcctccttttgcctttcctctctcctctactccacacggcggcggacctccggcgaaccccgccgcgcgaggccggtccacgggaatcgatgcagccatgcagggttaacgagcgcactcttacctgctgcgcctcgcctgctcgtccgccggagaggcttccaggcgacgggggagcctccgcctgctgcgccggagtccgcggggcagctgggggatccgacggcggcgacaaaaaaaggtacagtggagtacaggtgcaacctaggattcagaatatccattcgaaattggtgttgcctgtgataatcatggttggttgattagcattctagagaattgaaatcgagaaggagcttttttatccaataattagaagaaattatgagtgtgtttagaattaaacacggaatcaccccccttaccgctacaatatcaagtgcatctcttctattgaactgatttacctttttgaaattcaggttacttgattggatctaggagctttttttttttgtttgacatggtgaacaaggttcatgcagagatagaacacacaggcgagggctgaaatggtccatcgatcgaataatggtatcacaacatgcatttggccaaaatgacaccatggtgatcagcaacaaagggagcaactgataaactgaacccttacatccatccatacagcctgcatactactacacctttggaaaggaggaggatcacaatgttgataatgatgatgatgtacaaaagatggcagtcaaaatcaactcaagtatcactgctccaaggcaagcttcttgtgccggtcgagatcgttgaggtaacttgagcgagtataatcctctgaatcgccggagtcgaacatgaggggtttcatgagttttggtctttgcatttgcatcatttcgagtgattccctatcccccttcaagaaacggaccacctacaggcatcaaaccaacaggtcagtttacaatccaaattgttcttttttagcctttacaatggccgtatagttagcgtgttcatcgcactcaccgatttcatgctaggccgcgagcttgagctgtggtgaatgcacatggatgccactgctaggatgtgagccatttcttctggatcatatccaacatcaagagaaggatccactagttccttcatgttgttcgagtgagcaatggttttgcctatgcacatgacaaacaacagcttgtgaattcaagggcttcagatgtatgtgattataccagttcatgttatccattcaagtattgtagaattaacttttgatcatcacttgcctctctcaatatgaccagacaatgatataaaatgagctgatttgaatttttgtataatggagcatattagagatttgctttta

SEQ ID NO: 45078 - DNA, 1501 bp, Oryza sativa
agggatgattttagaatattaccatagacaaaccctttaactgcgccactgtactcctatatatatctcttattacaccggtcagagtactgattatttcatcatcttcttcgtgcattcgatcgatccatcgccatttcaattcccagtacttcagcaatggacaatcaatggaatgcagcgccatcttcaggcacgaattcagagtaagttgatttaccatggctatattaatttgttgttcattaattcaaaatgcaccctctttttagccaaacaatcaaaattaattttcttttgtctatactttctgatcgatctagctccatgcatgttcatatgttttcaaaattaattttctgttctgtcgatcttcacagccgcaacgtgcatgtgaatggggcagataagaaggcccagagccaagaacaacaagaggtgagagagcatatgtatttttaaattcatcattgcatactgatgactagttcacataagaaattagtacccctttaagttcattatttgctcctcccatttatctcaaaataaattagtacccctttaagttcattatttgctcctcccatttataaaagtagcagatatatgtattaggatcggagcatataaaatgtagtataattttattaggatttgataaaaaagaggatatttgcggaaggaatagcatgttgcttctgaactttacatgcatgaacgttccccattaaattctcacatgttctatctgaaaattaaatgatatgtctcttgcaagaggaacattcttgggaagtttaccctgctagtgctagcacaacttttttttcaataatctttcaactcatcatgagtattatatttggcatatgcattttctttggacacccagaaagtgaatatatttctttgcatgcaggcagaaaagcacctccagatgagggttgaggcccaggagaaatacatgcggtccatgatggagaaagcacaccaagccctcgcatctggtgccacgtggcccgccgccaatgagcaggcgaagatctcacctccaggaaggaagtgagaggataaatctggatttttcacatttggttcttgtgaaaaacttatttcgcaaatagacccctaaaaaaacttatcccataaccgccgacgtggcggggcgatgctgaggtgactagggagagcgcgccagaatggctggcgccaccccccccccccgaattttttatttttcttttatgtttttgatatttttttcacgcttagggatacataagaaccaaacatagaaaaaataaactcaaatggacgtaatatgtaacccgtagaatttttttctctcctctcctctctctccgaactagtgcagaggagagagatgtgcaacttttttatttttatttttttttgatattttttcacacttaggaacttacaataaccaaccatataaaaaataaactcaaacggacgaaatatgtggcctgtggaa

SEQ ID NO: 45079 - DNA, 595 bp, Oryza sativa
cccccccacccctcacctccattcatgtttctctgtatggagttgcaacgatgttatttttgttttattttttcggatgttttttcacacttaggatcacgatacaaccaaccaccaaaaaaaatttcaactcgaactaccacttagctaagtctaccacttagtctactttgcaccttcactaaaattagaccataacttctttagtaaaaccttttgatcagcatgttaaacataggagagatcctttagtaaattagactatatgaaattacttacttaatctaattcaaaatataaccatataaaatgatagccataagttaaacagtatagagatgcaattttttatttttatttcattttttgatatttttttcacacttaggagaacataggaaccaaccatataaaaaataaactcaaacggacaaaatgtgacttgtagaattttccaaaactcaccgaaacggacaaaatatgtcatttattgaaataggcgtaactttctcatacggactcggaatcaggcaaataatatatccacggacatctacataaaaagttacacccgattctcccttgctttgccagg

SEQ ID NO: 45080 - DNA, 414 bp, Oryza sativa
agagaaaggagaaagagagagaatcaaagcacctaaaagcaacaaagagaggtgtagagagagagagagatgagaacatatcatcaagaaaagaagctaagagagatcaagtgatgtggtcgtcgccgtagcagcagtacagcttctctaccaacaccgtagtcctttctctcctcctccccctcccctcctcgttccgcgtgccgcgagaggatcgaaccctattcctttgttcttgaatctcttccaaatctgtaacagagagagagagagagggaggagatctagtgagtctagagagagagagaggttcttaagaggaggaggaaagctagctaggagaatagaatgttcccttcttcttctccttctccttctccttcctcctccaagaagcagcagcagctcagtggc

SEQ ID NO: 45081 - DNA, 1393 bp, Oryza sativa
aggaatctttgcttaattgtcaaagaagaaagcatctattccctctcgtgtaaagaaaacggcttgtccatccccctcatggaagagtaagctaggaacgattgagctagagcttaattgctttataatgttctcactcatcctctcccaaatgggcccctcaagccacaattttgaccaccattttttttgtttggatttgtatgtgtcataatgggatgcatgcttagtgacgtgtgcatgtatgggagacaatcttctattgtactaaagggagactactctcagtgagattgattgtaagctgctcacttttttgaccctttgtggcatcaatacctgtagacaatttgttcatcacattaatttgctttgaacaaatcatactagtgtgccaaaaaaaaacagaaatgaaatttatgtatagaaagttctttatttttttctttctgaaaaaacacactgtttagaagatcaaggagagtgtgcattcacctattcatcttttaagtagaaaaagagtagctagcagttccagcattatatatatgtaacatacaaaaggaaaaattgaaattgatggaaataaactaatttactaccaacaagttcaatatcaatttgctatttggttcagtcaactaatcatgcatgaacctgatcaattcttgacaacaattaatttgtttgatttaccaatatggagtatattactatcaatttatatgcaccagtgaatatctagctagccagttcttaaaaaaaattaagtgccacaagatggcaattaatggtttatggttgtaggaaccaaaccaaaactaaaaactaaagctgcctgactggttgtggttgattggtccccaatgcacactatataaactttagggttttttttttcagtgtatatgttgtgatgtctacttgggcaaccaaccattcccacggggctcaatgcaaatgcatgtctttttaattccctcacaatctgcaagccatcatttggatatgatggtgttttttgagtacactcctttttccatgactaattgcatgatgtgtctagatatatgcatatatattatagagtttgacccacatatatataacgatatgatgattggatgcactagtgataaaagacgaagtcatctcttgtttccactaatctagcttctctgttggcgcgcataattcagcttaattaggtcgacaattttagtgttaattcgtgtaaccggaggacataagaatgtggagtatgttgtatctcctggtaattaattaagtaggtaaaaaaatccttctcatagcatagcaataagaatatatatattgatagatgaacaatgcatgtggaattaataatgcttcttattaataggggtgaaaa

SEQ ID NO: 45082 - DNA, 243 bp, Oryza sativa
ggcgagcgcccccatccacacgcgggggtcccgatcatggcagcggaagtactaccggatatcttagtctatcccagctcgaagctgacatggcgatgacggggacggcgccctggaggtcgccgcttcgggcccctcctcctactccctcgcgcgggaataattcgcgcccccgcggcctcgtcccggcgcaatgccggccgtggccgcgtcccagcctcagttccgccgccgtcgcgtgcc

SEQ ID NO: 45083 - DNA, 1501 bp, Oryza sativa
agaatatcgagaaggatttggctggatttaatagggtggatcggtctttcgtaggttgaagacgacgtgtgtgtgagctgagcctgtggctccacttatgggccaggccaaagagagacatgcaatttattgctcagctcttaatagttattgtatcacagaaaaaacatttttacccattgcaatgcacagcaattctatacccatcctcccactgcccccatcctgattgccatccacccaggctgtctcgctcggctcctataaaccagcgaaaaaaaagatcgacaaaaaaaaaagaaaattgaggcgcctaagtagatcgaacatgtttcactaaaaagatcgaaaatgttttagtcttttaaaaagctgaaacacaacaaaatcagctcatgaaacattttggtacaacatatgaaacaacggtttctaaaaaatcgagcgttgtttcagtctatataaaaacaatgtttcaacaaatagcgaaagaatgtttcagttcactgcaacatttgatctacataagaaaacattatgagtacactagataaaacattttgtgtggaacaaaaaatgaaacagattcccttaatagagggtttccataatatgtgggtgatttgttgcaaatgaatatttcaattcactgcaacatttcgtccatacatagtaaaatatcatgagggtactagctgaaacattattggtggaaaaaaaataaaacggattcccttaatagggtgtttccgtaatatgtgggggatttgttgcaacggggcgtgagtggtggggacacgtgggaggcgaggcggaggcgcgcgtggaggaggagggtggcctgattttttttccaccgcatcgggcacccgatccccagcattttcagaaattatgcaaggacttaaaccatctttggtggggacccaggaaaataagtcattttagacattggcattgtctacatgcatggtactccctctagttccatattaattgacgttttagacaaggttgaggtcaaacttttattagtttgaccatcaataactttaaaaatatttagtttaaaggaactggaacaagatatatagatttgtctttgaaagtactataataaaagtaaacatgcatttatttattatatatattattatagaaaaataagatcaaattaagatgtaccttgtaaaccgtgtcattgttcaaaacgtcaattaaaatggaatcgaagggagtacagttttagccactaatttatatgtacaatatatatactgacctgatagaattacagtatttcataagatattttcaacacaaatatacaaatcaataccattcacgattcgattctttttttactatcgaaagtttgactaatgcgtgtccaaatgctactagacgagacagattataaacggatagatatcccttcgcttcttgtgtatcagtctcacataactgaaaacaaacctaacctccgacatgttggcctcta

SEQ ID NO: 45084 - DNA, 201 bp, Oryza sativa
agccgtgtggccattactactgatttatggacagcaactcatcaaaagaaaggatacatgttgaggagggtgttggaacttcagatggagttaatgcttcttcaagtgttgcccctccagggggatttgatttggtggatgatatatttgatcagtatatgtctggacaaactgttgcctcttcctcacagattcgcactg

SEQ ID NO: 45085 - DNA, 561 bp, Oryza sativa
ggatggcttatgtcttaatgtgatccgagtggcttttccaagcagagatgttgacctgcagaacatctcagaaggaacacacctatatgagttcgactgctagtcacattctatgaggtttgggcgatctctagatactcatgaaaggcctagagtttgacttatatgctccaaacagaggggatgcgaacggcagcccagtaccagtcaaggttctgagtaaaacctgatcacacaaacttacaattcaaggcatagtccattgttcagttgtggtctgatgtagctcatttcctaggtggaagttcaacttaacagtctccaccaaaaccctggtatctcaaacaggcacaacattgagaacatttcttatgagccttgaaatttggtggggattgttagaataattgggctaggcccaacttataatattaaatctcaaaggcccataataagtgttgaggataataataccaccttaggatttaagcgagaaatatctcaacctaaatagggagttattggaggctccctgttgaccagttgaggtgggggccggaa

SEQ ID NO: 45086 - DNA, 1501 bp, Oryza sativa
cgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagacgatttggcatgcattatataactactctgagtacagccaggccagtgtttgtcacatggctgatggctcagatatacttttatgtcatggacgttgctggtttgagcaagtcggatgattaatttgatcgatccgacggcagtatgcatatgatgatgtgataagccaactaccacagagaattattagtgaagagtttttcactagtgactcagtggtattattggcccagttcctactgtataagcgaggatttattcgaggaaagagggaccctatatcataccattacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgaggccatgaaaacatcagaccgagcagccccggatgacacctatccaaaccatgtaagcccaactaggccacggtagtacagtgcacatcctatattcagttaataaaggcgacagttgcggctcggcaccagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacctg

SEQ ID NO: 45087 - DNA, 1501 bp, Oryza sativa
ttttttgtctctttattttttcttttttccctcttttacatgtttgcactggtccgatcacacactgttgggttgtggtgccatgtggcccaactacatggagaggctcttcttcttatttttttcttttcaattcaccatcctaacttgcgagatgcacatggagcggctcttcttcaccatcctaacattgtctgttttatgatggtttcttacccgacgatctttccgctcttcttcttgtttttttcttttcaattcaccatcctaacttgcgagatgcacatggagcggctcttcttcaccatcctaagattgtctgttttatagatggtttcttacccgacgatctttccgccgcttgtatctcgccacgtgtcgctcaagtcaatcagctggcatgaaaccaatcaacaggagatagatagatgcaaaggggaaagatattttgtttgcttctcggtatttcttcttgtatgagtattctagatttatctcaaagaggatagataaatttttttataaatattctatatttatctaaaaaggatagataattgggaagtctctaggttgtgtcttttattttttgctacttttttatgtatagtttttttagatttatctcaaagtttaacactgccatgtggcctaatgggatggctcgagacgaccatctttagaaagatagattttaaaagttagagtaagtagcaaaatttggttaggtcagcagtgtcgctctatgcctcaattcaccatagtggttaggtctgcagtgtcgctctatgcctcaattcaccatagtagtaacagccagccaggacagaaactgcagcaatgaaaaaattaaaagaactcccaacgtctctcatgcctattttctaaggaaaaaagatcaatgcatcttttggtcccccaataaacgtctcacgaataaatgtctattttctgaagaagtcaccattagtaccaaatttcaaacattgcatttggggaagatctgaaaattgtcgtgctctcaagtttccctgcaatgtatgagagatacgagactgaagtcagaccagttggtatctaaaggtagccaagaactaaagaaattctacaaggttgattccaattcatgtgatgaacagattggagaggccctattgagacaaaatctcattaaaatgtacctgcaaaaagaacctctttgagaccgtaactgagtcgtgaggtacctgttacaatgttagtgacatacatggctttgtcaaaatcaaaccagattctgtaatacctgtggaaaataaaagaaatatagtttctaactttctatgcacactagctagcagcactacatgatatgctaacactcaagcacaaatgttagaaagtaaaagcaaaactgcgccgatgtaaaggctgcaacagagctcacttgattacatttaaatgtgtgatagcttatcgaaataagcaccttggtttgatggcaaggggataactagcaaga

SEQ ID NO: 45088 - DNA, 1202 bp, Oryza sativa
agccgtgcccgcggttatgggcgggttgagcaatgtttttcgtgattagtctcacacctctcacaataattatggatgctataactggtaataatttgcttagctcctggtttggagttagatctgtacagccgggtatggttgttcaggatggttgggcctgtgcagcatgggtatgctgttcagtgttgattaaaatttctgatcaattactccactgttttacttctcttaaatgttttgctaaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttgtcttatatcccagttgagctgcctgtgggagtggagccggagcttcgctagattttattttccgctgcagttttcttcttagtgaggactaagtgcctcttaagtaagtatttatcgttttagttaatttgatgaatctgtatattaaattgtcagtttgtgtacctcggctgattcctggacgaggattttatgcacaaatatgttcggaaataactagtgaatttccgggcgtgacaagttggtatcagagccatcttgactgtaggataagccaaatggtcaaaccttaaggactaattttccgaaaacatgatttgtgaaaattttcctttcttccttctctagaattctctataaatcattttttcatcctctcccctcctgctttcaactggagtagttctgaaactagttgttgaaacttgaagacgccaatgtggtctacttgtggaggttaagtcaagtggatcgatgaataagaaggtgatggtcgatctgaagtgcccagatgtcaagatggaatgaagtttggatcctaccttagaacctatgccgccaaagtgtccttggagaatagttagtagggtagaacgcttgttgcttgcttgtgtgtaggtatggttgcattcccgtcattggtgtgattaatgatgagtgtgtaactatactaggttgcttgcttaatcaacttgaacaatataatggtctacacacatcagatcagtgttaacctggttaaggtcttgtctttagtgtaacccctctccttctatcctctctaataagcaacaga

SEQ ID NO: 45089 - DNA, 372 bp, Oryza sativa
agccgtgcccgcggttatgggcgggttgagcaatgtttttcgtgattagtctcacacctctcacaataattatggatgctataactggtaataatttgcttagctcctggtttggagttagatctgtacagccgggtatggttgttcaggatggttgggcctgtgcagcatgggtatgctgttcagtgttgattaaaatttctgatcaattactccactgttttacttctcttaaatgttttgctaaaatgctgcttttgcaaatgagcctatattatgccatcctttggtatccttgtgcacttgcatatttgctgtgtggcttgctgagtatgtcatatgctcaccttgcaataatcaatcaacctcagt

SEQ ID NO: 45090 - DNA, 1501 bp, Oryza sativa
tgcccttattctgcgccagtacaccgtactgacagacacgttatcctgcacaacccaaccgttgtgtcgtacgtagttcttggctgcttctgccggggcactaggtcggccgtcttcgtccacttccgttatgatgtgttgaccctctagcttcttcgcggcaccttgttgtccgcgtgccctcttctgtcagcggagggttgacttccactagcctcctcctcctcgttcccctccacatccctctccacgttccccttctggttcctctccgcatccctctccatgttccattcctcgttcaagtactggtttggatcctcgttcccctcttctttgttccagtactggctgcttccctctgcgattgtatcgtacaatatctgttcctcatcgcaatcagccatctgttcatacaagaaatatttgctaagtctataggtcatatttgctttaacaatcatatatgctaacaatcatatatgctaagtctaagtgtcgtatattagacccctagataataattaaaactataccaatcttgtattaaaactctaacaatcatatatgctaagcctaagtgtcgtatattagaaccctagataatcatatatgctaagtctaattacaaatctaataatcttatattaaaactctaataatcttgtattaaaactctaataatcttatattaaaaatctaatagtcttatataattagtcctatattaaaaatctaataatcttatattaaaactctaacaatcacatatgctaagtctaagtgtcgtatattagaactccaataatcatatatgctaagtctaagtgtcgtacattagaaccctagataatcatatatgctatgtctaagtgtcgtatattaaatctaatagtcttatattattagtcctatattacaaatctaataatcttatattaaaactctaacagtcatatatgctaagtctaagtgtcgtatattagaactgaaataatcatatatgctaagtctaagtgtcgtacattagaaccctagataatcatatatgctatgtctaagtgtcgtatattaaatctaatagtcttatattattagtcctatattacaaatctaataatcttatattaaaactctaacaatcatatatgctaagtctaagtgtcatatattagaattcaaataatcatatatgctacacattagaaccctagataatcatatatgctatgtctaagtgtcgtatattaaatttaatagtcctaattatattaaaaatctaacaatcatatatttacatcacttgcctgcgcgaattctgtcacaccctaaaaatcctaaatatataaattgttgtttaaatggaattattagaatttattttaaaagcctagaagagaagatctaattttaattaataaattccaacataaaatggggccagttaaaatttcattaaatactttgcttaattctataattcctagatttttctgggatt

SEQ ID NO: 45091 - DNA, 1501 bp, Oryza sativa
gacaatgtcgaggaccagacttatgtatgaatgggctaaaaactcagaattgacacaacgaattgggccaaaattcacaagtctatggagtggagcaatagaggaggccaccagccgaaattgggctggattgggccagccccaggttcggcagaacctggtggttcggttgaactaatcctggcgccgttggatgcaggttttggcgtggacgtctaggattgcatcctaatgacggttggagggcagggcacttcggacaattccccttccacaaccgtcatacctacctctatataaggagctcactctcttcacttcaacacacacctcaagcaagagctctcttatttctctcaagtttagtttagtagtatctagctagtggaatagaattagaataggaatcaggagtccagaaaccttcggaagagttcgagtatggctctagtagctttcctttcctcttttgtaagctttgtacatttattagagtactcttctaaatacatttctggtattgaaatactttccgagtatatgagtacctactttacattatgttcatgttatactgaatatactgctagcttatctcggagatgctttagtgcaggtatagtgtttgcttatgcaattactctatgtcatgacgatgatattagagtagtatctggtagtttagcgtggtgtctagattatgggatatcattatccggggttatatattgcggatgagaggtgggccgctgatggtgacagctcagtacgggtattcctccgcgcctatatataatcctaagttaatttcctagggagggtattcctccgtatttagccccggttggatggttatgatgggctgtcgtaaggaactcggcagtcaggggtggcttctcgaagtaccaggagggcatcggatagagggtattagctagtatatcagttaactagaatatatgtatactatgaatattagaagtataggaatatattctctttctattttctttccaactagcttagattatttattatgaggatgagtagaaatgcttgtgtgtcactctacccttggattatcttaacccctgcttagaatatgattatcacaagtaatatataaattattagttgagttctctctacatgatcttcccacaagataaaataaatacgatacgcttggaatactctcgggtgaaatgctacaatggtatatccgtgcgcttgcggatgaactctgtaaccataagataccagaagtatttctgcgtcattgctgggaattatatttctagtaatgtcgttaagaaataccaacagtcgccacctttgagtggtttgacgggcacatctcaggctggagttgactggcaggctaaaggcccagcaatgtctccaatattcctctcttgaggcgtcagatatttcattatgcttgtttgatgacttgaattattcatttcatccctcaattataatggaaggtccgtagagc

SEQ ID NO: 45092 - DNA, 1501 bp, Oryza sativa
catttgcaaaagcagcatttaataaacatttcagaatttaataaaacaattaagtaataattaaacaatattaatccaacgctatacaacataccctgttgtataggcccaacctttctgaacaaccatacccagctgtacagatctatctccaaaccaggaatataccattccaaaccaggagctaaacaaattattaccagttatagcatcatttactaaggtgagaggtgtgagactaatcgcgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcattgactccccagcgacgcctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttgattgtcatgagcactactctcaaaaccatgtgctcacaacccaccattatcaggttttaattggcacattaattaattaaccaatcacgattgaccatcgtgagctatcgttaagccatcattaaataatagtgagtcataagttatcccaatagtgtgctaatgtttctaagcatggctaagcaatcatatctaatatctagctgaaccaatatataaagcccaactagtcaagttaaaataacccaaggtatcaaggaataaagtaatcaagaacaaaagggctataacaaacaataggttaattccacccaatgacattcgaaaataaatgcaatagttgaatgaaaacaatagctttaaacgggatcaacatgctcaaagggttgtttgggatctgtgtgacttgccttgctggccttggaattcttcaaattcttttcctgcaaaaacagactctccggaaacgtcggaatctaaacaggaaagagcaaaatcaccagaacagcacataaacaagcatgaacagtacatgtggatatttttaacatgtagatctcaattttagaaaaatttagagacttgaaccaactaaatccaagctaagatgaattagttatgaattttcaaagattaaatcgaattaaaacagttatattgattttaattgaattatgacgcaataatgaattatttttgaaaaggaaaaagggatttattgtgtcagcggctagggttttcggtggaccgggcgcacggcggcggttcacggaaacgaacggccgagatcgatcttatccaaaacggacggccgagatcgatcggtccacgaccggtctacgacagacggcaacgatgacgtcagcgg

SEQ ID NO: 45093 - DNA, 1501 bp, Oryza sativa
gatccgattcgacctcgaatccacgaacttccaaagcgatttagacgatgattccaaaagagaaaaggtagaggagatcccgaagattgtttcccctcaaacgatttcaccggatcgggaaagacgcggccgaattggaaagcggcggcggcggacgcgacgctagggtttcgggcggcggccgacgcgaggaagacgacgactctgacaggcgggacccacctgtcagcgacggtcgcacgagcgcgcgcggctgcggactgggccgacttgggccggggagagagagaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttaactggccccattttatgttggaatttattaattaaaattagatcttctcttctaggcttttaaaataaattctaataattccatttaaacaacaatttatatatttaggatttttagggtgtgacagaattcgcgcaggcaagtgatgtaaatatatgattgttagatttttaatataattaggactattaaatttaatatacgacacttagacatagcatatatgattatctagggttctaatgtgtagcatatatgattatttgaattctaatatatgacacttagacttagcatatatgattgttagagttttaatataagattattagatttgtaatataggactaataatataagactattagatttaatatacgacacttagacatagcatatatgattatctagggttctaatgtacgacacttagacttagcatatatgattatttcagttctaatatacgacacttagacttagcatatatgactgttagagttttaatataagattattagatttgtaatataggactaataatataagactattagatttaatatacgacacttagacatagcatatatgattatctagggttctaatgtacgacacttagacttagcatatatgattattggagttctaatatacgacacttagacttagcatatgtgattgttagagttttaatataagattattagatttttaatataggactaattatataagactattagatttttaatataagattattagagttttaatacaagattattagagttttaatataagattattagatttgtaattagacttagcatatatgattatctagggttctaatatacgacacttaggcttagcatatatgattgttagagttttaatacaagattggtatagttttaattattatctaggggtctaatatacgacacttagacttagcatatatgattgttagcatatatgattgttaaagcaaatatgacctatagacttagcaaatatttcttgtatgaacaga

SEQ ID NO: 45094 - DNA, 478 bp, Oryza sativa
tggatagaaattccgggcgtgacaagttggtatcagagccaccttgaccttaggataagccaaatggtaaaccttaagtagccttcaaaatattttgaaaaaaaatagtaactgctcttctctattctcttataaattaattaagttggcagcacatgcaaggtaagcacaaaatttattgaaattcaatttcttttcttttaaaagcaaaaagttgttcttcccaaaatgtttctttctttctctttaccaaattttattgattagtccgcactgtacatctattatggtatcgatacaatcatgatagcactagtactactcatctttcttgtggtgacactgtaccgtgctcaaattaaatcataagtattttaattttattttcttcctttttggtcaaaaatcagttaaatcaagttggtgcagctaacttagaaaaatatgcattaattcctctcttctatgtttccttaga

SEQ ID NO: 45095 - DNA, 1501 bp, Oryza sativa
  unsure (1)..(1501): unsure at all n locations
atcggggttcggaggaaagagaccgatccgattcgacctcgaatccacgaacttccaaagcgaaaaagacgacgattccataagagaaaagatagagtggatcgcggagattgtttcccctcaatcgattcggccggagaagaaaaggagcgaccgaatttgaaaagcggcggcgccggcccagcgctagggtttcgggcgncgncgncggcgcgagaaaaattaacctgacaggtgggtcccacctgtcagcgacagagagagagaggatagcggcggctcggcggactgggccgactgggccggggagggagagagaaagagaggttttgggccggctttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagctcttaacaattatgattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacgaaaatcacgatgtgacaaatctaccccccttacaaagaatctcgtcccgagattcggaacggctagaaagaaaagggcataggtaaactgcagtctatcttattccataactccgataattattctaaggctttaaagaaaactactgccgctttgaaactggtggctgagttgtaacacttgaagacacaactcttgaagacgcaactggcactgcattggctcctgtgacaacaatgttgttaacctgaccttgcggctgctgatgcttcggcttcggacactctcttgcaaagtggcctggcttgtaacagttgaaacatacctgctgctcccttccactactgttattctcttgagactgaccttgctgaactagcaccggctgattagcttgctcgatgttaacttctttgctttcattagtctctaatttgatctcaccaccgatgttcaactgttgcgactgtcctggaccagcgggaaaagattcaccaatttggagtggcttgatacgctgcctctggctactaccttgtgcctcctggaatacagtcattttccttttacggttatccatcctattcttcttgtcttcaagtcgaattgctttgtca

SEQ ID NO: 45096 - DNA, 465 bp, Oryza sativa
ggaacccccgggacaggcaggcagaactgagcccctagcagcatgtcacgccctaaaaatgactaaattaaaaatgcatattttaaatcatttcttagaaattattttaaaagcctacaagctaaaccctaattttctaggaaaatttttaacataaaaatgagctagataaaattttattaaatactatgcttgctcctctattttctagaattttctgggaattatttgagtaagggaagtatttttaataattgaaacaacatttcacaaattgttttattttaaaaagttcaaaaaaatccccctccttggtcgttgggccgaattcggcccaacatctccctcctctcccgcggccgaaccggcccaagccggcccagctgccgccgccgcccgctcccctctatcgtggaggccgacaggtggggcccacctgtcggatccatcccctacctccggccg

SEQ ID NO: 45097 - DNA, 1501 bp, Oryza sativa
cggtgaacttattcctaggtaggataaggtgggaagggagatgggccgtgggctattaacacaggatgaaatgggccgcgcgtgttttatcagttgtgcttgtctccagtgttgggcaacaagtatcaccggaacccggatgcaatcatgcaaaaagtgcgtgacgcgaactgtgccttagctggtcactcttgtcctggagcttcacatgctgcaagagtctgcagaatgcatgcatttggcctgccgacgcgctcgatcggatatttttgccaaccaattcacgcacaccaacaactaattataacaattactcactccgtcctaaaatataaatatttttaacttaatgacaagtcaaatattttaattatcattaagcaaactatcataatatataattaatttttgtttaaaacatcttacttttataaatattggtggtcaaagtagtatctcatagactgtgtcagggtcaaaaatagtaagattttgaaacggagggagtataattaattatcacttgtagcatataactaacagcatgtctccgtggagcatatataactatagttcattaaccttgatcgagacactcttcacgaatagtattatcaacaactaattatagctactgcatttcaagttagtaatatataactagaagcatgtctcagtggatcaagcaagcagacatagtattccctagctagctaacgggagggcgggcggcacgtaagcacccgaagaagagtgatgaagctgcaactcccgcccgtggagaaaccaactttggtcggcggctacaacgcgtatatgtgatcttttagtccccgttggtaacatcaactggaactaaagatcatctttagtcccggttgtagagatgtcagatgttgtcagggcccccgggatctttagtcccggttgttgttactaacaggggctaaagatccgatctttagccccagttggttggtaacaccaagggaataaagatcccccccgtatatatgccttcttccttctctagcccgagagcaagcttaaatttctcaaagaaagaggaggtcatgccaaaatttattgtgaaaattttttagtaattatatacaaatcggatatgtctaaaaggttagtaacttcatcctccaatattttttttcttgttatattacttttggagctatgtttcacacatttttttttctacaaaactttgttgtaagttgatgagagagaaaatttatgtggggaagaagaatatatagaaattttattctcatagtttaaaatatgatgaaaattaatcttaaaaaatagaaaacaaactaaattgaaaattaagagaagtacaacattaatattagtttagaacttcaaaaattgttaataagaattgctcgtcgaaagagttttaaattattttatcattactgtttgactgtcattattgtatcaaaatttatttatgtatgatttttttttcatttcatgtaga

SEQ ID NO: 45098 - DNA, 234 bp, Oryza sativa
ggatataataaaaacgtctcaaaactcatttctacacatgagatgttccaaaaacgtctcaatattcatctctaaacgatttaattttgtgctaacctgtaaagcgtcttaaactatatcctcaactaataaagcgtctcaaacatcgtccctattttaatttcacttataaaaaagagacgacttatagaatgacttaagtgaaacgtcttaaaacaatggttttgttgtagt

SEQ ID NO: 45099 - DNA, 1501 bp, Oryza sativa
tttgcttgtgtgtgggtcttgcatgtgatttacatcagtggtaggatgtaagtgcatgcgtttgtttgttttttttgagtgttaggaagttggtgagtttagtggtgtgagagtcttcagtttgtaataatgaaactcagttaagatcaataaaagttaaagtaattccctgtcctaagtagttttcccccggtttctcttcttgtgccctgtccatgccagatggtgaacactcgcagcaacgggaatggtcccaaccccaacaaccccaataacaataacaatggggagaatccaacccttgctcaagttcttgctcaacagactcagctaatgcacatgatgatgcaacaacttcagaaccagcagaaccagggaaataaccatgcacctcctcagaataagttagcagaatttcttcgtgtgaggccgcctattttctctagtaccactaatcctgttgaagctagtgattggttgcatgccttagagaagaagttggatttgcttcagtgcactgatcaggagaaggtctcatttgcatcacatcagttgcatggccctgcctctgaatggtgggatcacttccgtctgaataggactactgctgaacctatcacttggcttgaattcaccgctgcttttcggaagacgcatataccatcgggagtggtgtctctcaagaagaaggagttcaggtcgctcacccagggatctcgctctgttacggagtatctgcacgagttcaatcgtctggctcgttatgctccagaagatgtgcgcaatgatgaagagcgtcaggagaagttcttggaaggacttaatgatgagctttcttacccactcatgactggagattattctgatttccagaaattagtggataaggctattcgtcaggaggacaagtataatcgcatggagcagaagaaacgccggattgctcaattcaagatacaacaggggaataatcagaagccgcgtcttattttaggacaccagtctatgccacatggaggttcttcgtctgttgttcgtccgcagcgtcagttcttcaacaacaatgctggcaacaacaaccgcaatcaagctccacgccttattgcagcctcgacacagcaacaacctgccaagagggagcaaggcagcaagcttgtggtgtgtttcaactgtggagacccaggacattatgctgacaagtgtccgaagccccgacgcgtgaaggttgtccctgcccagagcaactctaccgcaccagtatcaaaggcccgtgtcaatcatgttgctgctgcagaagctcaagatgctctagatgtgattttgggtacgttccctgttaactcagttcctgcaacagtacttttcgattctggtgctacacattcattcttatctatgagttttgcgggaaatcatgggatggaagtagaggatcttagacgtcctttgatggttagtaccccaagtaatcaagcactttctttgcaacgtagcccctcgg

SEQ ID NO: 45100 - DNA, 299 bp, Oryza sativa
agggggacgcgggccagcacggccgtgggcagcggcggctgctgctggtgacggcgtcgtcgtcgtcactacgtctttatatttatatttatatacatgtgggacccaccttgaataacaattacctgctttctgcttttggttggtccaaccttacttacttactacttggtaaggatacattgttgatgccctaagatatctcctcctgacatgacatatatatagatagataaactcagccgccctagagacaagctagagaacaaccaagacagcaatgtccatggcgtctctcc

SEQ ID NO: 45101 - DNA, 613 bp, Oryza sativa
tgctgttctaccaaaatttagcatttcaaaagtttcttcttatataaacactaccaaattttgatagggctacaaactaaatgcaactaatgctatgaaaatttgacaacattaaaatgtgccaaaatttggtaacgctaaatatcggttaggttgatttcagcaaaaactgaagaagctctaagcactaaatcatcagtaagaaagtttattaatgctgctcccatcaagacggagctcagacgtatccgtactgagataccacaagttcacataaggcagaagccacggactctggattctggaacggtctcggtcgttccggatcggatgggtacgtatgtcgccctcagaaagatgatgacactgactgttgcatttgccaagagccaatgggttgcgtttgcgtccccaaactttcacaaaaacggcagtcctcatccatccctagagtttaattcttttttgggactgagggtgtagccttcctggtgagaaatgaaagtactactggtacaagcaactagaacggggagcatatggaagccgtcgtgaagttgccccggttcctactagctctctctctctctctctctcctgtttccggtgcagg

SEQ ID NO: 45102 - DNA, 391 bp, Oryza sativa
acacataaagtactattcatgttttatcatctaatagcaatataaatactaatcataaacaattttcaaataagacggacggtcaaacgttgaacgtgaatagtgcaaaactgcacttattttgggacggagggagtattagatatcttaaaggtgctggattagctgccctcctagcgatttgggaagccagcgcccactgcgacatcgacatgtcataacaagcaaaaaaaatttaataagcgttagattaactgcaggccccgccgacccactcattgatttttgcagaaatcccctcattatttcggtatttccagtcgagtccactgaatcagagccgttcaaccccacgcgtggacacaatctgaccattcgtctcctatctaga

SEQ ID NO: 45103 - DNA, 1501 bp, Oryza sativa
tccctccgtctcattttaaccgcagttatgaatttctatgtccaacatttaaccgtctgttttattttaaaaaattaaaacctatatatcaagagaagctcaaaattgttaatgtgacttagtggttcccattgaatttggactctatatctacctgggtgaaaactcaacttatatataaatttgtttgcggtaataatttgtttgaaatttattatttttatatctcacaaataaagttgaggttagataatattttttataatattgtgtaacatcaacttatctatatgtgcgattctttttataatttaggtgaccttttagttaggatttccaacggatatttaccctattttacctttacatttacatgttatctcccctctctatctctctctctacttagaaatgcagaactacaaatctcgaaacatggccggttactaccggtatttgtgcttatttcgtttcatggaagcgagcatctgtcttgtgtcctatgcctcctgtctagcacatatatatgttgccctttgcaaaggaaagtttgtttaaattcttttctgctctcgagaaaggattcaaagtaaaatccaaagtaggttcccttctaggggtccatacgggacggaaacaaaatgatatgtatttttcattctcgaaaagagaaaactaaagaatttgagtttctactctagcattggatacccgtaggaacatgacaagttttgggtttgatgcatgttggagcattttgtagtattgtactcctagctactccctccgtcccataaaaaactaacttctggctacgaacctagacgtagtgtgtgtccagattcataaccagaagttgattttttctgggacggagggagtagctaagagcgctactatgtatcatttggctagtacaaatgtcaaagggttggctccacatttcatggcgaaattaaaacactatccctattatccgaaggtcatagtatttgtcgatgacatgggaccgggagtatcatgactagaggcttgggcaggagcaatcacccacgtggcctgaccccctcggggggtcgggcccgagggtgatgtgaccgcccctctctttgtctccccgagggatcggaccgctcccgtttcggccccgagggccgaggcgcgccccgaccccttgtgggttttgcgtcgcgtatgggttaggtgagcacagcggggctcacctaaccgcatttattgtggtttgaacgagcgcgtcacgccgcatgtaacgcagtgcagcgcgctcgtttatccggtctgtgaccggtcacagaccgatcagatcgcgggttaggtggcaacaggcggtctgacacacgcctcgccccatcccgtcaggatgagagcctccaggcactcgtccctagccggagccagcgtgctagctcctgaagatggcacgttggtcccggtcagatatatgccaggcttcatcccaaccattacaagcaagacattg

SEQ ID NO: 45104 - DNA, 1501 bp, Oryza sativa
accggctctctctctcctccctcccgcgcgcgcgcgccttgggccgccttgggccggccggcccatttagctcggccggaccgctccatttctctcgggccgcgccctagccgcccgagaaaagtctattgtccctccctcttttcttttcttttcttttcttttctaaaaaggatttaattaaatccttttcctttagaccaaaaatccaataatcttagaaattcaatatccttccaaccgtaagtccgtttgactccgttcaacttccaaaattcctcaaatctcgagatctatctaatggcacgcttagaggtcattaatagggctttattttcaccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagatcggcggacctacctaatttgttgcatttgatccttcctttgctaattgatataccatgtccccttgtaaccatctagttgcgtcccgatattcgtgcaccctgtgcgagtatcgacggacgccttcaaacttaaaattctgagtaacttcttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtcatgggcggatgtgaggtgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgatttc

SEQ ID NO: 45105 - DNA, 281 bp, Oryza sativa
tttggatcctagagatattttttagcccaccccttttagccccaaaatagcttaaggggatccaaacaggaggaagtttacatcttgtagacacgtggtgtgactgttgtttctttttttcctctatttataactttttagggctatggtcttgtaattttttaatgctatatcaatatgaaatctcacatggttcgtttcaaaacgccaagtaataatgatcatagttgcattaaaaaaaccttttctagatgatgcttattgtggagttaattaatgga

SEQ ID NO: 45106 - DNA, 242 bp, Oryza sativa
ttttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgataga

SEQ ID NO: 45107 - DNA, 1501 bp, Oryza sativa
attttatacagaaagtatcaagttttagttaatgtaaatcaaattaatgatttttttagcacactggaatttggttcactccaaattaagttaagatgaattttatatgaattttctaagttggagattgctctaggacgtgactacacagcactccacatgtagctgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaatccttaaattataaattgttgtttaaaaggaattattagaaatgattttaaaagcttaaaagagaagatctaattttaatttgctaaatctcaacataaaattgggccagataaaattttgttaaatactttgcttaattctataattcctagatttttctgggatttatttgagctaaggaagtatttttaataaatggaattgcatttaagaaataattttaattgaaaaaggtttttaaaagtctgttttggctttgggccgaaagtcggcccaaaacctctctctttcttctctctctccccggcccagtcggctcaagtcggcccgcagcccagtccgccgagccgccgctctcctctctctctctcgctgtcgctgacaggtggggcccgcctgtcggacccgtcgtcttcctcgcgtcggccgccgcccgaaaccctagccgagccgcgccgccgtctccttccaaattcggccgcgtctttccatctccggccgaatcgtttgaggggaaatgatcttctcgatctcctcttccttttctcttttggaatcatcgtctttttcggtttggaaatccgtggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgtcggaagcgctctagcgccgtgtaacctagcgccgccgtcgtcgccgtcgctccagccgtgcgtcgccgccgttccagtcgccgtcgtcactcgggaaggccatcgtcgggatcgccaagttgccaccgtcctcgtccgccccttcgccgtcgccgaagatcgccggagcaccatcgccgccgttgacccgaaggccgccgccgcttcaacctcgtcgccgtcgccgtccgttgcttctccgccgcttctttggtcaccggtgagttcgccgcgtcgtcctctatccgttggtgcct

SEQ ID NO: 45108 - DNA, 514 bp, Oryza sativa
ccgatggcaatccatgaaaaaactaaaggaacaaagataaatcaacagaatattaagaaattagctccaaaaatacatgatggccatcttaattcaggccttgccacatggaattattcattgaaaaattagcatccttaaaaattgccacaatcatcaaataggtttcgtagggaaatcaaaactcattcaaccgcatgattgtctagggtgaactgaatttttgcctcaaattattacccccccttccccccccacaaaaaaaaagcgccctaaaggcatatcatcgagcactaggggagcaatggcaccattgtacctctcaggagccacagaatttttgcggtggagcgacgacgacacgacaggaggagcgcggcacgtgcaggggggtgggggaggggagcacggccgggatggaactccgcgagagaaaaccttgacgactccgggagtgctcccggttctgccgccccctgatttttctgatgatatccgggtggactgctcacga

SEQ ID NO: 45109 - DNA, 957 bp, Oryza sativa
tactctactgttttacttatcttaaatctttgctaaatgctgcttttgcaaatgagcctatattatgccatcctttggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagacagttaattccgctgctattttcttttctttgtaagtatgtaacgttattattaagatggatttgtatattaaattgtcagtttgtgtacctcggctgattcctggacgaggattttatgcacaaattagttcggaaattactagtgaattttcgggcgtgacaagttggtatcagagccatctcgactgtaggataagccaaatggtcaaactttaaggacgaatttttccaacaaaaatgatttgtgaaaatttctcctttcttccttatctagaattctttgcaaattgtttcattgtctactctcctctctcgttcaacttgagtagttctgaaactagttgttgaaactagaagatgttgatgaggtcaacttatagaggtcagtaaagtggatcgaggaagaaccgaagtgccaagtggtcaagatggaatgaagtttggatcctaccttagaacctatgccgctaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaaactggttaaggtcttgtctttagtgtaacccctctccttctatcttctctaatatgcaacaga

SEQ ID NO: 45110 - DNA, 1501 bp, Oryza sativa
gcccccttgaccctaggttatgccaaatggttacccatagaagccctctaaaaatattggaaaagtagaactgttctcctccctttctcttttaattaaaccaaactaatggcacatgcatttcataatctcttttaatggttctcatttaaaatttattccagtgttattagtactgtacatctattactatactaatggctcattttccagcaaaagttttacaatgttgtttcatttaatcttgctgcaataaaataaatttagcaagttgattttataactttcttttatttcttttggaacctgttattcaaaagtataaaacttgtaatattgtttctgacttttccaacttatcttgcaaacttggtttactttatttatttaccttttactttgaatttctaaaattaatccaaaaacttgtgctattaattggatagatgtcttaactccctcctttcacttgtctttagatgccgcgctacaagcctgagtacttgtttggtgttgagggttttgtccaggagttgcgtacaatgtcctttgtcgttggatttgggactgcccctttttatgcccagattcctcatgatcgtcatgaagagaagtgccgagtcaaagtcaccttgaacagtaatagtgaagatatcccatcggtgatgttcgaagctggaggaagaaactacatccattcatgtcaggaagtggcaaggatcgccataggagagctccgtgatcgttacagtgatcagttggctgacactgagtatcgttaccatcctcgtcaaccacagggaagtgaccgtggcagttaccttgagactgaaggaattgagaatgatgctaccacaacacatttggttgagatgctatgggctatggatgaaagtcgtgcggaaactgtgttagcggcccaagatcgtgaagattggaatcgtggtaagatttgcaagctagaagacaaggtggatcgtttggagaaggaactagccgcgttgaagggagaagcaccacctcagaaggtcaggattcgtcttaccgcaaggaagagagctctatttgtccctcgctatcaattggcgccaaaggtccgtgtggtggagaaagaagttgccccagcagatcctccggtcgtcaacgtaagtgatgaagaagaagaagaacccaagcacactcatccaagattgagtgggtagctacccaagatgatgaagacgagccgaacgagccttcaatcgacctccgatgctcggaagaactagagtgacttgttaagtcgttgtcttagattgttgtgttagtttgcttgttttaagtttgcttgtgtgtgggtcttgcatgtgatttacatcagtggtaggatgtaagtgcatgcgtttgtttgttttttttgagtgttaggaagttggtgagtttagtggtgtgagagtcttcagtttgtaataatgaaactcagttaagatcaataaaagttaaagtaattccctgtcctaag

SEQ ID NO: 45111 - DNA, 1120 bp, Oryza sativa
cgtgattagtctcacccttctcaccataatagaagatgctataactggtaaaacttgattagctcctagtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtgaagtggagccgtctgcgctgtttatctttttccgctgcttagatctttattgattgagaggaactatctacctctgtaatgatattttatacgcttaataattagagtaataactatactctattatcaatttgttattgtgtgcctcggctgattcctggacgagggtttacacacatgtaagcgtttggaattttggatagaaattccgggcatgacaagttggtatcagagcccccttgaccctaggttatgccaaatggttacccatagaagccctctaaaaatattggaaaagtagaactgttctcctccctttctcttttaattaaaccaaactaatggcacatgcatttcataatctcttttaatggttctcatttaaaatttattccagtgttattagtactgtacatctattactatactaatggctcattttccagcaaaagttttacaatgttgtttcatttaatcttgctgcaataaaataaatttagcaagttgattttataactttcttttatttcttttggaacctgttattcaaaagtataaaacttgtaatattgtttctgacttttccaacttatcttgcaaacttggtttactttatttatttaccttttactttgaatttctaaaattaatccaaaaacttgtgctattaattggatagatgtcttaactccctcctttcacttgtctttaga

SEQ ID NO: 45112 - DNA, 854 bp, Oryza sativa
ttggatatgagcatgatttgccaagggatttaacgagtgaagggcgaggtcggttatgtctggtacccgagagttttcactccctctgttatttttttatttatcgtttaatttgcagatcgacaaatcgtttaattcacgtgtttgatcagtatatttttacgtgataaaaaagacattttaaacacagaattactaaactgctttttgaggtctgtcttccactcttcatacatgatgactacgtattgtgagtcagaaatatcttttggttttcggtcgaagcccagggcggtccatcgaaaaaagctgggccatggtcttgattcttttttgggctgttctgctcctgcacgatttgagtcttggccaacacaggctacggccattttaggtctctcaattaaggctacatccatagtccattttaggaggtttttacctgtatgccattaagaaagatggtgcttgtctctgtgccactaaaaagttcgagcctccctctatgccatcgttgaactttactgcgctctccacaccattccgtcactattttgttaaggttcacctatttggcagctctgacatgtgggggctcgcgtgtgggagggtaaccaaggacagcctaccaaaccctctctacctcatccaccaccacgtccaatccttcggtccttccaccctatccgtgaggacaagctcggccgccgcgtccccgccatcaacgcggtaccggcgacggaggagccagccgacaacgcagcgatgctccatccgttgtagcatcctctcaccaagctcacgccgccgtggcgcccagaagctgctaccagcgctaactttccccaccacca

SEQ ID NO: 45113 - DNA, 1501 bp, Oryza sativa
aggaggcacgggagaggacgggagttggggcaaacgaaagaggaggactagggggtcctagttatagccttggattgaagagatcggactcctcctacaagaaatcgatccgggaaatcaaaaactcggttttggagataaactcaaaaacgagttcgattcggataaaatactcaacgattagctccgatttttgggggtaaagatagaggaggataagaggaatatttcccctcaactaatttggaaagaggagcaacgaggaggccggatttggaaggaggagcggcacggctgcacaggctcgggacggctcggctctgtccaggggttgaagacaacactgtagcgagagggaggacaaacagacttctatgcgggctgagaggaagggacagaatgggctggattcggcccaagctgagtaggaggatttttattacttttccaattaaattaatcaatgaaatgatctttgaattgttaaaaatacttcctatgcccaaataattccaagaaaaatcttgaaaatacttggacactcaaagtacttaacaaaattataatcagaccatttaatgattaatttaatatgtggattattactgaaatgttctttgtattattaaaattaggaattgagctccgaaaaatccgagaatattccagagagtataattaaccatggagaatttaaaaaaaaaaatccatccatgctttatatttaggaaattttatttcccacatttaacttcacttgtaaattaatgaacatttaatataaattctaataataatttattaaataatttataaatcctaaaacgaaaatcagggtgtgacaaatctaccccccttacaaagaatctcgtcccgagattcggaacggctagaaagaaaagggcataggtaaactgcattctatcttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttgtcttcggacactctcttgcaaagtggcctggcttgtaacagttgaaacatacctgctgctcccttccactactgttattctcttgagactgatcctgctgaactggcactaattgagtagcttgctcaacattatcttcattgctttccttagtctctgatttgatctcaccaccgatgttcaactgttgcgactgtccttgaccagcggaagaagattcactaatttggagtggcatgatacgctgcctctggctactaccttgtgcctcctggaaaacagtcattttcctttttcggttatccatcctgttcttcttgtcttcaagtcgaattgctttgtcaaccagctgctgaaaatcaacatagtcatgggagatcaacgtaactgacagttcatccttc

SEQ ID NO: 45114 - DNA, 1501 bp, Oryza sativa
tgtcttcggacactctcttgcaaagtggcctggcttgtaacagttgaaacatacctgctgctcccttccactactgttattctcttgagactgatcctgctgaactggcactaattgagtagcttgctcaacattatcttcattgctttccttagtctctgatttgatctcaccaccgatgttcaactgttgcgactgtccttgaccagcggaagaagattcactaatttggagtggcatgatacgctgcctctggctactaccttgtgcctcctggaaaacagtcattttcctttttcggttatccatcctgttcttcttgtcttcaagtcgaattgctttgtcaaccagctgctgaaaatcaacatagtcatgggagatcaacgtaactgacagttcatccttcagaccttacaagaacttctcctgcctttcctcgtcagtacgcacatcttctggagcataacgtgccagacgattgaactcatgaagatactctgccacggtatgatccttttgcttcaaagccctaaactcacgcttcttcaaagcaacaactcctacaggtatgtgtgtcttcttgaatgcttccgtgaacttagcccaagtgattggttgtccttctgctctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacctccacttccacttccacttctggtgcgcgtgttcaccatctgttgcatattagagaagatagaaggagaggggttacactaaagacaagaccttaaccagtttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttagcggcataggttctaaggtaggatccaaacttcattccatcttgaccacttggcacttcggttcttcctcgatccactttactgacctctataagttgacctcatcaacatcttctagtttcaacaactagtttcagaactactcaagttgaacgagagaggagagtagacaatgaaacaatttgcaaagaattctagataaggaagaaaggagaaattttcacaaatcatttttgttggaaaaattcgtcctta

SEQ ID NO: 45115 - DNA, 1501 bp, Oryza sativa
cccctgccatgtcgaacaaacctcacgttccacttttttgtattctcgctttgaagagtacgctgtggaacctccgaagatgtgcgagacatgaagatcggaatctggatacgccgagtccgagtcctgagtggttgcctcagtggccttctcaactacacgtactcgcttgcccttctccaaagccagctgctttgccaacgactttttgaagatgaggcactcctccagagaatgtttgtccgacttgtgtatggggcaccatattctcttcgtatcactgccttgtgggtctgggtgtttgggcgggcgcttgtattcagacacgaggacttccgcttgagctttcctcttcccactcttgccgcttttcttcttgcttgattcgggtgtgtccttggctggcttcttctctcctcccgcctttgactcgtcgttcttgcgtctcactgcgtcgtctgcatgggcgcatcgatcgacaacctcaaacaaacttcgagtcgttgtgattcgccttgttgccaactcctgggtagtatagcgatctctgacaccggttttgaaagcacgaatcacagaagcatcggtgatatcggggatcgtatttctgcactcattaaagcgccgaacaacacgtgtaaatcgtcttcgatcgcgtggcgcttgtaagttccctggaagttagcgacgaattgctaccacaaatctgcccatgaagagatcgagtagggtgggaggtgcatcagccacgaacgcgcagaacctttcaacgccgttggcaaatagtttgctaacgcgttgtcgtctgccccagcagcgtatagtaccgtggagtagacctggaggaattcttcagggtcagtactcccatcgtacttctctattgctccgggtcggaatctctcgggccatcggacatcacgtagagaacggttgaaagctctacacccagtgcagggggcggtgggttgtcggcgattgtgtgtcctccgtggatgtctatcggatgacgaagatgaagatgatgacgatgatgacggtggttcactcggctccggtgtgcgattccgagggcgacgtttaggttctcgagaattctgtcgtcatccaccattgttgtcctagcgccgatccccattatcatcaccgtcatgttgacgccctcgaccagcatcgtctggtgtccgctgttcgcgatcgtcgcggtcgcggcagttgtgacgattatcgtggtcttggtcttcgttcgagcgacctcctcgctgtcacgcccagaagtttcccctttttcttgctttaaaaattggttaaataaattgcccgaagaaattatcttaattaacctagagctaactccataattaataaatgcaattaataatcggaaatagcgtggtggaatttttcttgagttccccatgctccaatgcattaacaagatttttagtggaattttcagagccttggaaataattttaaccaattaaaaatcaccaaagtg

SEQ ID NO: 45116 - DNA, 921 bp, Oryza sativa
acaaattttatcttagcccaatttatattgagatttacaaattaaaattagttcttctcttctaggcttttaaaatcatttctaataattccttttaaacaccaatttataatttaaggattttaaacaagaaaagctcttaacaaatataattagatcattaatgatcaaataattactgaactgttctttgtatcatttaggaattgagctccgaaaaatctgagaaaatttcagagagtttacttaatcatgaagaatttaataaaaattaaatccatccatgctttatattaaggaaattttatttcccacatttaacttcacttgtaaattaaagatcatttaatacaaattctaataataatttattaaataatttataaatcctgaaacaaaaatcaggatgtgacaccctatcaaggatcctaaattaggtaggcacccaaataatctttccaagcccccagtctcaggggctctactgcacagcccccatccacggttggaaaagctcgggagctgcccgacgtggtcttggtccgccggcacctcccctgcccagtgctcattcccgcccggtgcggctcctccctgcctaccgtgtcatccctcaagtgcattcctctacccgacgctccttcccggccgacgcgtctgctgtacctggagtctcctctagcctgcaccctctgcctgaactcgatgaaaaacatggcccagtggccgagtcatgcgatggcgtcgaggcactggatgattcaagtgttgttgcaggctgcaaaattgagaaagtagtagcagggtagcactagcagctgcgattgtgggacttagaagaatggggaaagtgatacatgcgatgtgctatgcagcttttttgttgttttgcttggttgttgcttcgtgagagaagtagct

SEQ ID NO: 45117 - DNA, 1501 bp, Oryza sativa
cagatggtcgcggagatcgccggtgctgcgaggtggatgggtagctcatctaggtgacgtccgctgctccggtggttcgccgttggcagcgccagctatcagtcgctcttgttgtgctctggtagcggcttcctcgaacgcgttactgagattggctaccgattcccatagtcgttctatccatcgtgcgagatcatcgttaagaacggggtcatagggagcttctctcagtactgcattgatggtgccgagatgttgggccggcgtgaccgtctggttctccgcccctgcgttagcgtgtgcagacgtgctagtcccaccgatggcaaacatgtcgcgtggtgtactggaagatgatgagccatagtcttcgagcaagtgtaggactgatggctcgtggggatcaatgtcgattactccaacaaatcgatccgaggtcaacgtcgctccttgttccttgtttgtgcccttacgagaggttcctacctgctggaccttaggaagcgtcgttttcatggcgtggagaaagaccttgtagcttgagaagtcgtgattcttcgtcttgtgaataggacaatagacatcatgagttggagaagtacgctggattccacgctctttgcaagcacgaattttagcttgtacgttgagaaaaacccagcaagcttgcaagttgtgcttcctggacttgtggataggataccaggacttttttacctcagaagttgtccttgtcggctcggagttcttgtcggaaggacaaggttcggccacactaggaaccttctcgggctcgtatgacgtcgatgttccattctctgctacggcgggaggatccttagacgcgggatcgtccggggttatagccacggcgttctcgtttccgataattgatggaccagccgagattggcaccgtggtgtaaaccgggaagatgatttcgccaacttgagtccacaccagcattgttcaagtagggactccatgaatggggccggtgctgacgccgttgtcgacgaagcttgatgtcatagtagtagaaccttgagcaccaaagctccctacgtggcgcgccactgtcgacgatgggtacccatagaccggatatagagggtattggggtacactggtacgatgatcaacgtagtacgacatgaaggaaacaagagacaaagattatactggttcaggcccctaaataggtaatagccctaatccagttgatataggattatatggagatgaccacaaattacaaagggaataatagaactggatgataccagcgagatcgtagtcgagttgattcgactagatcacccggcgacttggctcctgtaggctccggcttcgtaggctgtggtcgttgtgttgtgtcacgcccggaatttctatccaaaattccaaacgcttacatgtgtgtaaaccctcgtccaggaatcagccgaggcacacaataacaaattgataatagagtacagttattactctaattattaag

SEQ ID NO: 45118 - DNA, 207 bp, Oryza sativa
tgcatttgttttctcgcgaacattccacagatcgagggtgaagaacctcacttagcgcccccggccgaaccggcaaaggggggcctgcgcggtcccccggtgatgagccccacgcgccgtcatctggcgcgccaggtagggggcgcgtgtgtctttctaagccctcgtcctctttcgtgtgcgccaagcttctcccgctcagcccaa

SEQ ID NO: 45119 - DNA, 1501 bp, Oryza sativa
tggggaggcgcatagttatttccctggttttgctggttctgaagttgctgcatcatcatgttcattaactgagtctgttgagcaagaacttgggcaagtgtgggattctctccattgttattgttattgttgttgttggggccattcccgttgctgcgagtgagcaccatctggcatggacagggcacaagaagagaaaccgggggaaactacttaggacagagaattactttaacttttattgatcttaactgagtttcattattacaaaactgaagactctcacaccactaaactgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacatggattccgaaggatggcataatataggctcatttgcaaaagcagcatttagcaaagatttaagataagtaaaacagtagagtagttaatcatcaattttaatcaacactaaacagcacatccatgctgctcaggcctaaccaaacctgaacaaccaaccccggtcgtacagatcaaacctccaaaccaggaattatccattccaaaccaggagtcaaattaattatcacattattaacattgatgagtagtgtgagactaatcacgaaaaacatcgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctctgcacaacacaactcaaaacagtgcaccgttcctggatcataatcaccccctctacaaccagaggcatggactccccagcgacccccacggacttctcgccgcttctcagtctggcactccaaaatgaatcatgctatacaaaagataaagccgttgcccacgctagcttgtggttggcacgataaatgttttacaacagtagctcgcgaaccggtccttaattgtcatgagcacaaccatcaaaaccatatgctcacaacccaccttaaacaggttttaattatcaattaattaacatcacacgattaatcatcgtgagctaccattaaatataaccataattaataagaataatataatataatttatatttaatcccctttaattagctaatgtttctaagcatggctaagcaaacatacatatagcatttaactgaaccaa

SEQ ID NO: 45120 - DNA, 187 bp, Oryza sativa
aaacagagaacaataatcatgaagcagggaatagagaatttttcgaatgagattataatttgttggagcaaatttttaacaaaaatcctcatattttttatagggaatgatatgctgattctgtgggtgatactataggctaccgatcttcagcccagctcagtttgatgtactatgcatccacagc

SEQ ID NO: 45121 - DNA, 1501 bp, Oryza sativa
gcgtcacgaggaattcctccactccgttcagtgattcagctttcagccttcaggtatcctccgttttcatcccctcatcctcctcgaatacacaatttcttttttcacggtctagccaaatttcccaatccgtcggcgctcaccgccttctgtgccgcctcacttgcgccggcgaccggatgacgcctgcatcccctccaattcatcttcctcatcccgatctgatcctccagccctagttccacaagcaacatgccggagatgtgtgcgggagggatccaagcgaggtgcctggctagaggcgccacatccgccggggaagacgagggttcgctggggaagacgagggttcagtcaacgcatgagagagccactacaatggaaggatgcgagggtacacagggtcggcttcggccccggcgtcgacgaggaagcggagccggaggatgtcgcttgctgcagatggggggtcggccgcggcgccatcgatggaagttgcacgcagcgccgccgccgtcgatggaagccgagcgcagcgctgccgttgacggaagccgggtgtatcgtcggatgccgaatatgccgcgtcgcgccgctgccgccgccgccgctgggcgtagcactgcctccaccgccggacgccctatgccatcgccaccacactaccacgtaggccagggcacaaagctgccatccaatgggttgtggaggtaattaaattgagttattggagaagatagagagaaatcagactggaagacatgatttattttttttactactgctattgatttcccaggcataaattcatattatttttgtatacatatatagacgtatcccgtatccatgtttttcagaaaatgatgtatcctatccatatccgtatccctgtatctcggtaacatagagcaaaggatgttgcttgctgcagatggggtgacggccgcagcggcagcgacagtgagtagtttagaacttcagattagctatcttagtaggcaagcagagcaggcagggcgagcattgctagcgtagaatagctcagatgagttatgtttgtttctgaatttctgtctttgtttctgaatttctgtctcccacaaggttaccttggttatactgcacaatatccaaatttgctatacacggtctctcatatttattaatttcttcagtttgtccaatttcccatatgaattttgaaaaataagaaacaccttccatgggaataccaatatatctgttactgtccaatgtctatttttcagctcaaatcctcatgattttgtttagttctaatttatctgttcatatctttgtacaggaatattttttctggtcagcctacagagacaagttctggcaaggtgagtttatgttcacacagtttctccattttccttaagatcataaagtgccaaccatattttccttgtttttttttcattaaatgggtggtttgatactattagtaatattgtatagtgataagcaggaa

SEQ ID NO: 45122 - DNA, 1501 bp, Oryza sativa
aaatatatcggcaaacttgtacagtgtacggactcaggaaaacggaccatgtgaaaccctagttttacattccacttgttcaacgcatgaggacgaagagggaggtaccaccgtagggattcccttgcctagcagtagaggattgacggatgttgaatctaccttaatgaaaggctctaattacaggtaccaccgtaccaggaggtagcaaaggttctcatgactcatggacggttaaaaagctatctcttgcctgttatatggtcgtgtgggaacaatggatttgtaatgttagccttgaaaacctaacgatttaattattacaaagcaaaaatagtttgtgaaacctggtggtacgaatatattgtatgtgtagcttgtctagctccatatattaacaagtgaaaagtgaaatcattgttagattaatgggctaggcccaattaaatcctaataaattccattggcccacattaagttctatgggtaataataccaccttagaaatctaagtgaagaggtctcaacttaaatacggagctagtggagagtctttgttgaccggttgagatggtgcgcggacaaccaggcggggcgaggcgaggcagacagctactgcgctctctcgttttgtaacggacggtaataaacaacggagaattgatttcgtatcaatgaacgcgtcggttacggaattaaacgtcgtgaattgattccgtcggttacggaattaaatgccgtgaattgattccgtattaacgagcgcgtcggttacaaaattaaacaccgcggttgatgactccgaacattaccctcgcgctcgcatatagatactccgcagcaaccagaaggacagagaagttcttcacgactcttgcacttcgagttcctcctccttttttcctgagctgcctacgcgcacaggtgtacaggatgagcaggtgcctccggaactccatccgcttgagaacttgcacgggtaggcgggcgatcaagtttttgggtatcgcttcaaacgcgactgctcttgttcttcgcggctactgctgctgcatcggtgccttcaccaagatgtcaacggagattggagacaagaagatgaacgacatcaacggaggcaatactgcctcaaaatccagcggtgggacgttctcggggtatactttcattctcccgattctattagatgtttctttgttaatactcttcgcaatggcagcattgcgttactttgtaaatgttgatgcttatttcatattaaacatactcaagttgtatatatctagcactgtcactacatctactcatattgcaaatgtcatgtttattgtcttaatattttggattaaaatataccgaattatgaccaaatttccaataatccaaaaacttgaccggtctttttcgatagttgactttgctgcatcactcaaaccagatgctttcgatggttcaaattataaaagatggaaagcacatacacttttgtggttgacggcga

SEQ ID NO: 45123 - DNA, 1501 bp, Oryza sativa
ataactaattcatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttatatgtattgtttatttggtttttattagtctttttccccgttttgcgtgatagcttgtcgtttccgtcgttgcgaaggttcgcgagtgcgccggaagtattcaagaagattaattgaagaccgattattgcaaggcaagtcacaccgatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgagctatatatattggttcagctagatattagatatgattgcttagccatgcttagaaacagtagcacactattgggataacttatgactaactattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtggacaacggctttaccttttgtatagcatgattcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgaacaatgtttttcgtgattagtctcacacctctcacaataattatagatgctatacctggtaataatttgcttagctcctggtttggagattagatctgtacagccgggtatggttgcttcagaatggttgggcctgtgcagcatgggcgtgttgttcagtgttgattaaaattaatgattaaagtactctactgttttacttgtcttaaatgttttgctaaatgctgtttttgcaaatgagcctatattatgccaacctttggtatccttgtgcacttgcatatttgctgtgtggcttgttgagtatgtcatatgctcattcttgcaataatcaatcaacctca

SEQ ID NO: 45124 - DNA, 1067 bp, Oryza sativa
cctctggcgagagtaaaactattcgaatagccgtgcccgcggttatgggtgatcaaccagatttaccgtgattagtctcacccctagtttagcgtaatgaactggtgtagttcaggtggttggttgggcttgttgcaacgtggtgtagcgttggacagtgattggttaaaattgattaattactacagctgttttactgctttcaactactggtttgaaatgcctgctttttgcaaaagaacacctagcttcctttggttatatcctgcatcatacctccttttccggtatgacttgctgagtacagtgggtagtactcagtcttgctctcttttcccccacaccagagttgaagttcttctcagatggagccgcctcagagaggttggtttcgtcgctgccgtcaaggtttgcctgtggagtggggtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacaatcagcttagaaattctggttcgagaatttctgggtgtgacaagttggtatcagagccgaccttgaccgtaggacaagccaactggaaacctaagagccctctgaacccttttttttcatatgcatatgctcttttgcacttggatttgtttcaggaaaatttggggttttgcctctttggtttgtgggaaaaatcttggtcgttcattcggatcggatttttaaaattagctcagtgtagggttttagaaaaaaaaatctatttgggggttttaaaattagctcagtttaggtttgttgcttgtgggttagtcggcggtcgatatcatgtgtcagtggtatgactgcctcaattaggagttgcgtgcctctttttcagtgttttaatcaagattaagataattacacttaaattcataagcaagattagtttctaagccccctgtttttcttccttttctcatatttctccctatccccttcaga

SEQ ID NO: 45125 - DNA, 165 bp, Oryza sativa
attcccagcaatagcgcagaaatacttctgttattttatggttacagagttcatccgcaagcgcacggatataccattgtagcatttcacccgagagtattccaagggtatcgtatttattttatcccgtgggaagatcatgtagagagaacttgactaataatt

SEQ ID NO: 45126 - DNA, 437 bp, Oryza sativa
tagaataaaaatgtaataccagtaataaatatgtaaatattctttgccaaatatgtatatttatctatatatattattaagaaacatagaaatctttattattaagacaactcgaaaagaatgtgccatatttattctaaaggatataaattatcacgttaatcgaacaataaattccaagccgttagactgtggtggaaccaaattagaatggtgaagattgataacagaaatatatgtaatataagtgtatctttagaactaaacaatggtatatagaggagtaagtgacagcatttgatgaaacttctaaatattataaaaatgaaacgaaacaagataataaactctaaaaagtataaggtccaatttttaaaggtttgggactttagaaagtaaaaaaaacaatgataataaagttccaatttaaatcacaa

SEQ ID NO: 45127 - DNA, 791 bp, Oryza sativa
cagaaaagagttcaaatgaaatcaattgcaaaaacaacagcctttccttgaagcctgcaataaacacctatttcccatggcatgctgagtactcctgtactcacccttgctctatataaataattccccccccagttgctgaagagatgaagcggatcccgctgacgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctatgataccagcactgtttcctgggtctggtatcaatttacaggttaatttggagcgtcacgggctagttccggtcggtactagttcggggcgtgacaagagatggtattagagcacaggcttggccctagggcgaaacccgacgtttaggacgaccctaaggatactaagttcaaaactacttgcgaaaagctaaggtttcttttgttttctttatttccaatagtttgtttctaaaatggttactaatattttctccctctttcaaaattgtagatggcagtgaacgcaagcgtcagctcccacggttttggtgagggtcaccacgtcgctcagcttcgtgacctcgcccgtttccttggcttctcgtgtcccgagtacacggggtactccgtggaccgtgttccccctcgctg

SEQ ID NO: 45128 - DNA, 1475 bp, Oryza sativa
cgagcggctgcaggcgcggcagagcagcggggccgggcggcgcagacggcgtaggcgcgacgcgggcgacgaccacgcgggcgcgcgcgcgaacgacgcgcggggagcggcagcgagggagcgaagaggagggctcggctcggcggctcacgcgcacgcgcgcgcggcgcgcgggcggagcggagggggagggggagagagagagagagcgagagagatagccgggaggaaattcggcccatcgaccctgggggagacaaaatagacttttgcggaggaatttgatttggaaggatttggattcggaattgaactcgacgatagatcggggatttgagatcttgagatggcacggacactagacaacaagcaaagaaacaaatttcgcaactagggtttttaagagataattttcccgctaggcgccacgacggaacgggcgctacacaacacgtcatcattaatatatgtcccatttctctctcacacataatccctctataaaaaaaatggggaagcaccggaagtatggtggagtccttggtgcctaactccacccaccagggttcaaatcgcacatgtagatgagcgtgtatcctctaagattgggtttttaggatagacgagtaatttattggacccgtgctcttatattttgaaatggaataatatattttataaaaactgcatatacttcatgtgtcccaaagaaaggcccctttggcatagctctagttcctaactctaatttacccggagccggagctgtgccaaacagttcagatcctccgtttttggaagtggagttagctaagctactcataaaaaataaaatacgggggtggagctaaatttttgctgcggcacagttccactccaatctaaaagacccactaccatttaatttttcaacatatttacataaaaatgccaccgaactaccccacctctcacctctctttccctcccataatcctcacctctcccacccggccaggcgcacaggcggcatagtcgacggcttggggtgcgcggtaggccacgggcggcgcacggttggtggggggacggcatgcgggcggtgaccgacggcgcacgtggggatggcgcatgggaggtgtccagtggcgggcgatggcgcgcggccgacagccggtagcacacacggagacggcaacctagggcttcagattggggattgctttttttcccttttttttttctatttagatctagagctgaatgctagacaaacactttttagcttgtccccaactctcataggagcccgctcccactggagtgagagtttagagctagagggccaaaatttgacctttttgaaaattttcattttatttccaaaccatactagtattgcctttgtctcatagcataacgatctagtaccggatttagggtgtggttagttcacgtttaaattagaagttttattgaaattggaatgatgtgac

SEQ ID NO: 45129 - DNA, 1389 bp, Oryza sativa
cttgcgtaacattatccttagtttgttaatccacaaattacaattgcacttcatccaggcacctaactacataaagaatgcatcaataccacatgaagcataataaaaccatttgtgacaaggttatgttgcttacgaagtagaacattaacccatgcttaactcaaagcccatttgtccctatcagggaaaaggggcccaataaagaacccgctagaagtcttgggaacctttatatcttgtttgatgcatttaaagattgtgtaaccatatgtttggaagtacttagtagtctcttacaaaatcatataatcaggacgaatcaagtacaaacctaactactcaagtctatttccaaatattaaaactggcatgctatattgctattggttactggatgtctgatttctacaaatttattcattgacaagcgtgtgacaaacgagtgaccctgtaatggctggcccaacagcaacagatcaaattgcaaatttgcatgtcataaatctgtccaaagcagaaaaaatgacatctcagctagagatgccaacaggcaacagcatccgttatgtttattaaaatcagaaatcccaactttggttcttaagaaaagtttgttccccaagtctaattcgcaaacacctaaactatcaccaaatcatgatgtttctagtacagaagtgcagatgaatagccaaacagaattcagaatttcttttctcaaaactgaattcaaaatttcttagatatggatcccattcagacagaatttaactattgaggtgaacctgatcaccggagtgcaatgacatcgaaccagggcattcaaacttgtgcctccagagtcaactcttggagatccatcttgcaaccaccggtcatcagacaatcaaagcatcaatagtgatcacttggtctaccagccaccatcaaaaagcatggtttggatcactgaagtctgaaacacaaaccaatggagagaaatctcatcaataaacatcacattgcatattactaatgggattccttaataatgtaatgttgtaaactgagcaacaggcagtaactacaatcgtcctagggaagtaaaagtaaaactttaaaacgttgcaattaccaaaatgtgagcaatgcacaggatccgattttccactgtaatatacaatgtctataacttaatgaacacttcaaaacaaagataccaaggaacacaaaatccaacaaggcattgagtacgattccagaaaccaagagaaaaataatatatgcttgctgcaaagcacggtaatatcaaagtttttttttttagcaaacgtaaaaagtacaaaccctatcctacccttttctaagacaaatctttgcatcaaacgaacacatcaaagatcaaaa

SEQ ID NO: 45130 - DNA, 225 bp, Oryza sativa
ccgccggaaaaattggagggggggaaaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaa

SEQ ID NO: 45131 - DNA, 203 bp, Oryza sativa
cgtcgtacttcgcggaggagaagggaggagggggcaacgagaacggattccgtttgccgccgctgaccttgtatagtgatgtatttggagagtgggcgcctgggatggcgcctatatgtgggctctgtggcatggagtgcagagacgggaatgcccaaatattgaaggtactatcgagttataaagttcctttttgcattagc

SEQ ID NO: 45132 - DNA, 1501 bp, Oryza sativa
catcctttttggaagaccgattcggcgcttagactcgtcacatccagtcaggccagatcggccgcgttaggggtaggtagcactggccctcggctagagatgcagcagctgcagaaactcttttcgcgccacgcctcaccaccgcactttcttttgcagtgaaggacttccaaacgatagacgacgaagcccttatgagcttttaatatcggatgcattgaccgcccaatgctatatactccctccgtttcaaaacaaagaaaaagtctaatttttaatatccaacgtttaatcgtccgtcttatatgaaaactttttatagagtaaattgtattggtggtatccaaacttattagctaggtacaatttagtacataaacttgtaaattggtcgttttgatacacgaacttatctaatccgtacgaactaggtccaaaatggcttggcaaggttatttccacctaacttacgttgattaggatgtggcgtgcatacgtatagttacataaaacatgctatatttataaatttgttctctgctttatcttaaatttcatatgtttctaacccttatatcattgctcggttttttatatctttctctacaatcactatatctcattctatctttttattgaacgtgtgtatgtctaagtagcaaccttctcatatatatgtttacgtatatgtttacggacggttcaacatcacatatggatttttatgactgcacttattttgaaacagagtaagtatgatactacagtgtagtgagctcttaagaaaaaaatgattttgcccggtcgaatgctctgcccgacacgctgacacgctgaatgcatggcattgtttcagttgcttttatgtcttgtgtcaccggagagctccgcgccaaatataccacgccgtgtcctatatatgagggtagggacgtcaaaacagccaggatgggtacgtaccttcatcccgtggtcacccatataaccaagtgatgtacaaatacacgtggatgcattgccactgcgtccgcagatagggtaggccaagcaggtacacgtgtcgccgcctcatctagggtacatgtgtgctcgcgtgcagattttccaactcatatatatatatatatatatatatatatatatatatatatataatctgacctaaaatttgattttcgatctcctacctacaaataagaagtgagaaaactccttccttcgaaagaaaacctaaatttaattccaaaaattaaaaatggatcattctattaaattaccaatagaaatttccattttgttccttcccacacacgtgggaacgaggagagaggcggggagcgtgcgattgcgagagaaagaggcgagatcgcactccctttatcaacagagccagaattcgggagatgggaactccaaattctgggtgagagagtaggaaatttgttggagctattttttttctgttaaaatctctcgaacatcagttttgggaatggattag

SEQ ID NO: 45133 - DNA, 1501 bp, Oryza sativa
ttgttaaaacataaatgtctcgtgacttagcagatgtttcttgtatcaacagatggctgaccgcgatgaggaacagatattgtacgatacaatctgtcacatcctgatttttgtttcaggatttataaattatttaataaattattattagaatttatattaaatgttcattaatttacaagtgaagttaaatgtgggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaaggataccaaaggatggcataatagggttccatttgcaaaagcagcatttaataaacatttcagaatttaataaaacaattaagtaataattaaacaatattaatccaacgctatacaacataccctgttgtataggcccaacctttctgaacaaccatacccagctgtacagatctatctccaaaccaggaatataccattccaaaccaggagctaaacaaattattaccagttatagcatcttttactaagatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcattgactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaagaacaaaa

SEQ ID NO: 45134 - DNA, 701 bp, Oryza sativa
gatcatacctgtcacaaatctaaaattactttctaagcttgaggagttgaggtgcaaatggcgagaataatacccatccggtgaactgagcaagagcttagaagcaaacaacaatggtaatattgttgtttgttctactttcattttgagtgtgtattaagcgttttcttctagggataaaacaaaatttgacatagtatgccataaataaaaatatccttttaattgtcaaatgtattgctcacctggttgttacagaaagtgctcaccttgatcatatatgtgtcaacccatttgcattgaactgttttattcaaaagaactgcaaaggggattcacggccaccactgagcggacgttactggagatatgctattggccatctccgtccatatgcatctgaatctccaaatggaatttgccactgccatgtttgggtgctctggagtggaaaaaaacaatcgtgtatattgctttttggagtagtgtttgactgacttgtatacaaggttatggtaattttggtgcttgattttcgtttcttggaagaactagtggcgtttgattgacagtgaaataccatttgcaatatatcctggtgtagtggaaccttcatgtagtggtaaatgaatatgcatgtgactgcaattcatctgaattctatgtgtagtgtgtatcccccgaacctttattcttttaga

SEQ ID NO: 45135 - DNA, 1501 bp, Oryza sativa
cggaagtgtttgcggaagctcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttatttttctatgggttataatttgattagcatgaaccttatatattggtttggttcagttaaatgctatatgtatgtttgcttagccatgcttagaaacattagctaattaaaggggattaaatataaattatattatattattcttattaattatggttatatttaatggtagctcacgatgattaatcgtgtgatgttaattaattgataattaaaacctgtttaaggtgggttgtgagcatatggttttgatggttgtgctcatgacaattaaggaccggttcgcgagctactgttgtaaaacatttatcgtgccaaccacaagctagcgtgggcaacggctttatcttttgtatagcatgattcattttggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatccttcggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacagtttagtggtgtgagagtcttcagttttgtaataatgaaactcagttaagatcaataaaagttaaagtaattctctgtcctaag

SEQ ID NO: 45136 - DNA, 1501 bp, Oryza sativa
cccggctgtacagatctaatctccaaaccaggagctaagcaaattattaccaggtatagcatctataattattgtgagaggtgtgagactaatcacgaaaaacattgttcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgtccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagttagtcataagttatcccaatagtgtgctactgtttctaagcatggctaagcaatcatatctaatatctagctgaaccaatatatatagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatcggtgtgacttgccttgcaataatcggtcttcaattaatcttcttgaatacttccggcgcactcgcgaaccttcgcaacgacggaaacgacaagctatcacgcaaaacggggaaaaagactaataaaaaccaaataaacaatacatataaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattaattttgaaaaggaaaagaaggattattgcgtcagcggctagggtttgcggtggaccgggtgcacggcagcggttcacgggaacgaacggccgagatcaaccctatccaaaacggacggccgagatcgatcggtccacgaccggctcacgggagagggcgacga

SEQ ID NO: 45137 - DNA, 234 bp, Oryza sativa
tctggtactatgctcatggtgtaacgctcaacccagtggatggctccttggtcttcagcgatcagatacgcgaggctgcgagtcgactaatggacgcagtggaagcctcttctcagggcacgttccgacccgacagagagaaggacgagctgtcactcgccctacagactcccgagcatccaggacgaacacgagggaaaggcgtgattccctggaagatgggattcaaggagg

SEQ ID NO: 45138 - DNA, 291 bp, Oryza sativa
aatttacttgattgtttcgtcctgacaaatctgcatgcttttggtcaacaaacctaggattacttgacattgactcatataaaccttagcttcttctcttctgtgatgtcacattctttttggggtggctgttgtttgttgtagctgattgtagatgctatttaatacttctgatggttgtcatattccatatattctcttcatgttacttttttgttcatgcttatttattttctttatttttggatgtttgctgatgcatattaattaatggaatgctaacttcatttc

SEQ ID NO: 45139 - DNA, 168 bp, Oryza sativa
aaagagtatgtgctcgctttactagggacaggcaggaagctttggtgaggcaatggttccacattagacaaactaatacagtagctgagtatgtggagaagttcgattccctaatgcatctgctgttggcttatgaacagtcagttcctcaagtgtattttgttcaga

SEQ ID NO: 45140 - DNA, 1501 bp, Oryza sativa
cctcaagcacctccagtttccgctctaggatgtccagcttctcattcaaggacgcaagtttgctcttcgtagtagcttctgcacaaatgcatacaaacctgtgtaagcatattagttaacttgaataaacatgcatgcataagatatgctacccccagtccactctgttttgctgacatgctcgagttcctaatcaacatggagcgattatgttgtgaatgcatcttgtttggagcaaaaatggaaggtatgatagttaccagtgccttaatccggaccatattgaaaaggttcaatatgcattctggactaaatgtatacacggagggcaaagtacagaacacatatattctgcacagtaatgttcaaggtatctttcaagctttgtttttgacagtggtttaatggacataataagaagcatacagggcttggaaaagcaccaagccaatccctcctttccaagtaacaactactccacaattatgcaaaattttagataatgacaattgtgcaaatcagactgactagaacatagtcactggagtagttggctggccaacaggaaatatgctgtcttgtcaatggaagcttaactaacgttgatttaataagcttatagtccagagaattcatatcgtagaaaagatttaagaacaattaaaggtctatatccagtaacaccgttactgaactgaatttccgaatatgcttaagttagtttgtttggtgtgacgctggcagctgttggaagggcagaagaaaggcttgatttatagatactgtgttgacaatggcagaaacaagttcagattagaagggaggcagaatgggtttagagttgatggtactagtgtacatgggtgaggtagagcacatttgtggaaggcagggagagtggaaatgaaattttggttggtgcatatgcatagctgtgtcgccaagactaatggaaatgtggaagcccagttagggaaggagcaaggcagatctagtagtagaaaggaaaaagggtaatgcagatccagagaaatgtggctatgcctgagtagaggaagcagaaataaatgtgaatccagtgcaggtccatggaggaattatgggaaggataaggaggaagaggtaggaagagaaaaaacggaccgaatcggaggaggaagtcgaagaggcgacggacgttgagggagatgttggagatgaactcgcggttctcccagtccgcctgcaccgcgatccccacgttcaccgggttccccatcccatgcccgcccgcgcgagccatctccccctcccgatcgatcgattaattacctgcttcttcttggattcctccctcccccgattcacctcacctactctactcctcctcgccgccgccgccgctgctgctcgtgacgtgacgtgctggtgtcgtcccctcctcatcttcattctcccgcaactccgagtggcatctgttgggctgggccggcatgcatgagttagcccacgcacatgagct

SEQ ID NO: 45141 - DNA, 1501 bp, Oryza sativa
accccgccacacgtccaggatgcagatggagcagcgcgtggaagggcaccacagccgctaccgcgaacgaagggtgacggacagcgcgcgaatggagaccgccgccgctgcatacgaaggcagatgagtcacgggcggatgggcactgccaccgcttccacaggtcaagggtcacgcgcggacaagcgccgctgccatagacaaagggcgacaggacgtggcggcaaactgcaattggtggctcgcagctaccaccgccagctagtggaggaggttagttgggggaggcggaaggtggaggtggaatagggaggggattgcggacggagaggaggaggagaaagaaggagcgtcatgtgagacggagatgaggatgtgagtaggcacggatatggtttgctcggtcggctctcatagcggttttttatttttttttagagtaaagtgtacgggcggtctttaaaacttgtaggggtatgtcttttaggtccctaaattctcaaaatgcatatctaagtcccaggacttgtcatagtgtgtcatctaggtcccaaatcgttacaacccattcaggatcctacatggcgttgatgtggcatgctacacagacatgacgtggcatcattttgaatgacaaatggtacccatttaaaatttttcagttttcatttttcttctctttttttccctttcttctcctttatctgtgaccagagcagaagaaaggaaaaaaagaagaatgagaagaaaacgaaaaagaaaaaacaaaagaagaaaaaaaaagaaaagaacatgtcatgtccatgtggcgtcatgtaggatcctagaggagatgtgtcgatttgggacctagatgatacactttgataagttctgagacctagatatgcattttgatattttagtaacttgtatgacataaccctacaagtttatggaccgccaatgcactttacttttttttatataggttttggtttttatctagaacttgcactataatataagtataggtgtcgatttttatttagcggctactacaatttattaaaggttttggttttttaataaacggcacctaaagtattgtgctagtttttctctatcaccggtacctatagtagattgaaggtgtcggttctataattttccatcctgtggagatacagaaaggtctatatgtatcggttttaggatttatggcaccaatagagctgtttcttttgtgcgtttctatagtagtgagtggctgggcctagggaagtgtggtcgaagcacgcccaccctatgtgcgtctttcacgacatgctcttgccttcggtttcttcctctggtcttctagcggtgtctgttccggtcatctgcaacatactctcatggcctttttttatgacaaaacctatctgaaatcgtcccccaggataaagactttatcgaccctcgagggatcgacgtaaatatattcgctagctataaaaggactcgaaaacctgagttaagt

SEQ ID NO: 45142 - DNA, 988 bp, Oryza sativa
ccgccctgttggggcgcacgcgggccctgagcatctcctggaacacgtcgacggcctccgcgaagctcccggcgccgacgtaggcgctgaggatggcggcccaggcgatggtggttttgtggggcattgcgtcgaacagggcgcgcgcgtggtggaggcgggcggccctgccgtaggcggtgaggagcgaggtccaggagcagacgtccctgcaggagacgttgacatcgaagacgcggcgggcggagcagaggagggcgcaggaggcgtaggcgtggatgaggccgttggagacgtaggcgtgggcgtcgcaggcgacgaggatggcgagggcgtggagcgattctacgaggacgcgcggcgaggcggcgtggggaagaggagcgagggaggcggaggcggtgaggaggaaggagaaggtgtaggcgttggggaagaagggattggtagcgatgatgcggcggaggcgcgggaagaggcggagggcgcgcagcggggagtgggagtgggagggcgggaggagggagcggaggagcgagttggggaagaagcggtcggctaggagcgaggagacgaccaggtgggcgtgggcctgccggagctgcgcggcggtcagccaagggcgggacagtagcagatgcagtgccgccggcggcgccaccatccagaccgagccagagccagcaaacaagcagctcccctgctccaggtcgaaggaaaggaaatgaaagtagtgggggaaaagaaaaactgggccgaatttgttcaagctcatgtgcgtgggctaactcatgcatgccggcccagcccaacagatgccactcggagttgcgggagaatgaagatgaggaggggacgacaccagcacgtcacgtcacgagcagcagcggcggcggcggcgaggaggagtagagtaggtgaggtgaatcgggggagggaggaatccaagaagaagcaggtaattaatcgatcgatcgggagggggaga

SEQ ID NO: 45143 - DNA, 428 bp, Oryza sativa
agcttgggcaccaattcgtgtatatcctatatctttcgattggcgctaatactctttattggtctatctggctttatcacaatgatattgctttcaaaaaagaagatactccattcgttttttaatatatgacaccattgactattttagatacgtttgaccatttatcttattaaaaaattagtaattattatttattttattataatttaatttatcatcagatgttctttaagcatgagttaatatattttttatatttgaataacaattttaaataatacgaatggtcaaacgtttgtcaaatagttaatagcgtcatatattaaacaacagagatattatttctaatctaatgcacgttacatattttaccaattgactccaaatctgtatgatgcatgcttttaaaataggagcgcactagg

SEQ ID NO: 45144 - DNA, 1501 bp, Oryza sativa
cttgctcagatcttcttaatcttccttcttctctcatctttcgtattcaaagctgtaaatgactgcaggccgaaggtaggatccagcaatattttgctccgatcctcgcaacatatattcttgtttcaaaggtaattaattcgttgcgattgtttcttaattactccattaatttccagatactatatacatgcttgcttgctcggggatcaatataatattccattatatatgtttgaaagagggagttctctctcgctcgcttaattttgttgttgatgcagttgctcatcaatgaatgaatcaatcaatgggaaaatgaatgagttattcgcagtggcaggtagggcgggggtggcgatgatgaatatggtgtcgagcagcagcatccaaccggggcagatacatagcatatggcagcgacgacaaggaggtgagagtagagggagatatgtggtgatgagcagcggcagcgtcaggaagagcagcagcagcaggaggagggtggtggcggttatccgggccgtgggcgacggcgcaggtgaatcgacgagcggcaaggacgaggaggaggaggagaagaggcgtcgggaggagctggagcggttggtgggtggaccggaggacgcgacgttcagcggggcggacctggcggcgctgataaggagcaagtacgggaggtcgtacgacgtgacgctgataaagaaggagttcatggggcggaacctgctggccatgaacgtcatgtggaagtaccgggagcagcggtccttcccgctgacggaggaggagtacctgctccgcctcgacgacgtcgccgcctccctccgctgctggggcgccgtcgcccacgtccgctcctccctcgccaagctcaaggaccgcccccgcatcggcaaggccgtcagcatcttcatcgacatgcccaccgacgactccggcgcccgctccaacgagtggatctacaaataatataatcccttctatttatttatttatacttcatcgccatctcgaattctcgatggatcgatcgttaattagctaccttgctccttaattccttcatgtatttgcttcagcttcagctcaacgatcgatcacacattcacactcttggaattgtatgtacggccacttattaattacctcaagattcatcctctctgcattgtcttgtgctgcttcttgctagcttcagctccaccgacaccgatcgttaattatgctcgatcctctacttatttgcttcggctcgacgtaccatcactctctcgctcctcaatacattagtatgtacttcaacttgatcactgatgatgcctcgtgttatcttcttcatcctcggctcttcctccagtgctcaggtagagtaggacgtagatgcgccgctggattgttcacagcaaatatgcgccgttcgatctgtcacttgactatctatcacgggaaggcccagtttcggcccagtgagttacttgtgtttgtggactaaactgca

SEQ ID NO: 45145 - DNA, 1501 bp, Oryza sativa
  unsure (1)..(1501): unsure at all n locations
ccgtcatcggatgtcctactgcgattcagaggagagcgattgagattgagaaattcagaatggaaggcagaagagagaattcctaaaccttgcgctgccccctgcgcggtagaggtagaaggcgggttggtcgttggcgcggaagaaggcgcgagcggattggagggcgcagcggaggatggcggcgtgggcgtcggggaggtcgaggagggcggcgccgtggcgggtgagggaggcggagagggcatggacggcgcggccgtaggcgggggtcgcggcgccatcgtagggcgccaggtcgtggaggcgcaccctggcgagtcgcccgctgctgctagcggcggcgggaggtggggaggaggccgccatgagcatgggagtgggaggagctcatggtggctactgttccgccatntnngcctccctccactccacagcgtctagtgctcctcaacctgcaagcctgcaaaagaccccgacccccaatgctacgactgttttactgatttctttgtgaacaacagaaagatttttctttttctcttttcagaaacaaaaatgaatttgagtctcaatgaagttcatcaatcacgaaaacatattactacctccattctaaaataatttttttgtttgtaacatttgaccattcatcttattcaaaagatcatgaaattattatttattttatttgtgacttgctttattattataaaaaaaactttaagtatgacttattatttttatatttgcactaatttttaaataagatgaatgatcaaacattataaaaaaaaatcaaaacgacatctaatttagaacggaggagtactataatatatttttattaaggcatatatacagtctttaaataaggtaaattgctttttttgctatacatatatttcgaagtgttgataagattaaaatactatgtaaatatttgtcaagacactgtatatgtactacatgattttgtatatgcaattgaaatatatgtattttcataataaaatgttgatgaccaaagttaattatataggaggagtatatggttatattgtactcctctgtcataaagataagttcatttttcacacatcccacacatatactaacataagaaaaaccccagaaaattcatactttatcccatcccaatataattattcttcgttttatgtacttctaatataattatttcttatattactttcacaaattttgatacaatgatgattacttaaaataaacttattttaggataaatggaaggagtcaaaaaaataaatttattatgaaacgaaagagtatgtgacagtttgttaaggttttttgacatgtatgtatgtgtggtacctgcatattactcctacgtatgtatgttgatcgatctcttcccatcctactagaaaagggtaagggagaccgaatcgacggagtcggggtgggtggagatgcagagagagaggcggtttgttactacgtaatacgtgtatat

SEQ ID NO: 45146 - DNA, 1501 bp, Oryza sativa
tgaaaattgtagttctcaatgagctagctttgtagtcgaattggttttattttagatcgtttagggtcccaaatgttcgttacaagctgcgagatctattttagaaaattcttgagtttgagtttttcaaacgagctggattgagatatcctttggacgaaagaagatttaagtagatgactttttcatttgttgtcattaagagctcaaattatgtgttacaagtgttttagagagttcaagttaaaaaaaaatagcatctattacataattataaattgattcataggtgggataataaagatgttacgcgaggagtgggaggtacggtcctggttcaaatcctatataccgcacgaacacatttttcagtttaatgtttgcaactaagaaaaataaaaaattcaaaaaatgtattttcgcgggcatctccggtcctcttccataggaactgaagcaagagcgtgccacaaagatcttgaaggagcactgcaagcagcagtggccgtgagaacccacgctatatatgacactatttcagtacattattgatcaagatatttcgccatcatgtccagacataggcaatcagcattgacgtactagtgatgaaaaatggaagaaggtaatcgttcgcaaggaccaacttgtattcgtaccttcgttaaacaatagttgtactctcgtaaattgtaatcaactttcttttccataaaaggtaatagtaaattttataccatatatatttagagacaaatgtcacagggtcgcatcaatttttaatattctttttcacttaattaaccctacggttacaattattgtccgtaaccatgatgttaaaataatgaagaaaatacttattgttaccccatcgcatattagttgttgttataccttatatagcatagattatgttatgagaaaaaagtccatactatccttattaaatgatgtatgtgtggtcgtgggagaatagttgagggtataaaaaaagagaaatttgaattaaaagtgattgattggataagtaaattgtgataactattttgggacaaagtttaaatcataaagagataactaatttgggatgaaaatagtacattagtttctaccaggggcggagacagccaaattaaaaagacgccagggtcaatgtaaactagtatttgcaataccgattaaaaaaaccatgaaaaccgcttggttttttcaatccgctagttttgaatccttttcttatatagagttgacgaaaaaaatcttcgaaagtttattagttttaaatatttgttctaagctacacgaaaatcattgatttttactagccaacaaaccttatgaatcagagaggggaaaaactttatcaaaaaatgataacataaatacgtcttaagacttgcatgtaatctctccatcccaaaatataaaggattttagttagatgaatcatattctactagtatgaacttagacagagaaggagggagtagcatctaat

SEQ ID NO: 45147 - DNA, 1501 bp, Oryza sativa; identical to SEQ ID NO: 44915

SEQ ID NO: 45148 - DNA, 1501 bp, Oryza sativa
ttcagccatcggatgcatggtaagagcctgatataatttctaaaatcgaacatggacttgcgtggagacgaatcgttttcacggctcatgcgtggacgatagatggtgcggactctaatatgtcgtattttgcagatgacaaaaggaaaaaaataattatgcttaattttcaaattaaaaactggttcattataagatttcagaattactaacgtgctagtggcagagagaaaaaaattgcacaacaatctagccagagccaaagtaataataggatttgagatgtgggaggcaaagtaggcggataaaaaaaattgcggagcaatttagcctaggagaggcaaagtaataataggatttgagatgtgggaggcaaagtagacttattctgaggcaaagtagcaataggatttgagatttctgagcaatctagcctgatagaggcaaagtaataataggtctaaaatggagagatagaggcaaagtaataataggtctaaaacggagagatagaggcaaagtaataggtctaaaagggagagctggtgggaatcgaaccgtggtcggcgggttgaagattttctccactgaccaagtaggcaagctgctagttgtggttggtgtctacatgagcggtaaatattgtatatcaaccgaggttttggagtagattagaaaaggtccgatccgactattaagcggagtaaaacggattttagcaacgtgggatgacggacgaaaaaaaccaccggaagccttacgtatttttttattaggtatagataaagtaagggtttaattttttttttcatgttgagttggttgtttcttctcgttagcagattaaaccacatcatcggaataacaagaaccgtcagatgcaattaagaatgaagagttttcaccggaggtcttgccaatatgcagcgtccacgcatcggaagacggaagaagagaatgaaaactaagtgaacgagaaaaaaaaataaaaggaaatcaaaacaaatacatacttccgatatagaacgacattattgcagaaatcaaaacatcttggaacagatatagaacgaccgaaagtataatttttttaggaaaagaaaatcaaatattaagcaaataattgtgctaagtatctttatttctatctctctttactattataaacattgaagatgtttttatcggtattttagtacctcattcgtatttaagtcggtttttaagttcgttcgtttttagaaatacagatccgtgtttgagtcagtttttaagttatttcgcttttagaaataccataaaagtcatataagaaatttcttttaaagaaaaacttatatactaacttaagacgatcggacttttaattgcagctcctgattttgtaaaaaaaaatatctaagagaattcccacagtaaatttcaccttaactaaaccgtataataataataagattaaaataaccttcactcgttgtaacgcacaaatttttttttaagt

SEQ ID NO: 45149 - DNA, 162 bp, Oryza sativa
caggagggccaaccggccaagcccaacttcccccaaaagccctaacgaaataaacccttccgcccccgccgccgccgccgccgcctcgccgcggctcgcatccctcttcctctccctctcttcttcgccggcgcgacgcgacgaggcggtagctgcctgcca

SEQ ID NO: 45150 - DNA, 1501 bp, Oryza sativa
tcctagatggcagactatcttcttagcctcgtacgttgtctcggacaattggtttccctccggaagaatgttcttgacgagtttcaataaatcgccaaatgccttatcactaacaccattttttgccttccattgcaagaactccagagtggtatccaactttttgtgcccctgctcgcaacctgggtacaacgacgttctgtggtcctctaacatcctgtccaatttatgggcccccttttcactttcgcagtcctccttggcgtcctgcaacatctgaccaagatcatccgcaacgtcgtaaccatcagcatccatttcctcctcgcccgtttgatttccttcaaatccagagtactgagcaaagtccgaaatattgtcgtcttccacttcatcttcttccatttcaaccccttgctctccatgggatgtccaacagttatagcttgggatgaaccccgactcaaacaagtggaaatgaatagtcctggatgcagaatactccttctgattcttacacttattgcatggacaacaaataaaacccttttgcctgttagcttcggccactctcaaaaaataatgcacgccgtcaataaactctttggaccgccagtcagcgtacatccattgccgatccatctacatgacatgaaaaaaaatcgtacacacataattattcgtacaataatgacagtcatacaataattataaaataattacaaactctttcaacagtaacacaataatgacatatcattattcatacaaaattatgaaatattacaccgaataattatatatttactatttataaagttttaaactaatattaatgtgttgtacttattttaatttttcattttactttgttttctattattcaagattaactttcactatattttccttctcaactattttataaaaccttctttaacaaataaactaaatttctatatattctttcttctccacacaaattttctctctcatcaactaacaataaaattttgaagacaaaaaagtgtgcaaaacatgatccaaatgtaatatgaaaaaaataaaacattggaggatgaagttgctaaccttttaggcacctccgatttatatataatcaccaaaataaattcaatagaaattttggcatgacctcccctcttttttgaagaaattttgaagcttactcgggctggaggaggacgaagacatatatatatatataggggtgggattttagtcccggttggtgttatgaaccggggctaaagatcgctgggatctttagtccgactaatgttacgataccaaccgggactaaatatcccgggagggcctgacaggccctgacagcatttaaaccaggactaaagatctttagtcccggttggtgatgcccgttaccctttttaaccggggatctttagtcccggtgtttgttgcaaccgagactattgtggaattagtccgaccgacgaaagatggtttctccaccagt

SEQ ID NO: 45151 - DNA, 1501 bp, Oryza sativa
tatgttcaaagtgcttgcctttcttccgtactgggtggtttgctgcaaggaatcgacgatgacccatgtacacaaccttccgacagtgcttaagatacgtactttctgtttcatccatacagtgagtgcaaaccttgtaccccttgttggactgcccggataggttgctaagtgcaggccaatcgttgatggttacgaacagcagtgctcatacgttaaactcctcctgtttgtcctcgtcccacacggggacaccttccttcttccacaacagtttaagatcttcgaccagtggtcttaggtacacatcgatgtcgttaccaggttgcttggggccttgaataataatcggcatcattatgtacttcctcttcatgcatagccaaggggggaggttgtagatacacatcgtaatgggtcaagtgctatgaccgctgctcatctctccaaaaggattcatgccatccgtacttaaaccaaaccgtatgtttcgtgcgtcctttcaaaagtctttaaattttctgacgacgtttcgccactgcgaaccatcggcggggtgtctcaacatcccgtcctgttgacgctctttagcgtgccatcgcatcattctagcattccccttgttcctgaacaaacgccttagacgtggtattatagggaaataccacatcaccttagcaggaattctcttcttcgttagctgctcatcaacttctcctggatcatctcttctaatcttgtatcgtagtgctttgcaaatggggcatgcttctaggttctcgtactcctcaccgcgatataggatacaatcattcgaacatgcgtgaatcttctgaatttccagtcctagaggacagactatcttcttagcctcgtacgttgtctcggacaattggtttccctccggaagaatgttcttgacgagtttcaataaatcgccaaatgccttatcactaacaccattttttgccttccattgcaagaactccagagtggtatccaactttttgtgcccctgctcgcaacctgggtacaacgacgttctgtggtcctctaacatcctgtccaatttatgggcccccttttcactttcgcagtcctccttggcgtcctgcaacatctgaccaagatcatccgcaacgtcgtaaccatcagcatccatttcctcctcgcccgtttgatttccttcaaatccagagtactgagcaaagtccgaaatattgtcgtcttccacttcatcttcttccatttcaaccccttgctctccatgggatgtccaacagttatagcttgggatgaaccccgactcaaacaagtggaaatgaatagtcctggatgcagaatactccttctgattcttacacttattgcatggacaacaaataaaacccttatgcctgttagcttcggccactctcaaaaaataatgcacgccgtcaataaactctttggactgccggtcagcgtacatccattgccgatccatctacatgaaatgaaa

SEQ ID NO: 45152 - DNA, 1501 bp, Oryza sativa
cctcagtcatatattgacagtagcaccaactgatcagagaataatcacatggttcttgcagtaagtaaacctactgattagagggtaggtcatatgtatctttccaactgacagggtataaacggaagaacagtactgttcagagaatttttagattttttagataattaaccactgcagtcaatagcaacctctccagctgtcaagagaggtcctaattaactacactgattttcatcagaccgtatatcaaaagtcctgccaaccaatttgtcgagactatgcatgcatgtaattcgcattttttttctgacatgagtacattcttagaaacatatatatttacgacatgaggactcatgattcacattttggacttttgtgtctttttgactgatactggcaaaatgccagtacattgctacgtacggaatttaaaatatcacatcggtacattccaaaaagaaaaaaatatatgttaaattttagtctttagagcctaattttatatttagttagagttttttttatcttcttatattttagctataaaaaagtttaagtggattcaactgacttacgttattgcatacgttccatcccttaaaaaagttgcatcgtcaatccataaaaaatatagaagatggcagtgtgtttattctttctttcttttaacttcagtaaaacatgtctaataatccgcaactagcttatataggcaagtcttagatgtttggtggtagggttataatcgcttcttacttttaatacaagataatccaacaaatgtaattgatatgtgtgagttcgatatcgtacaaacgattttgtcccaaaaatattattgccgttagggttttgtccattccgtgtcgttaaatatactattcatcctatagcatttaatggcacgagatggacggaagtctaacggcgatggtatttttaggacaaaatagttcgtacgatggtatttattggaactcacacttgtcgatggtatctcttggatttggacgcttgtcaatggtatttcttggattatctcttaatagaatcaaccttgttttagaaaaaaatagcatatgtttattgattgagcacacaaatctactacgagaatatgtgtcaaacatactaatcctactaaaagtttgaacttagagttggaatatgtgtagcatagagttaaatcggactctatcatagattcactcttaaatagagagagtgacaccacaatgtaatcatgacaactacaatttagtgtaaacgcgtagggagaggatagcgcggcgagcccatggactcgtagcggttatgtgctatgttgattggggaggagcacctataatcagaggcctaaagatgtaggttttcactaaacttcgttaacaactattgtgtgttgatgtatcgtcctttagtgtatcttaatggatgatcactgtaccgactaacgtttataaaccgaactaacgaacacccttttccccaccaa

SEQ ID NO: 45153 - DNA, 218 bp, Oryza sativa
ccacagcttggaattgtcaatgtgacacagatagttgatggcaaggagctcctgaatgaaagaacaaaccctgagaaccggtatctgaagaaggtaccaagcattccatttcaggtttttttcagttgggcaatgctgtttctgggcttccctgttttctgaactttctgttgctatatgcttttctgattacaccaaaacagctgccaattgactgc

SEQ ID NO: 45154 - DNA, 289 bp, Oryza sativa
tgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaatgattatttgtgtacgatttttttttcatttcatgtaga

SEQ ID NO: 45155 - DNA, 922 bp, Oryza sativa
gataatcatagatgctaagtctaattaagtttcgaatattacatctctaataatcttatattaaatctctaacaatcaaatatgtttcgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacggtagataatcatatatgctaagtctaattaagtttcgaatattacatctctaataatcttatattaaatctttaacaatcaaatatgtttcgaatactacatctctaataatcttatattaaatctctaacactcacatatgctaagtctaattaagtttcgtatattaaacctctaataatcttatattaaatgtctaactatctctaacactcaaatatgctaggtctaataatctaataatctctaacactcacatatgctaactctaataatctaataatcttatattagaaatctaacaatcttatattatatctctaataatcacatctctacatcacttgcctgtgcgaattcgttcgagggctagctaccacttcggcttgagggacgacgacgacgacgtcttctctgcaacatgcaaaaaaaatgtattagtctaaatacaaaggaacatataatgtatttcacgttttcaagtatatataatcatatatatatgctaagttcaacaatagtttaattatctcgttcgtacacatttcgctcgcgttcgttctcacacttgtcaagtgcattcacgttcgttaacgtttcaatcacgttcgtttgcgtttctttcacgttcattcatgttcgttcactaacactcacgttcgttcacgtttcagt

SEQ ID NO: 45156 - DNA, 574 bp, Oryza sativa
atatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactattgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcggcgctccccttctgctgccctcccctctctctctttcgttttttttggatttttagtgaatataatgaaatttcacagaggaaggactgggctttataggggggaggcaaaaatcgccctcccccagggcggcaagggggccgcctgcaaaattccatgccctccctcgccgcccatttgcagg

SEQ ID NO: 45157 - DNA, 1501 bp, Oryza sativa
atcaaagaagcccacgtcatatgtatagattgtcttattctgcatggatcattcttcatatgtatttacctataagttatatgctagcccccattttctttgagagagagactgggagacagagtgatagacaatcaggcacacatacaaaaatgaaggggagaaggagcacatttttacttagcttaatcaaaattgaataactgatataaacctacataaagttttgttccttttttttccaaactagtgtggatgtcatcaccatattatttagttaactacgcatcgcagtcagacaacaagcacgggtgatgaaatggtatttggtctgttgcagtggggcttttcttgaggatgctatggttctgttatgtggacactctttcggtggcctcatgctgaagaaagtcattgaaatggtattttttcaaaaaacttcatactcaggcttccagatggctattaattctcttgttgtaacttatgagggcaaagttctctcttttactgtagattgcactcttcaatgtactagcttcaactagcaattcaatttgattattgtccttaacacagatactggcattgttcactaaatttgtgttttttgtttgaaattaaattatttatttatgtcttctttattatttaatagagggccctagcggtaggttatccaaaactggaatgtactacttaacagagaactgtgactattaggactttaggagtgctttttagtagcaatggcacattcttgtaaaaaggtattttacgcctgaagcagttccttgtatttcacacagcatatatcataaaacaatagattatgtttctacaataactatgcgacatatatttaataaaagtgtattttcaagtcatttctattttacttatcttctgatccagtggggtgacaccaacaatcatgccagtttttctatttttactatgattaggcaagatgcaccatttgcaatggagaagttgatccggccaccctgtttcctaatctcggtatatttctgactactaattttcttccacgaaactggcattatctatgtctcacctgctcacgtactgctgttagtattttggatataatagctttaagagcagtagctacagtggtgaagatggaagatgataggagactctttcataatgctgctcttcgcaaacacaggaaagaggtgaccgaacgtatggatgtgctgaagagcactggaggtagcagagtacgtaatgctgtggctgtgattgtgaacataccctcaagcaatcaatggtggtgcatggatctgaataattactttcattgttttaatcagggcaatggtgagctggtgttggatgctgaaaaccctacatcacccaggggtgtgcagtatccatttgtagtgggcgagagggtcctgatcatggtacaaggagcacagttgcttttggctcttgcattactaagaaataataaagggcagaaatgaattct

SEQ ID NO: 45158 - DNA, 629 bp, Oryza sativa
gcatttatgcgttatacatctttttgtatcttggagaaaaaacggtgttgtcggagtagtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagtacgtaaggttgtgtagggttctaatgtacgacatttacacttagcatacatgacttagattgttaaaacataaatgtctcgtgacttagcagatgtttcttgtatcaacaga

SEQ ID NO: 45159 - DNA, 1501 bp, Oryza sativa
agtacctgtttttttacacaaggtccccccacattttcttgtttctatgattgagtacacttcggccgaatttagttccatattttttaaaaaaaaaaacttccaactttttcattacatcaaaacttttctacacacataaacttccaacttttccgtcacatcattccaattttaaacaaacttccaattttagcttgaactaaaacacacccttcccttcacccgattccattcatagggtgtgtttagttcacatcaaaattggaagttttgttgaaattggaacgatgtgacggaaaaattgaaagtttgtacgtggatgtgtttagttcacgccaaaattgaaagtttgattggaattagaacgatggaacggaaaaattataagttagtgtgtaagaaagttttaacataatggaaaagttagaagtttgaagaaaaagtttaaaactaaactcggccatagtataagagagagagagaggtgttgcttcgaccaatctctacaaacccagccataaaatcacacattcaaaacacatagatcacaaactccttctattgcttgcttccattgtgtacacagtatatcttcgctagttactcatttacatgtcccctccgtgataaataatcaccatggtttacagcatttttaataatcagacaaaacaagatgaaatattttcactatgcgtgtgtaccatattacgtgtatatatattgatgattgatgttactgtaaaaaaaatacaaaatgcacgtaaacagaagcaagagatatacatttttttagagggaaaagatcaagcttaaacgactgtacattttaaataaggtgaattaactgtacattgaacaaatgctttttttaggtgttaaaagagagaatgatggctatggtctagacgcggagtactctattatgcaatccactccttaaaatataatataaaaaagcacgtaccaattttacgcgggaaaatttattactatctgttatctaatcatcatactctatattaaaaatgtaacctattcaaataataacggtggatttagattgtaaccgtcgagatatcgactgatatagttatatacaaaatatggactacgtatatttcgaaacaaaagctattattgtatattcaatcaattcatacatttaaaaccttgtgtcccgctcaaaattgcgcgggaaaatccatacgttagcaaaacatcgtacatatactatgtgtttgtgcgtaagaaaaaaaaacgctcaccacctcacggagttagtcgaaagatccctgaacgtttcttcttgtgtttgtgcgtaagagcttcctaaggaaaacactagtgaaaacttgaagcttaatgaccatcatatttatatataagtaaccagttgcatttgcacggtattagtattatttggaaaattggatatgcaatgtaaagcacgggcatgcattcaaatgttgtgaaagcaaaacgaaaaaaaggaaaa

SEQ ID NO: 45160 - DNA, 871 bp, Oryza sativa
cagaaagaatagaagacaaaagtaggttctcttgattatttgtttcctatcctttggaaaaaatggttgcattgaaaaaaaactgacagctggaggagggatacgcagattgtgagatttgcaaaataaactgacaggtggaggagagatacgcagattgtaagactgaaaacaggagcatggttctatcaagtacgaaaacaaaagaagatagcccaatcgaaaatgtgcgatgcatgtgaattgggaaacagccgatgaatcaaataatgtattatgatgacatttaggaaatgtagtgagtcatacagcagtgagggaaatcagtagcataggtggagattatacaggcataagggttcctagttgtacaaaaatattcttatcaagttgcagtaattcttgacatatgtaggcagataatcttgtcagttcagttgttgattagcagtgatgagatatcacatataggcagcatgatgagtagcattggtagcaaacccagaggtgtcccaatgggtttagtggagttaaaagaagtagatgtggttatgacaaactccttgggggtaattttgtccattagattggcaatacctgaattgcaattgacaaggctgaaggagaggtaaagaaattaaagggggaaaacaaaaaatggaatgaatagtacatgaagtagaaaacagtggtaggatcccttgatcgagattcattcgcatgctgttgtaattgtgagtaggaaaggttggattgcaagaattagagacggcattcgcggaagaaattaatgaaaataaaagttagtaagagtaacaaacgtttgatggacgtaagaagtgaattgcaggaataatcaccactgaatgaa

SEQ ID NO: 45161 - DNA, 1501 bp, Oryza sativa
aaacatggtgccctcgatcttaattatatcttacttatatatctacctagctatatctcctgcctgctctaattcttggatcgatcgcgatggagattaattgatctgtacatcgatccatgcatatcagatactgctcacccggccgccatctgcgtgcaattcgatctagcaggtaaaattactgcttggatttttattgaattattctttctgctaattggaatattctatctgcaataaaagatatcttgaaataattcgatcggccaggctaatttcagtactctttaatttgatcagatctgcaagtttatgcaccctttttaatgtatggttagtactcaatttttggataacaatcgatatgatagtactccatgcatgcatgcagatctccatatgctaatctgatcttatcatttgcacttggtattctattcatgagtcatattatatatgtatagctaactgttatatctactccattttttttttttgctttatggtcttgtacatatatactgcaatatagttcgtgcttcattgacccggtaggtctctcacatatatatataattttgaaattattccctgagtctaatttacctaatttccttggtttatatgttcctatttggttttcttctgaattcatctatgttttgatcttagatccttttttccagtagtagatagattatatgtgttgtgatcggttttcccaaaactgtttgtacgttcgctatataaagatcaaaaaaagtaagtggcgtttttttactgtttatactttataccatatatttttatttgaaagttgtacgcagcagtagttttcatatgaatggattatgcatggtgtgctagaccgctagtattattgttcccagttgcgttgtgaacaaatggtactgttgcattatatattatatttagataatggaaatggtttactttggcagtatattatatgtatatatatatatatatgcagagttagccatcaaattcagtactggtacaattcaaggcaagatatatatgtttcaccaaattaagaagaaaaggcaatctctgtacatcaatataactggtgaattaagttaaaggcttgggttttaattattagcccctttatatatataaaaagaagttaaagtctaccactacatacttacatagtattacctagtacatgagaaattaagaaactgaatgcatggtgaatcctaattaattctgataggcggccggtgatagcaagccttttttacagtagtattgtttgaactttgatctgtgagctgcattgcatggtggaccagtgtttgactgttcatctcttctcttttgcttgcatgcatgtagctgggaaatgaaagctaagaaagatagcgtgcacgagcgtgcagaatggcagcatatgtatgcattattcagtactgctagatgaacagaatctagaaaaagatgaactgaacagcagcagcagcagcag

SEQ ID NO: 45162 - DNA, 1501 bp, Oryza sativa
gaaacgttcaaaagtaacgatgcaggcaaatatatagtgaactgcgtacatgtcacaaaccaaaccgttcccaaataacttgtaaaaggaacgttgagtagtttaccctgtgggttttgatgttctcttgatccactttcttttttctgggtcctctcttcttccctgcatcacgtcttttgggcttgttgagaggctcgagaagttgatcagttttctcgacatcctattggcaaaacagcaattggtcagtataactttataagttctccctcaaagagtaccaaaatccatactagatagatactccatccgtttcatattacaagtcgtttgacttttttcctagttaagtttgttcgagtttttgactaagtttatagaaaaatgtagagtactatttcaacacaaaataaacatattattaaaatatattcaatgtagatttagtgaaactaatttgacattttagatgttgttaaattgtactataaacttgatcaaacttaatcaagtttgactagggaaaaaagtgaaactaattatagtatgaaacggatggagtagataaaagcacaaacactgaaacagcaacggatagcattttggagaaagaaccgaaaaaccgtaactttctttgacgtaaataaatttaaagatatttgtagcaatcgggcgaaatgagatgagaaagcaatggtggaagaatctaggggaaaaaatcaagatgttttgggatataaagggatcggattcgaaggaataattccgtactagtatatcctataccagtactagtatttttttaatcagattcagattcgatacagaggatacacggttgctggaatggaatggaagatactcgagcggaaactgaacagacaaaacaaaatgtatattgattgattgaacacactgcgtctgcaatggctgcttgattagcaacaagaacaagctgtttgatcaacacatatgacaggacagagggggggagagagagagattccctacctcatcatcgtctggcgcgttgaaggcgttgggcggcggcttcctttccctgagcgccccgggcctcgtcgcaacaccgcgcccttcttcctccggcctcatcgccggcgggcggaaagcccggtcgccgttccggcgcctccccttggcgcccgatcccctctgcttaccactcttccgcttcgcctcctcgccggatccgtcgatcgccgccgcctccacctcctccgccgccatggcggtgcggcgatggtattgatattggggcaaaacgagagagagagagtggcggctgcggcgtaggctctcaagtgtcctccttttattacccgcgcttccaatattccaaccacagttacaaaaaggtcctccaagtttttcctttttttcgttttgctttcacaacatttgaatgcatgcccgtgctttacattgcatatccaattttccaaataatactaataccgtgcaaatgcaactggttact

SEQ ID NO: 45163 - DNA, 1501 bp, Oryza sativa; identical to SEQ ID NO: 44923

SEQ ID NO: 45164 - DNA, 310 bp, Oryza sativa
ccgagatgtgccgctttgagtcaatgtcaaggtactaacaaaatcacaaccctccatatgtaaatgagctacaatgacctactcatcgtaactgctttgtaaaatgcaaaacataagttactgctatgcgtatgaaggaaacacgaacgaggtacaaatatatgttaaacatggactaaaacttaatggaactagctatatttatcataccacatttttcaaaatatattatcaaatcgtttttacacaataaattacctatatttactacgtaattgcactgtctttttataattacgttttttttaga

SEQ ID NO: 45165 - DNA, 1501 bp, Oryza sativa
gatagcatattgtccacgacatcggattaggccaatcgatcgagcagctgcgcgtcgttctcacgtcggattgaatgaatttaattgcaggagttaacatagcccaaacgtgcaaagtgagtatagctcaactggttaggttccttgtagtggaaccagcccacacgggtgctcgtatttacggctaattattctttcagtggtaggcgacgtacccgtcgacagcgagacgcctgtggtgacttcgtcaatctctgcgttcatagggatgtttttctaaaaaaaaaaacatagtccaagcgtaccggcagcatcaggaaccacacacgctcttgtgtggccgtgaagcgtcggatacatgatacatcgatcggatggctacgcatgcattcaattcattgcttgctggtgtacgtttcagaagctactggagtagtaggtagcgtaaacctaacttaactaattactggtccctaattatttaggtttgcattgatagtattagcagcctcgagttaacatcactgatgcactgatgcacctgtcactctgccgtcaccagcaattcagatacttgaaagggacatgtaccatttctctccaagagattaggagctttaattaatcaccctacaactactatttttttttaccgactcgcaccagacagtgtgaagtttatattgaatgagcagaaaaaattataagattacaacaatggaacatcgtaactaggaaaacaaaaggaataagcaccacccacacacaccgacaacaccaaaccacagacccaagaaaaagttaacaccggaccgaccgtcggtaagcgtgaccgactgccgttaggtcaataaagaaactgccactgggaccacccaaaatacaaccctaacaactactatgtgagtggtactgtttggcaatggttaaactacacaaaaaatttaagtttggaatttttgtttgctggaatgctgggtagaattgagctagcattataatatgtcatagattttattccattatatcagaaaaatattaagggttattttgtaaaaaccatgttaggatggcagtaatgctttttaaagaagtacggataaattttacacataaattactttttaagtcgttaataaaccaatacgtcttacaataaatcttgggcaatcgacaagtccctaaatcccccatttatttatgctaagcttcgtaaagtattttaaatctatttttagcttttatttgtattctaatcatctagtagagcaggtacaatagcagactattagccaactataaacatattttaatgagataaaagatgagagagaagagcagcgggctacagatctgtagctagttacagtacggactccaagacgcaatgtgtgtatgacatgtgagaccatatattaatagtatagtaagtaactattgtatgaattggctatagatgaattggagctagtagtgggctatactattgaacttgctctta

SEQ ID NO: 45166 - DNA, 491 bp, Oryza sativa
ttttagttcgactttcgaacttataatagttcaaaataatcatctgctgtcatcatctactcaataaaaaccgaaatcctctgtcaccatcaaaacatagcaaaaatcaaatgccattaaaaagtgccaaatgacagttgacagcccaaaataaaaaagaagaaaaaaaaaggaacactattatattccagatttccagctgcaatatcaagctaccaaatggatccccaaaaaaattgcaatccattccatgaactgagcccaccatgcaccacacaacccccgctcctccacgcttctcgggctcccgtagaccgggtccacccgccaatccccccacacgtcgatatctccagcacccaccgcacccactctcctcctcactccgctcccctcctctcctcctcccttctcgcggaggccgccgcaaccaaaaaaaaaaaagtctaaccctagatccaggccccgcgtctccggcgatctcccggcca

SEQ ID NO: 45167 - DNA, 1501 bp, Oryza sativa
cgccgccgccgacgtggggagtggggactggcgccggccggggaaggggaggagaggcgtcggccagggaagaggaggagaggcgccgctcgagggcatcggccagggaaggggaggagaggcaccgctcgcggcgccggattgaggggaagagaggtagtgggcgtgaggataagggaaagaggggaaatgggggattttatattcttttctggatttaagggtgttaagtgtaaattttggatctccacaaattaaagaaaatatgagaactgaaacaaaaggtactaggggctgaaatacaaaattaaagccactcgcagagccacttgtagtgtgaagaattcaaatttaggactcgtagctctagcctacgtgacacactgaggctcctcatacgagagtgacacactgtaaatgccctaagaaaggaagaattgaagtgttcgactgttggttacttgttactccatcggtttcataatatgtttatttttaactcattttatttttcttaaaataagtttacttaatattgaaagtagataaggggggaatagttatattggaatttgataaagtatggatgttgtagtatttttgttttgtattagtttgggatggatgaaaaaaaaatattatggaatggagggagtagtagtttttccttgtcacaaaaataaattacctatgtctacgaagtgtgggccaacgtaaaaaaaaagtatgtgtcagggttatagataccacataactaatagtagttgactaaatctcggcaggacccaccacataccttgtcctatacggaaacaacctgcggatatagaagaagttccggataaggaaagacaaccagagttctacatggaaacgacaaggactactcggattgtatccatattggtttccctagttctacttggacaaggggacacctatgggtataaatacaaggccccctaggaggagaggggacacacccaccatagaggacacggaacaacagaagccacaacatacaagccaacatacgtcaagacaagccgccggatatcgacatcagagatatgcctagatcgaccctatccggtacctacagaggccggccgtagggatctagcgctgtctctgatctcgccgagcacaaactcgaagaggaagactaccatgttgtcgactacgagttagaacttcagaccgccatgtcgacaacagttagataggctaccccaaatattgtactggtgtgattatggtgaataagagcaataccggcttcggccaacatgatgtagggttataacctgacaattcaggggctcgaacctgtataaaaatcctcgcctccatctcttttacctcaatctcgcatatatcatagtaccaacgatccccataccatacaaataccggaatcgcgacatcaaacatcgacagtggtgcgccaggtaggggatcttttggtgcttcaaagtttcgacgagatgggtttaagaga

SEQ ID NO: 45168 - DNA, 411 bp, Oryza sativa
cacacaaactttcaacttttccatcacatcgttctaatttttactttcaattttagcgttgaactaaacacagccataaaaccaaagcacattaagttcaaaagctacataccaaaagccatcatcaactgacggatgaatgcatcgcttattcgcttcattgcttgagttaaattaatcgcaagtttaagctagctagctagctagctggggagttcccacggactgatcaaatagcagaccaatctaagtaaacttttcatcgagcaccttgtgtgcatcggccaaagcatagcgaagatcctggcatgcatgcttggagcaatcctgacatggcctctgcagagagaagaataaggatgtggtggcgcacagctagaaggcctaagcatctatggggtcgccggagca

SEQ ID NO: 45169 - DNA, 1501 bp, Oryza sativa
agtggggagattttctccgggggacaaactacctgtcaccaccattactaccaagatcaacaacaaaaaagggcaaaggtaaaagtagcttccagatctagggaggagaagctagggttgaactaccagtctaggttcgcaaattcgtcgagagagaaaaataaaaaaaataaaaggtgtgaggaagatgtaacgagcgggaggatgctctcaccggcgaggatgcggcggcgggaggaaaagcggcagggtggagcggcggcggcgccggcgatggtgggggatcggagattggggctcaggcgaactcggcgacggatcaacttgggtaagggggcaacaaggaaggggaaggcgagagtcggaggcctagtgtactacgggcctttgtataagggcccaagtctcaaaacacactgaaatcgggctcgggtttagaacgaacgcaacgaagtaggagttggattgggggagaagaaaggaaaaaaggacagggacggctgctgcaatattcgtgctgggcatttttttaattatttataattactctctcagtcacatctcataaggtgtttagattcagggtgtaaagtttcggcgtatcacatcgggtattatatagggtgtcgcatagggtgttcgggcactaataaaaatactaattacagtatccgtcggtaaaccgcaagacgaatttattaagcctaattaatctgtcattaacatattttttttaactgtagcaccacattatcaaatcatggaacaattaggcttaaaagattcgtctcgcaaagtagttgcaatatgtgcaattagttattttttagcctatatttgatagttaatgcaggtgtttaaatgttcgatgtgacaaggtgtaaaatttttgggtggaatctaaactggccctaagtaattttgactttttttctagtcaaatcatttcaagtttgatcagatttatagaaaaatctagcaacatgcaccacatcaacatagtgttattaaatctaacatcaaatatattttaataatatgtttattttgtgttaaaaatattactatattttgctataaacttagtcaaacttaaaatatttgacaaaaagaagccaaagtaacttgtagtagggagttttttttttattttgatgggtttttttctttttcctacgcctacactacacacgatcaagtagcgtacattttgatgggtacgtaataagctttaaagggactatctatttatttatttttcttacagatttaaagctttaaattttgcagaattttaaccaatggatacaacccatttcttctaaattaaataacctatcgatcggcggctgtccctccaccgtgtgcctcgacatcgtgctattgctggtgtacgacagcccaagttttttttcggccgcttcgtttcctattttggcccacgtattttcggcccattaagaaaaactgttttatttttgtaaattttacagcaaaccga

SEQ ID NO: 45170 - DNA, 1501 bp, Oryza sativa
ctccaccaaaactgggagtggagctgggtggagctctctcacaaaatgaactagagttgtggagctgggtttaggcagctccacaactccactccagacccaactcttggagctaaatttaggagttagagctataccaaacaggccctaatagtccattgttttcaataaaatagttttactttttttaaccgtaatatgtgggtaacagttttaattagaattaccccggcttcatgaaaatcttgcctccgccactgcataagacccaaaagaccaaaagggacgtaagttacaaaagacaacagaaatctaaaactgaaaatcgagagctcaaacactgcatctactttaaataatactaataacaatgccatgcacgctctcctatcttaaatttttattctcttactatttgttagtaggatgttgatagcatgacaatgcaaaaggcagtgttttctcacgtcagagtgaggtgccatgaaacccttatccacctaaaatatctaatccaaacccggctgctattggctaatggctattccgagtccagaacgaggggagtccaggtcaaattccttgaaaccggcctcttctctcgcagccacctgctttgtattttttttttttgcagagccgtacactaggattgtccaacgattttggtttgggagtatgttgagataattctcttttgttcttctagtcttttagaacagtagctgattagtttgttggtttgactcaactaacctggctgctgctgctatcaaatttaagtctttgcttctgtccacctacctctgtcctaaaatatagcaatttttagctatgatggacacacagttatccagattcataactaaaaatacttactccctccgtttcacaatgtaagactttttagcattgcccacatacatatagatgttaatgaatctaaacgcatatatatgtctagattcattaacacctaaataaatatagataatgctagaaagtcttatattatgaaacggatgaagtatattttaggacggatggagtagctccaaaatttgtgtgtagggaatactactcgtatctttttgactataagcttttggtctgaacctgaagacacacttctcaaataggagtatcaagacaataaattccaagcaactactactataaactgtgtgttcaactgccaaccgcacaagtattgcttttcaaaaaaaggaggaaaaacctatgaacttatattgtgtagtctgtgtattccaattgtttttaacaaaaaaaaatgtattctaaccgtataatattagccatatcacttgcgccctccatctttaaatccatatataaatgcaaacttattttgagacaaaggatgtagcacatgcatgactaataatacaggctgcgtgcgcatttgtttacgacaacaattgttgttgtttcatataaagatcatataaaattttgtaaggaaaaagataaaaaaaatcac

SEQ ID NO: 45171 - DNA, 583 bp, Oryza sativa
  unsure (1)..(583): unsure at all n locations
gtcccatcgggggtttggtcaatgcaactcgatctgaatgggctggaagaaccggcccaaaccatcccatctcaattggaaaaagtacaccgaaggtccctcaacttgtcatcgggataaaatacgtcctcgaaccgcaaaaccagatatgcgaggtcccttaactatacaaaaccggtcacccaaggtccttcggtggttttaacaccgattttggtctatgtggaggctcgaaccgcaaaccagatatgcgaggtcccttaactatacaaaaccggtcacctaaggtccttcggtggttttaacaccgatcttggtctatgtggcggctgagtcagcgtgggacccacatgtcagcgtgccacgtcaaatttcccctttcttttttctctcttttttttagttctctttgctgcggggagtagcaacgggcggcgcccagcgtgctgagcggcggccggcggggncggcgtgcgagcgcgcggcggccgggaggcggagcatggcgcagaagaggcgacgccgcggacgaacgcgttgccgacgatggtgtcggcgcacgacgcgaggccgagctcggaga

SEQ ID NO: 45172 - DNA, 1501 bp, Oryza sativa
tccaattcaaaacagggcgcccaagggcaccaccgccatttcgccgtgttaagtacggcccctcaaactctcaaacaacattttgaagcggaggagttagcatgattagttttttttttcgaattaaattaagatatgtgtcgccttatgtgggacaaattattcaatacaaaacaaatttttttaatcttgtcagggttatagctaccacataccaaatagcagttgactaaatctcggcatgacccatcacataacatgtcctatacggaaacaacctgcggatataggaggagttccggataaggaaagacaaccagagctgtacatggaaacgacaagaactactcggattgtatccatattggtttccctagttctatttggacaagaggatacctatgggtataaatacaagaccccctaggaggagaggggacaatcaacatacacggaacaacagaagccacaacatacaagccaacatatgccaagacaagccgccggatatcgacttcagagatatgcctggatcgaccctatccgatacctacagaggccggccgtagggatctagcgctgtttctgatctcaccgggcacggattcgaggaggaagattaccctgttatcgactacgagtcagaccttcaatttagaccgccatgtcggcaacagttagataggctaccccaaatattatacttgtatgatccagataaataaagagcaacaccggcttcggctaacaggatgtagggttattacctcacaattcaggggcccgaacctgtataaaaatccccgtctccatcttttacctcagtctcacgtatatcctagtaccaaaaaatccccatactatgcaaataccggaatcgcgacatcaaacatcgatagtggcgcaccaggtaggggactttggtacttcaggattttgatgagatgggttcaagagatggattctccgacaacaagctactcgacgacttctgctatggggagatttaacccgaccgaagtatgtctcccgttgagatcggaatcatcgtcatcaattatattcgatctggcgagatcgaccaaggttcaagacttcgtcgcggtggaagaccaacggtatcgacagcacgagagattgatccaatatgagtcggtcctattcccaatggggtgtcctcggacacgggcccgatttgaatcgagatcaaacgtcgcactgtcctagccaggttaaggtgcaaacaaatcgttccgcgcgtggcatcaactcctacagctagctggtgcaaggcatcggcccgctgagtccaagctggacacggcatctactatcatcgacagagtacaccaacagacagatccaagccaaaaaaacgtgcatgcatgtttggaccaatcaacatttatccacacagtgcatatgtacaattgctttggtaagatatgtctgggctactcagacaggtgcacagaaggtaattagtgagatcgatttttaa

SEQ ID NO: 45173 - DNA, 1501 bp, Oryza sativa; identical to SEQ ID NO: 44933

SEQ ID NO: 45174 - DNA, 163 bp, Oryza sativa
ctcccacttgtcgctcgagctcgcctcccaaaccctacctcctcctcatatacctctaggtctaggtctagggccttcctcctcctcccggcctcttcccctattagcgccttgtgccccgcctcccgccgcccctcgcccgccacttgttccgcggcttacg

SEQ ID NO: 45175 - DNA, 248 bp, Oryza sativa
cgtggaagggaacgaaaggggaagaagagtgcagcgagcgacgagggcatcgcggctacagccgccgccgcgcgcgacggtttatcccgtccccgatccgatcgtcgccggggctcctcctcctccaccctcgccgcgggcaatatttggaaccccccagggaagtatctctcaccgccgatcgcctctcatgccgtgctgagtggagcgcctaccgaatccctacccccacccgccgccgccgcagc

SEQ ID NO: 45176 - DNA, 1501 bp, Oryza sativa
ctttatcaagccggcccaaggcatgatggcccggtacgatagaaagcacggtccgacacggcccgtaaatgggctgggccggcacggcccgtacgtgagccgtgcctgggcctggacaacgggcacgacgggcggcacggcacggcacgaccactgggccgtgcttgggccggcacggtacgcgaatggctgctgcagcacgaggtcatcagtcatcacccatccacggtcaaatttcctatgcagccagcaggtagcagcaagtagcagctcgttttcttcatcggctcatcggtagcacgtagcagcaaccagcaaggccagcagcccagcaggccagcactagcatttggcaagattgttggctgactcacgccgccgcgccggtgggctacgtcgccgcgacgagccgacgaggaggagcaggatgggtgtggctgtcactgccgcgtcgccgcgacgggacgacgaagccgcaagccaccgctggcgcgtcgccgccagagtttcttctcagcgcagccggcctgctcccatcttttgggccgtgcttgtgccggcccggcacgaataggcccgtcgggccattgggctgtgcttgggccgcgtcctgaagaggccgtgctggcacggcacggcacgacgagtggggcgtgctgggccgacacggcccaatttggcacgaagcacactgggccgtgccgtgctagctctgcacggcccaagtcccagctttttgtgagcggtgagtttcttctcaccgttgcactatactgcaaccctgatctcaccacccagttcttcaatctcccgccagattttctttgtgagctgtgaatagacattttttagatctgaaaataggcaccacattggcactctcagtactaaaggactacacgaccacgtgaaatccaggtacgctagatgcttatcattagcatagaaacagtagtagctatgaccatacaatgttctaacatgcctacatgaaaaaaacagttgcaaaaaagtaacaaacaggcttcgaccattttggcatttttgggggaatacatgttgcctattctaatgcagggaaattacgagttcacttggtcaccctgcaactgcaagcattatttagttcttgtcatgcattgtttagatatagtacggaaacatacacctttcctctgtcaggtgcaccctcctccctttttcaaaaatgtaaagagatatcaatacaagtttacaagtgttctgcaattatatggttcaattcatgccattgctgtgtgataaaaggtttgtaggatttttaataatgcaattgtgatttttagcattgcatattttggtttggatggtgattacaacataatggtaaggaagaaagatctgttagttcatgcttgctctaatatctctccctccctttggcttgcacaaatttatgattggttagcatgatacattgactgattaaattccttggtctctccatcttatatttttgcag

SEQ ID NO: 45177 - DNA, 1501 bp, Oryza sativa
cacgatcattcttcttactgtcaaataagagtattatatggatcatattaatctagtgattttggctggtgtcagtatgagatgtatgccagtcacacacacatattacattatatacagagaaaacgggaaaaaagaaatcgatcgtcaacttggggttgcgttttgataaatatgaaaagctactgatccgctagcaagctagatagtcgcctctcaatgggagggcatcgcattcacatcgaaagaagaagaaattgatcgatcgatcgaacatcgaaggtagtacgtacgtagcaccggcctgatcgatcatggcgcggcagctgccccgcacggggtccttctcgggcgtgtggtggaagctcggcgatgacgccgacgagcagcggcgcctcgcggacgaggaagccgccgtcaaagccagcatccagaggcgccacgccaccgcccgcgtcatccggcgcaccattgctttcacctccttcgcccttgaggcagctggattattcgtttatgggttgtggacggcgagaatcaagactgctgcgaataaaacgaagaagaagaagcagctactgctgggtgtgctgttgtccgtgcccgcctttgctgccttgctcttcgccgccattgcccgcttccacaaattcagtaagtccttagttcctccatcgatcgtcaatttgtttctttctcaaccttaattgcgcatggagtggaggcagccactgcataaatcaataaccaatgatcgatcgtcaaattagttaatgtcgattgcagttgacgccaaggaccagcagaagctggatcggcttcgagcagagaggaacaaggccaagatgggccactcgaggggaagccaccacaacatgcaaaagctcctcctcacccacaatacccaggtccgtctttaatggattactagtactattaatttgctttgcttaatgaagataagcttttcctccctcaatgtcatatccatgcatgctcatgaatgattcatatttctttcttactcctgatttactaatactaacttggcccctgcaggagtctgattcagaatcttgtgcggaagcagcagctaccaagacagcaagccactccagattgagcttccatgtcggagacgatgactgaatgaacaatctgaatctttctatcttaattcttactatgtgattgatgtcctgaaacttgatgctactctgtaacctctacgtttctattaatggaaatgggggagctccatgctctcctagttcaaacaaaaaagatcgtatgtgattgatgcatgcattcgtgcatcacttcttttactcctacaattaacttcctctttgattttctatgtaccgtgccatcttctagtgattgatcgtgcctaatttgcacaaaccagaaattaatattcatgcagataccctgctctacgttcatcacccagttcagaaatatgaaaaatctatttagttgatagatgtaacataac

SEQ ID NO: 45178 - DNA, 390 bp, Oryza sativa
tttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaa

SEQ ID NO: 45179 - DNA, 1501 bp, Oryza sativa
gagcgccggaaactcgcaccgcccatgccttcacgccggcgtccgacgtgtacagcttcggcgtgctcctcctggagctgctcaccgggaaggcgccgttccaggacctgatggagatgcacagcgatgacatcccgagctgggtgcgggcagtgcgtgaggaagagacggagtccggcggggagtccgcgtccgctggcggcacggaggagaagctcggtgcgctgatcagcattgcggcggcctgcgtggtggcggacccggcgaggcggccaaccacaccggaggtgctacggatggtgagggaggcaagggcggaggcaatgtcgtcgtcgaacagcagcgaccggtcaccagcgcggtggtcagacgccgtgcaggtgcagatgggcatgggggtgccgcgagatcagggagagctaggaggactcacctgatcgatcgatcagcagctgatctcatcctgatcagcagctgatcatcgcctggctggccggcttgttgttactttacttcatgtaccgtagcagcaaaaaaagtgtagttaccactcaatttgtcttggctcaaagaatgactcattcttcaggcaacactttttaaataccaggggtctttgatttgggacttgtgtaggtttttagcagggaagggtggggcattgggagatactcctagcttagataggttcagagatgaagattctctgggctggatctgtctgtaaatcttttttggattgttgtaaacttgtcctttttattttttccggagtggagctaaactggtttatgtgtcatcctgtgcttgtttatcttccaagttgttgtagaaacacaaatctataatcattacagtttgcttttactaaccaaattatatactctctccgattgttttttttttatcatttttaactaatcagtgtcatatattaacgatgtactccctccgtccaaaaaaagaatcacatccaacactagattggttttttatgggaagaagggattaggtattatataaaaaagagtatagaaagcacaagtatatccaacagtacatgtctttaaagtattggatgatcaggtattcattaggggaaaaaataaagcagaaaataaaatatttgtgatgaggaggatgtgagtggagtgtttttgtcctgaccgaaaaaccctcgggcctcctcggtcggcccatcttgtaacagggcctgccctgccacgcccaacaatttatgaataagtcaaatttaggtacattttgtcatcgagtttgaatcgcatccttaaatcgcaatatcaaatatagtatgtctcttaacctacaaatatcagagtacctaaaatcttagggtagtattgtatctggttttaactgacgtgatgagttgactatggccaacctggttgagttagtgtatgactcacatatcaatcacatgaaaaatataaaagaaagaaaaccatctctacccctttctctctctcggtctcccccc

SEQ ID NO: 45180 - DNA, 208 bp, Oryza sativa
ggtggtactccgcatggatgcgattttgcttattttcacaccattcggcgctatacaaggcaaaactcccaatttgggtgtgttaactttatgccacgcttaaatcgcggttgtccttggccagttgtctctgttatgtggaccaaatggggaactcattggcagtcaaaatggttctatcataagattccagcagatctgaaaacca

SEQ ID NO: 45181 - DNA, 1501 bp, Oryza sativa
aaaaaacttaaatataacttttacctatacaaatgctattcaaacgcacaagtacccactctagaaacgttggctggtatgtccatcatcacttaaaaaatagctgtaaacctgagcataaatgcgaagtctaacgcttaaaccccgttgtcgaaacagttgagctacattcctttggcatacttaggggctgttcactttgttgtcattttcaaacttatcaaatttggtaaaattgttaaaaaaaagtgactacatttagtttgctgtcaaattttagtaactatataagaagttaccaaaattttggtaatgctaaaatttggtaaagttgaaaatggcataaagtgaacatgcccttaagtagaagctgattcatttattcttgttgcacttgctctaagagtaaggataatggtagagctcacttcctattattagcccatcttaaagccaatatatataatagattagctataaggttggctacaatattttcttctcctctctctatctcttaattatgcatttaatgtatttgtcttggatcttgtgataagctagctcttgcataagagccaacacccttgatttttcactacctctctcctccctaagtttatagtaggcttatagctcactattatacttgctctaaggccattcctaacccaatgattaggatggtgtccataacattaaataagttgccacctagaatgaaaattgatatggcaagtgaataaatgagaaaatagaaggaaaccatattttgcatgagacatggtttgtacacaacatccaagacatcatatgagataagtagcattaaatttaagtatgtaatagtgatgtttgtattggaagagtagtgtctagtactagtttcttaatgatgtggagcttatggaaactatgtctaatgtcttggattggaaatggcctaaattgttaaatcatacaagtcatcgtgttagtaagtttgtcgtaaaaagatacttctgcaatttcaaaatgtagctaactagtataggatgggatattacctagtgatataaatctggacatcccatcatgtactaggtatctatattttgggacggaggaagtactattttataagtaatatagttatagtgttaattttttttagaaaatataattaaaaaggagatagtacagtagtaaagacacataataaacataacagtgtgtgttggttagtaaatcgatgtcctgtgttctgttgtgggacttttagtaaacagagcagccaggggaagggcccaggcccaactaacaattaaaggcccagttacctgcatcttttcccttcttccctagtcttctcctctcctcggtgctcagttccttcacgtgctccagagcagcgtggccatggcgaccgcaacgcgagctccagcatttaaacccgcacccgtcccccgcttccctttgttagttaagctttcccctcccaattaattaagtttagctctta

SEQ ID NO: 45182 - DNA, 1501 bp, Oryza sativa
ttggcggcggcgccggcgccactgcggtgggcgcggacagtggcctgggcgcggacgagcgcctgcatgctctgcagcgtggcggcggcctgccggcgaacgaggtagccgcgcaccagcgcctgcagcttcaccagcgccttgagcgctcgcagcgccttcttcgcctgcacgaacacacgccatgattaacgacaatggcgacgacgacgacgacgaaaccagagcaagaagacgagcacccgttgcttaccaggaagcctctgaatgccgtctggattctgacggcggcggcggcaaggctgcgcgtgtcgccggcgacggtggcggcgaggacgggagccgagcggcccttgctagtaagccgcacgacggcgacggcggcctgagcggccgccacggcggcatcagccgccgccgcggtggccgcggcgacggcgatggcgtgcttgctctgctcccgctccgtgtcggcgtacaccgacctgagccacgccgcctcggccgccctggcgatcgccgcattgcccccggaagcctccgccgccgccgcagcagcagccgccgcggcctccgccgagtccctcgacgacttcccgaagctccacctcttccccccactcgccggcgcctcgcccttctgctccttcctccctcctccccacatgttgcggaaccaccgcgccgccttgcccatctcgccgctgtcgagcggtggcgcggcgcgctccggggtagctagcgggtgaggagtccgagtgagtgagagtgagtgagaatcgagacaggttttgaataagagagggaaaccgcaggggggagggggaggcgcgtgggtggcgtcgcgttcgaaataaaagaagaggagaggaggccaccaccaccaatgcggcagccattaccggacaaacaaaacaaaaccacctctctctttctctctcttcgcttcctccgtcccaatcccaggctactgatagaaagcaatatgaacagtttatcttttttatctagtggtttagatctatttatattaccatttcagttagtggttatagaaattttgagggagcattattgtaaaaaaaataggtgtaaggtataatcgtcatttattagtgactaaatcttctttctcttttatttttcttttcgataaaatatgagtgatgccaataaaatggatgaccataaattgatttagacaaaaaaaacataaataataaagtattccgtaatcattatattagtaaatttataatttacccttaataacgaacaattcagaccattcctactgtactaccggtagagagtaccagagaatataacatcctagtactatatgagatattacctggtacaatatatctagatataatgtatgtctagatatatagtacagtaccacgtaaggttcaatccactacttaagttaagttgtcatattcaagaacagacggagtaattaattaggcataaatagtggattaggattggacgc

SEQ ID NO: 45183 - DNA, 1501 bp, Oryza sativa
gagagagagggtgagagagacagagagactgacgaacccaggttgaagacgatgacgacgagctcgggcgcggtggcggtggccaccgggggctcggagcggaagggcgaaaacgacctccgcctccaccctcgccacttcaccgccctccgtcgcgacagggggggggggcacggcaacacgggggcagcggggcggcgcgacagcagggggacacgggcaccgtcactcccgctggccacaggccaccgcccacctctccaccacgccctccgcgcccccgccacgcctgccgcttgccctgcccccaccacggagaaggcgagaacggtgaggaggccggcacagacgacaatgtcgggcgggtaaagcatcgacttgagcgtggaacacgcggtgacgaggagggcgaggaaggaggagaggcaggcttggcgccggcgaggagcggcttgcccgcgtagacgccatgaccgcgtacgcaacggcggcgcgggtggcgaggaggagcgtgaatgtcgccgagaatgacacaacggacgcgatgagggtggcggcaaggtggtgcgccagctgcctgacgaaatgcgtgagcgggagccccgacgccaccgccgcgaggagtagcttccgcgcgaacgggagcacggctgcaccctccagcgcggcggtggacagcaggaggcaccccgaccgatgccgggcagagcaggaagaagagcaccgacgtgaacgcgtgcgggtccgcccgcagcacgcgcaccatctcctgcaggatctccatcgcgttcatcggaggcaacaacaccacccctcctcctcctccaccaccccgccgctgcgctcgccgcccgccccgccaccgccacgcccatcgtcggccaccaactcgtcgctcccaacgatatctgagacggtgacagagagattgagaggaagaggggaagagagagatgggagagtatgacaggtgggccccaccatttttaaaaaaaatgctgactagattaacacgcgcacgccacgtaggacgataccgctttggattttcggtcgaggggattattcgtccggtatagctagttcgtataaaatgactgattttgtggcttaggggggtaattcatgccgtcgtcctagtttcgagggggtaattcgtactttttccttttttaaataattatttttatgatttaactagacaaaccgttattttatctatctattaaatagccgacgtttctatctctttgtcacgtgatttacactataaaaaactttttatgatgccgcctcttttctggcggagaagcgaaacaaacatttataaaaatgtattggaggattatgggtcatgggccgtcagaaaaagccgattttcattggcggacatgttattttttgaggcgaacctcttaagcatcgctagtaaaaataggttttcgctggcggtaggtaaagagcatcgctcgcgataaaatttcaccatattaaaaggtcc

SEQ ID NO: 45184 - DNA, 1501 bp, Oryza sativa
cgcggagatgaagcggaacttctccttgccgtcgctatggctgcggccgatgacgagctcgctgatgcggcgccaccgcgtgatggaccccgtcgacccgctcttccgtggggggcgcgacggcgaggatgctggcgacggcgaggacacccagatgcagtagctgtccggcgacatgccgtccagctcggcgatgtccgacgacgacgatgacgacccgacggacgagttccgcccctcctcgaggaacagcctcctaagcagcggcctctactcctccgtgacctccgccgccgccggcgtcaccgaacacgcggccaaacacgtggggaacgaagggtaaatgagtccgacaaaaattttctccactccgatctaacgccgttacttcaaaatgcgacggaagtgctaccgggcgaaaaaaaatggtggcctatgctatagatcgaaagtgggaactttttatgctattttttggtaccgctttttttcctgtgctataggtcgaattttctcattgaaaaggggtagaatcaaagctagctggaactctcttttatttggatccttcagttggcccctgttctaaaaggtacagtacaagttttcatctcttcaactgaaaattcatgaattgattaatcagaactcacaactattgagtattgacgaggattccccttgttgtttttggcgcggttaccgcacccccgcggtaaggtggctaccgcgaaaaccgcgtggtaaccgcgagacataccatgattttaaaaactgaaaaggttaccatgtatgataaccgcagtaaccgcgcggttttgtaaactctggtattgacacgagtttaaaacttgtgcaaagcggtcacacttttgtttcaatacattagaacatctcaatgataacttcacagatgtgcaatggtaacagcatgtcagcgaatgccagaaatcgagatcgatcagctcaaccaaaaactgaattgaactgaattctgctatattttcaagttaaaatcggccatatacacagctttaacccgtcaatggcgacaaattggcgaccacagtctagtgtctactgctcatgcagtcatgcttcaatgttgctattgaatcaataaataaataaataaatctggaaagaagaaaaaggaagggaagtgtcaagtgtggttcaagggtagtagttaatatgttgtattagttgaaacgtccaaaaaaaattccacttcttacaagaattgaacttttttattaaaaaaatccaacaaaattctggcacagaaacacaatggtgtgttttttttttttggttagatcctacctctctcagctcattgctgcaggccactgtccactgaagatagtcgcaaaaccagtagtgcaatagtgcagtgcaatcagtctgcccagaaaaaaaaggttaagaatagttgacttgagagaccaataggcaataccgcaatagaccatagatgatttttttttggataatcatt

SEQ ID NO: 45185 - DNA, 173 bp, Oryza sativa
tccctcctcctccccttccccccgcccccggccccgccacgcgctccacatcccgagcggcgtccccgccggcccgccaccgccagcgacggtcgagcatgcagccgcgggtggctgcagggcgcctgcggcgggcgcctcgcgcgcgcgcagcacccgggggctcggcgcta

SEQ ID NO: 45186 - DNA, 1501 bp, Oryza sativa
ctcgaaaaaaataaacacagcaactacacaaaagtagtatctgttgtatcagtcggagcagccaaggagccaaaatgttggctcccatatgttgcaaatgagttgcagcatggatgtatgcttaatatcaagttttataatagaggtaatagtcatcttaattaagaagtaatatatacaatatattgcctttggcgaacttgtcccaatgtaccatgataattttattttatttatttagtcttaattcactgatcccttcatttcatccctcttggagtttgtatagaggttgctccttatgtaagggatgactcccctctttccttccttctcttctccacctcattatgtgagcttcatgacacttaggggtaagtacttggatgcatacagtactcgctctaaagagcaaacccgatacatttgcgtaatatgaaagccccaaaaacttcgatggatcaatggtttgtttgcattcgacagttagaggggtccaagagcatctccattgtacatgtaaagttcattttaagcaataagttaatatttctagtcctttatgttattacacgactagctacttaattctagataaaatataatttattgagtgaccaggcctctactagtgtttctattatttaaacatttagaaaataatattttattcatagatgctataaaattttattttcaaacccaaaccttttgaagaccaacgcgaatgacatggcaagtgccatgtaggtaagtatattatcatatcagctgcttgtcgacaagcccatacagtaacaccaagctccgtgacaagcctatgctgtataaaaaagattttgtacatttttttattaaaccgtgcgcaaagtcacactataaggaacatgaaagaagaaagtcaaacgtaattattttttatctggagggagtaattttattttctgtatctactcttcctctgccctggtagcaaaacatccacaaatcaactgcaacatccacttcacaactttcactgcaactagcaccttgatgtggtcaaagctatgaaccgtggtgctacaaactccacaaagtacttgcagatatacagatcatgcagccatgtgcccatcagcccatgtacttgaatttgcagatgcagcagcaaacatctcactctgaatttttgggtgatagctgccaaggaccatcaaccatgcatgctgtctccccatgcctgctggtagttgtgaattgtgaatttgtgatttctcctctgctttgactctgattatgagacatccataatccattggaggaggtgcttgctgatcatcaatcctagccatccatcctgcaaggtgtgtccaggatggaggcaggagatgcatgtgagccctccagcttattacctgttgcatatcaaaattattgccagccttttcaagattgcaatacatattgcatttatatactgcatctgtattcacatgatcacataattagaatcaatttg

SEQ ID NO: 45187 - DNA, 338 bp, Oryza sativa
ccagggtcccccacccagccagcctgcagcctgcccctgcttccgtgttgcattgccttctccgatgtggatgggagatgaaaatattcccatggctccccttttccgatttactcgatatagagtaaatcggaaaaagggagccatgggaataatttcatctcccatccacataggagaaggcaatgcaacacggaagcaggggcaggctgcaggctggctgggtgggggaccccggtagcagcagcagcagcagcagcagcagcagagcagtagtacttggcggcaatggcattggcattgcattgtcatctcacgatgcagggggccagagggga

SEQ ID NO: 45188 - DNA, 1501 bp, Oryza sativa
gctgtttgtaggggtaaaaaaaatgtgtactaactacgtacacacatgggcatatttattttaacctgcctaacttccgtttgtaagcggtatttttcgccctttgggtgatgtaggttgctgtgatgccttgtaatttttcaagttgattgctcgattagtctttaatatgttattagtggtaaaaaaacagctggtgtttcttgtcgaccttgctgtccgtttgttctttctgtaagttgactttgttgtcccatgcgttgtattcttccggatgtgtcccgacctcttttggtatttactgttaacagaggttgctggcgatttgattcactgtttaatggcctaggtgtcagcttgcatgcctgctgtttgttttatgcgtgtccatgctcttgcttgttgtctcttcttgctcctccccttatattgttcctctctgcattagtgatagctcctctgttctctctgcgatccgttcgttcaaggtgcttgtctttgttgtttgtcttttctttgttattttctcctcccgttcccgacgcttgctctgttctttcaattatactgtgctaattttctgatgattgtacgcctccttgtttctgtaaacttatgtgtttattgtttttacttgccaaatcgtattaagcactgggtatacttgcttggccgtattggtttatgccgtctgcatcagctgctagagctcgccgtgctgcaatccttcgtggtaggagtttttcctcgcgctcagcatgtgaactgacacgacaaactggtaatttcagtttcattggttaccatattcatttttattctccttttgacccaaatttaaacatgacttcttccgttgcattttttactgtacgattagcgcgctatgcttttcgatactcattagatttaaatttgtgtttaccctctactttttagatagtttgatcatgctacttttttttaagctgcatcgttcaagtctggtccttcgtaccagtctttggtgaatcgaaggaaaaggaaattggcgatcttacgtcggcggttgtttgcttcaccagattggttctttctcattatcttatcttttttatcgtttctttgattatttgctcccatgttgagccttgttttctctgctgctctttgtttattcttagtttcttcctcccgtgctcggtgtgaaaacttttttttttcttcctcgtttacagttcctacttctaatccttctttccctgttggatatgttgttttttccaccgattatatatgccatttgaaaggtttgtttcctctcgtgcttttttcccttatactccatttatcgtatttgtttccgtcttcctccttctacctttttttctgatggctatttatttatttttattcttttttctttagctgcgtattctggtcgatcttactatggtggtcctgactactcttgccgtaaatgctctgttgtgttttggtaccatgagagtacacgaaacac

SEQ ID NO: 45189 - DNA, 1501 bp, Oryza sativa
ataataatacaatatacaatatggattggctactatgattctttaaaatctaactcccttgatttgcaggacttaaccattcaacaatgtaaactgcctccagttatagatgaccaaacgagccgcctagcccagcacggcccggccatgatcaagccggatccgagattagtcgaacaaccgacctacatgcccgcctacttgctgcaccaacaacccaggcacggcccaataagattcgagccgtgtcccgctagcccgaaggcacgaaagccaccgtgctccttcttagaaaaatttttattttgcgtccctcaactcattgggttgtgtcttatatataaagctatactaagtctattttgcatcccacaactctttggcggtgccttgaatgactggaataagtctattttggctcccttatcgattttgcctcctaaatctttagaccgtgccgggccggcccgccatgccgatgcagaggcccaagcacggcccaacggtcgggttgtgccatgcctaggacggaccaaaacttcgtgccatggaccagaccattgagcctcgagcctttcggctaactatacctccaatacgtgcaagaggtgtgcccgctctgcaggcactactagagaactgatttttgctaggtcagccgaaaaccatccccggttccaaaaagaaccgagactaaaaatcatctttagccccggttgaaaagtccatagcctttttatgatctttagtcccggttgaaaagtgtctgctcctctactctttttattcccggttggaaacaccaaccgggactaaaaatcagcgcatagtatataatccctcgcacttatcctctagcaaccactctttccttgtcctcctcctttcttttcgtatcctctctcttttctctctattttcttatccttattcctactaagtcgtgttcttctgcctgcttgcggtagaggtgagcgagcggctgagggaggcgccgcgggcagcggcatgaaggaccgcgcaacgggtggcggacggcacggaggggcgcgcggaggtgggcggcggcgcagatgggcgcgtggcgagcgacggccaccgggcggcaggcggccgggcgcacgccggatgtttttttttccttttttccctcttaatttgtggatgatatttttgttgactatatatgttgttgtggatgatttgaaattgtggatgatgattttgttgttacgaatgatttgggatgtcgggagatgatctgtggatgagtttggttgaaaaacaagtgcaaatagctaaaaacaatgattcacgagtatataaaaaaagataaaatatctctagtcctggttggtaacaccaaccgagagtagagatgcatctttattcccgggtatttaaaccgctatctttaatcccgaatttcttctcctaatttataatccgggactacaaaaagagtttctaattgggagagaaaaggcattctccagtgagg

SEQ ID NO: 45190 - DNA, 456 bp, Oryza sativa
agctagctaaatcgcatcgattgattttggttcgttgttataaattcctcaatgatctagatcggcacccgacttgcaaaattgatctgtagatcaagcagcaaaggaacattttgaagaaacaagcaaagcattcattcgttcccttatttttgtcttgttatactattttgttagtccaacgtgttgaatagtgtcgggtgagaagaatatataaatattagacacgttatattaaacctcagggtagaggaggtatataaggaaacgagtctattcaaatcaattctatcataagatatattttactaccatatactctaacatcccccacaatacaagcgtgagcaacacagacgcttatattagagaaaaatcctaggagagtgctcaacacagatgatagccttttgtgttgtaatcgatgtagctaaagtgaagggtaaaacgtagcca

SEQ ID NO: 45191 - DNA, 1501 bp, Oryza sativa
gaaaatgataatggcagtttccgtcggaactcggaatcggtcggaaactttacggaaattttctcggaatttctagaaatcacaaaataccttgaattctttttttaaagcactgaatagttaataccatggtgtttggctgttatttttttaaaaaatatttattttgcaaatttaaaattacataagaatatttttttctgtattgggatttatcaatatcattactaatttattccatagattgtgttttatgatgtattattgatacttaacaattgaacttatatgattgtgttttatgataaattgttgaccattgagacttgagaattgggtttatcagtttaaggggtttttttttattccgataaattttcgttaccgtattcgtgccggttcgttttcgctccgttttcggtttcgataatattcgattccgttttcgtatccggggtttccgattccgatttcgattccgaaaaaaatatgaaaacgaaaacgataaaaataatttccgtccgtttccgtaccgttttcactcctagtgtatacaaggactgaacactgcaaacgtggaaggaagaaccgaagaagtggtagccagcatatctatggctgagttggattgttggaggtggagactaatccctcgtgcatgtaaaactaaacggttcattagttcatattaattatttcttaaaaaagattaatataatgttttaaacaattattctataaaaagaatttgcaaaaaatatactgttagcagtttgggaaatgtgggcatgaaaaagtataatacggggttgggaacccatctccccgcacggaaaacagagcagtccattagcacgtgattaattaattattaccttttttttttcaaaaaatggatcaatttgattttttaaacaactttcgtatataaatattttacaaaaaatacaccgtttagtagtttgaaaaacgtgcgcgcagaatacgagaacccctcatccgcacacaggggtacaactagcagtatagtaatgctcaatctgaaaacagatgtttattggatggattgtggcattatagaggtaaattaaatattttaataaataaagttaacatatcacttaaaacaaaaaaaaagtagtctaaataatgtagttgacaaatgtttttttataaaatgtattttttcaaacataaagtaagagtaatctgttttaataaccatggtaaacattatttacctaagcacaatatagactctaattcaagaatacataatgtaggaaaagtcaatttatgatttagttacgtatgaactcattcttactacgagttgtgtaaacggtcacgacaaaattcaatatgccctactacgtcaacttcacaaacctgtaatgctataaaatcaatctacatgtcccacaatgttgtttctttgttatagatcgaattttcactttaaattggtggatgcatggctactccctccgcttcatattta

SEQ ID NO: 45192 - DNA, 353 bp, Oryza sativa
tcacttcacttcatttctctctctcttaattttttttactcagaaatggcagtttggaatacgataagtttaaaattttacatgaattttgtagtgttctaattaacttttttttttgccaaagtagggggaaagataaatgttgtgcagtgaactgacctagctctaattacagtggtgaagtactaatgaggacaagcagcaaaggctaaggtagctcgcctttctgtttgtttctttgtcagggatgtgaggctgggttgggggctactttggaaaagggcttttgtcgtaaatgctgcagtaattaggagagagcttgcatggtatgctaatttcgtgccggttttaga

SEQ ID NO: 45193 - DNA, 1501 bp, Oryza sativa
tccaatgtagataatgatataaaggcaatcggctgatgatgatgtaataaaataacaatataatccaatataaactaatcggctagcaatgatatgataaataagcatcgatacgaaggttaaagcacacatcggctagaggtccgatgtcatgaaatccacaagattagattaaacaatgaaacctttgttgtcatcggctaaatccaacttatatgtatatgcaatcctcatgagccgatgcaacgtccagataactcaccggctgaaaccccgataaaacccttattggcaatcaataagcaggctagagattatggttctaagcacgacttagtagatcaaaattaactgatgcagcactaagtataaaaagaaacataatatctagacaatcaagccgatgactgattttcagggtggtagatgcctaggctaatctaatctagcaacgcgatttagccgataccggcagaaaccctaaaacgagaagcagccgatagagctaaattgatatgctaagactagattaacagagacatatgataaataggtaggcaagtatatcatctaaaccagagcaatccaagaggtcgaatgtactgatgcagccttgaacgacgccgatgtagacgatacaattgcctgggccgacggaacattggacttatcccttcgccggagatcgaagacgatgcagccccgcgtcgggtgccaagtcctgccggaacgtaaaaacaaaagtagaaataaaaatggtggcgatgcgccgaattgtattgatcgtagagatcgattacatagaccccgggtgtacatatttatacccatgggttgatacaagtccttgtcggacaagaaagaaactacctaaagataaaaggaaaatatagagtccttatcggacactaaacaaacttttctaaagataaaagaaaactaacaaactattcctaattaatagataaactgccatgccgcatcctctttaaactcggtcacttaggaataagcttcctttagtagattgatttccttaaccgaatatagcaggaatccgactattggtgacttgataactcacatcggctgattccgagatgctgcagccgataatgattctaagccgatgacatctttgccgattaccaaatttcactgttaacacgaggccagcgagcatggcgcagacggcgatgcagccagggaggcgtgacggctggtcggatcggtgtcggtacggccggcgaccaacgttcgtcggcgtcttcttcccccttttcttttttccatttcttctcttctttgtttcttgttgctccggcaattcgctcgtcatggcgcaaccgtgcggcggcggcgcgtccaggccgagcggctagcgtcatgggcagccggtgctgcagtgcatcggcgtgtggagcggatgcatgaccggtttccatggcgccgatgctgccgcttttcctttctttcattttgcttttcttctttgtttctt

SEQ ID NO: 45194 - DNA, 863 bp, Oryza sativa
cctgtcagcgtcccggagaaagggggaatgagaccgggccggcccaaagtaaaagagaccgagcgcgggagggactgggccaacggcccaatagagaaaaagaaggtaaagaaaaggataaataagaaaggatttttcctgggattaaaaattgcactttggtgatttttaattggtaaaaattatttccaaggctctgaaaattccactaaaaatcctgttaacatattgtgacatgtagaatccaaaaaaacaaaaattccacatgccgattccgattattatttgcatttattaattagggaattagctctaggttaattaagataatttcttcggacggtttatttagccaatttttaaagcaagcaaaaagggggaaaacttcagggcgtgacattagctttccctaaagtggtatgcttgtagtttcctctctcattactcttaactcttcagttttaccccctttttttttttggggggggggggtggtggtgctgtaaccatatccatacctaaattgcattaacatattacttcacgcgtaagcatatttcatttgttccttagaaatcatcacgtctcaatctaatttttcctgattttcatgctatatcattaccgaatgtttcggagtttcttatattatccacctaaaaaaaatactagatagctagtaattgctgactaattcagttcggcaatcttatggatatttctctataaattagatgaacctacaaaatgataaattctatacctttttcatcatacatttactaggatatggttgctgtttgtattttaatttttttctgtatatttgttatttgatctagtgcccttgcagtttgtgtagt

SEQ ID NO: 45195 - DNA, 1501 bp, Oryza sativa
cttttcccaactccgaacccctgaggcccgagccatgttcttactgggcccgaacgggattgctgccaatctgcggcccgttgaagttgggcctgagcgggactgtcaccaacgtacggcccagttcggtcagaacggaatttcagtgttcgaacgagccgtattagttgggacgggaagacactgcgacccatgtgaattgggcttcacgtgacggccgatgtaatcatctgggcctttcggctgcctaacccggcgaggacggagatattttaccctttttattattttttttaaaactttttaatttcaaaaataaatcatcagaaacttattttaagatctaaatctcttagccatggtaattcacatgatatgacaaaacaacactgtcacatcacccataacgaacgtgacagttttatcctgccacaccgattaaggagacttggcaagacaaatgttgccatgtgtcaatgtcgttagctaattaaacgatatatatttaagtttttgaaatggataattttaaaattaaaagttaaaaagttaggaaaaagtaaatagaaaatctgcggcctattcagattatagccaaaataaatcttaccaaattttggcaagatagcaatattaccaaaattttggtaggatttcttatgtatttactaaattcggcaacaaactaaacgtaccatttttttagcaactttatcaaaaaatagtatagttaaaaatgacatcaatctggttactgtatgtgaacgctgccggcgacttctgcaaatccggtgagttgataattgataattcaccatcttctcgccatatccgtgtgacagcgcacttggattcttcctgcgcccggcttgccgctctccctcatgtgagcaagtaccatagctgccgcttgcttgcctctcatatctcaccaaatccttccatggcgtgtcaactctgtcaactaaacaattcacaagatagccggtttaagaagcgtaaatagttccagctaatcattccccttgcccttgggtgagctgagcatgcagcagcagagaacatgcggaagtggcagcgtgatcagcttaattacggatcgaatataagacgcgtagctgcagatcgatctggtggagagaaatgagagaatcttcttcttcgtttgcatgttagtgtgcctgcaaagaagctacgaagaaacaaggagatcaccgatctgacgacgcaattaattggagctgagtgtgtgcagtgtacgtacatgcgccattcgcgctgcagcgcaggcaaaaattccatgccggtgatcccgctcctatttaagatcactcgcatttcttcatagttactactaccactgtcactaactacattgcagcaactcggcgagctagtccacctgcaagattcatggcgatgtggaagaagaagaagacaccgagcattctgccgctcgtcgttgtcatcgccgcggcgtcgctcatcgcgccgacgacgg

SEQ ID NO: 45196 - DNA, 1501 bp, Oryza sativa
ttttgaaacgactaggtgagtgcttctcaaatgacacggatgagacagtgcgtctcgtccggtcggagtatgtgcaatgtatcagtctttgaattgatcaaggttagcacccggccaacagctttcaaacggccacccgggcctggctgatcccatcagccgccgattttccaaacatcgaacccattccacagcagtaatttcacaagcagtagtcaaacaaaactacgctaggaatcacctcacatccgcccatgactgtgagcacggctgttcgaacagtttgttaacctctgcagagggggtacaccttacccacacgacgttactagccttggtcacccagcccgtgcataacagccacgtctggtgactttggggctttcacgacaaggcatttcgaaagccgacacaggttcaccgtatgccaacgagaggggtcccagactaacaccagattaggtcccagaccatactgtgccaggaagcccgggggttctccccgacaccaccccgttgaatccacatgtctcttggcatcaaggctcccccgattagcaatttactcagctaggggtgtcccatttcacccatgtggtcgcacttgtcttatgttcggatgtaattccaaggaaacggtccttaagtgcaagagcgggaaaccgtactcccggtacgttccccggtccgcgaatttgaaaattcatttagttcgcaagagccgacccaggtgtcgggtttttccaagtcttttgtaaaacccaagttttacccatcattggatatttttaaatttgaggagaggtgtcccgatgcgcgtgcttgaaggcccgtgcatcgaagcacaacagtcgacaaagggggtttaagtgttcaataattcaaggagggtaattgcagcaattaggattggggggccggcaggttatctcgcaagccacggccgaattacttgtgtaaatcctattcatgcattatttgcggaaaagaaatacttagatttaaattataggtgcaagatgatcaaaggtgacttgccttgctcgagatcttgagcttgatcctcaaaatcctcgcactgcgggtcttcgggctccgaaactacacgagaaatgggacaacacaacaaacggcgaaaataaagccctactattgacctctaggcgtgccattagatagatctcgagatttaaggaattttggaagttgaacggagtcaaacgggcttacggttgggaagatattgaatttctaagattattggattttttgtctaaaggaaaaggatttatttaaatcctttttgaaaaaaaaaggaaaagaaaagaaagagggagggaaattagacttcgcaggcggctcggtcgaacttgacgggccggccggcccgtgaaggcggcccaaagcgcgcgcgggggcggagaggagagagggagccggtgggccgggtccaccttgcgtggtcccgggtgggacccgcttgtcggcggcatggttcacc

SEQ ID NO: 45197 - DNA, 350 bp, Oryza sativa
ggcgcgcgcgtgcacccgcgggtgcgcacgcggctgtcgagtggctcctcggcggtgcctctttgcccctctccccctccgtggccggcgtcaaccacggccggcgacgaggtaagattagggttagggtttcgatcttttcgatccgttggatcgtttgcttttcctttcttttggatttctttccccaaccaatctaaactctagggtggctctgataccattgttagggttgtctattggatcacctaggtttagatctagtcgggtggttctatttgcgatggatgattgaacaacaatagagaataaggaaagggtttagggatgtgaccggttgacgcgttgga

SEQ ID NO: 45198 - DNA, 1501 bp, Oryza sativa; identical to SEQ ID NO: 42340

SEQ ID NO: 45199 - DNA, 428 bp, Oryza sativa
tgaatttcgaccaaatctactgttcaaccttcgaaattccaatcgaaacttaattccgagccgtgttgaaacatcgaaatttcgcgaaattcggccggttttcgtcggaactgtgaaccctgagtacagctagcactggcttcaaagcgtccgcatgcaagcgctagcaggcgaggcgactaggcaggcagccgcgagtgcgagtgtaaacgcgcgcggcgaggcgaccgaagcggcggagatcgaggcggcgagcaaacaaggccaaactcatctcccagactccatctcgctgccgttccggcgttcgacgcgcgcgcgcggctgcatttcggtgccattcggcggagccgatgcgacgccgcgcttacacttccacccacacgcgcgggaaccgttcgacggaatgcctcccctggctccccgga

SEQ ID NO: 45200 - DNA, 1501 bp, Oryza sativa
cgttcgggcccagtaagaacatggctcgggcctcaggggttcggagttgggaaaagtacactgaaggtcgctcaacttgtcatcgagttacaaaatcgtcctccaaccgtaaaaccggatatagcgcatcccccaacttacaaaaccagtacaaactaggtcactcagtggttttgacttcggttttgttcgatgtggctacacgtgtagtacctcaaggttctgagtttatatctccataggagcgaatttaagagattgggttatttgcggggcaaagttttctatttcaatggccgtatatatccagttggatgtagaggctggataaaaaatatcgttctctaaaaaaagaaaagagaaatggaagatttaggtggggaacctctctcctatgattattcaaaaaaaaaagcctcgacaaacatttctttttttttctctctgttttagtctccttaagtctatggtttacttgttatctgacttgactatcacaagctcagaacggttgtttgacggaggcctagtttagttcccaactttttctttaaatttttaacttttctatcacatcaaaactttcctacacacacaaatttttaacttttctgtcacatagttctaatttcaaagcaaacttccaattttagtgtgaactaaacacaccctgaaactgcacatcatcacctgtgtactgaattctatttgtctcaaaaaaagaaaaagagaaacgaactgtcagtcacctgcagttgctgtccaccactgacaagcatttcacttttagttcgtgtgccaaaattttgaaaaatgaaatggcatattggactcaaaaagctacttcagcctgccgctgacagaaaactctccaatccgacccatagggcgcgcttgccttttgtctcagattacaggaatagtgatgtccccttctgcagagcaatgtgaagcatgagtgcatgttcagtggagtgttaatagatggaactcaaggagggaggagactggagcaggagtgcaggacacgggcatgctatgccgtacctccggcacggccaatggcacaggtgccggcacgctttgctgctgacattagccgtcctcgccgcggctgttcatcgggccgttttgttttgatactaaaaatatgcactaccaatttataggcaaattgcaaattgaatagtatgcgttagttttgattgagccaaatatttaacagtgccccctatcttatttggtcatattttagaagcttcttccttatacaataagaatttggctttatatcggtaacaatctaaatgattgctaaataattttatcctaccaatattttggtagtgccaaagtttacctagactttgacactaccaatgaattagtagggtaatgaatcaaacaagcccatcatctgtcacccagctgcagtcactctgggcatatggagacgagctaaggcctatggtctatggcggtggctaagacaccatcagca

SEQ ID NO: 45201 - DNA, 183 bp, Oryza sativa
ccccctctcccttggccctccgactggcttcgccccccctcccccctctctgtccactcctcctgaagtcggtgacaacaaggtgatcttccttgtttctatcgactccctaccactggatccaccaccattagccactagcccactacctcttaactagtcgctttgttttggccccgcagc

SEQ ID NO: 45202 - DNA, 573 bp, Oryza sativa
gtattataaaataagggtgtattatagtttgttacctcagccagcggaaacagtgtgaacatgacatgtaattagaaagactctatggctaacattcaattcagctatagcttgcgtgatggctagcagaaacgacattcgcgtgcgtaaatgatcaagagcatttctgctgttcggaacatttctgttattccccgcggacaagtcacaactacttctgttcagttttaactactcgattggaaacttcagtttcaaggtacgacttacagtttctgacgacagtagagcttagaccagcaaaccaatcatgcatcattacgcgttagtcaatctctcggcgtttgcagagccatgtgcatgcgatcgttggaacagtgttcgcatgcttcaataatgcataacgacaatcattccctagcttaattaattggtatgcaatccatgcctctctgcagagttcagacctcctagatcttattactactatttaagcaccaccaatgccgcacacatccctcacctccaaatccattcttcccaacaatatctagctgcacctgcgcaggagac

SEQ ID NO: 45203 - DNA, 1501 bp, Oryza sativa
ttgaagtatggagtattatagcacttgcccttagagcaggtttaatagatcctaatcagccggcgctagcacactatgcgtcagccaaatctgacgtggaggagtgagaagggaagaaaaaggatggagcgggcattccatctatcgcccggctaaagcgcaacacacgagaaaaagctgttttcttccaaccagaagcgagaagatgaggtgtacatgtgaatattaaatatctaaatcttcaatagagataaacaaacagctaacctaacagctatcctattatattagtgatggctataggtgacatgatattagagtcggcagctggctatattattatacgttggtgtcggtttcctcctcgagcgccgcgtcgggttagcacctgacctgacctgactccggtagcggccgccaccacaccacaccacacccacccccacgtctttgaccgcgacgctgactggctcggcccagtcgcgcgcatgccgcaccctcactgcgcgtgggccaggttggtcggtgggtggcccacgttgcagtgaaggtaagagactctagttggtgggtgggtgggtgggtgggtgggtgcggtgcggtgcgggagatagtttaagccggtcaggtcatgacctgccccgggtcgcacctgggcggtcaaagcgcacgcgtttttctatttcttggacatgcggcgtgcgggtgccactgctcccttttccatagacacaagtcagacgatacgatagctgttcatcgccatcaaaattaattaagtgctgtgagcaagttttatgctgtgttttacactaattttttaacgtacagtcccttgcttattttatgtgcatgttttctgtactactaattaaatggtatttgttttttaaataaattataaaaaaattacttggaaaattatattaatttaaatttttaaatatttctaagctaatatttaataaatcatacggtaatccactgttccgtttcaggtgtaaggagaaaagttttcgaacacatcctaactgtaattaacacagccttaacctttgttaaatcaaaagttactacttctatttttcggttacttaattatattgattaattaacaatgcataacaaacaactccaacgatagttgttactgctagtgttgtgccaccaaaattttcacaaaatattatcgtatacaataagggctcttcatattatgagcaatgtttttctgatgggatagtgcttacattgcacccaattgttggtatctagattccagaacctgatagttcgaactgatagcaaacatttgttgatgcgtggaagcaaagggacaatcaacaccagaagtttgctgctagtcgatctcacattcccgtcgggagtgttctattcggttcggttgaatggtatatatggaatactaagagcaagttcaatagtatagcccactactagctccaattcatctatagccaattcatacaatagttactta

SEQ ID NO: 45204 - DNA, 1501 bp, Oryza sativa
cgactaagtctcccgtcttgctgtaatcgagaatttgaattgaagtcaagaaattttatctcggcgcgtacaccatctcttcattccgtattccttgtcgagatccaccaaccgttctcgagtgaccgagaaggcgcagagcctgcgacgaagccttgtcaacatttgttgtactcgccttagtcgatcttggtgtagaaccatagagacatggcccaccacataccatgtcctatacgaaaacaacctgcggatatagaaagagttccggataaggaaagacaaccagagttctgcatgaaaacgacaaggactactcggattgtatccatattggtttccctagttctacttggacaaggggacatctatgggtacaaataaaaggccccctaggaatagaattttcctgaaatcaatactcagaaaagaatcctatcttactataaagttatcccccactaactccttaagcttaacatgcaaagatgccacatcatcatccactaacaatcatcacatttaaacatcatgcaaacatgctatatctttatagtttttataatttaagagcttttcgaatacaaacatgttaaattatcatctaacataattcacataatgtttcaatgcatatttttattatattttatgatatcctatatagttcatcctcacttaattagtgcttaaatgattaatctatggtccaaattatctttctccttttttcctataattaagtcatatcacatcaattgtttttagcctttagatgattaatctatggtaccaactagtatctctctacttttcttcttccataaagttatatcaccttactttttacgtttgaatcaccattctacatactatttaaatttaaattatcataaaccacattaatttacttaatctgatgttatctagctatcttacacgttatttttttattgttatcatactaaattcccgcagcaatgcgtggggtttcacctagtattagatagaaatagcccccgagcgaatgctcaaagggtaacatgttataatatgtatggaaaactgaaaatgaattaaatttacagaccaatgttttatatatgagcatctactcttttaccgacttcgatcagtcagtttgttgaatcatacactctccctagctcctagccttgtcgtcggagaatcgttcttggatgataaggctcttggaccctttacctgccttggttgaaaaagcactgatcctagcccccagccatgaagttggaaaactcaatttccgattacacggcttggttaatacgcacggcgagaactcttacatgatcaggtcttacatggtcgtttgtctctacatgatccgacaaggccttatccgctctgggcgtccccagccgaagttcccttaggttcctcagaggccttgtcaggacggcgtaaagggacatgaggataggtttcaactctaggtgtcgtcgtggtaagggatctctgg

SEQ ID NO: 45205 - DNA, 1501 bp, Oryza sativa
gtaagttgagggatgtgttgtatccagttttctggactgagaatggaaaataagactagaggacaatggagggacctagagtgaacttattccaaaaaatcacaagaacagcggaaggtccagtcgaacaaaacaagccatggtttggcccaagcttatttcagaggctgaaattgttggcccaagcttattcagaggccgaaatcgttggcccattcctgtagataggagactttactccaaaatccctgcagcttcagtttttttagagagagacaaagtcgtacaactcgtacagttcctggttgagatcagaccaagcccaagtacccaactgcaaatcaaatccaaaacagattagctaaaaaaatatcaacaattcttttcttgacaaaaacaattacaatttacaaaggcaccgatcaatccccaacctcgcagatgtatttttgtatgtgagttgcatacaaattacattatattgtaactataacatgatacaattacatcataattatattatataatgatgatatttgaaagtgtttcactccagaactgactaaagttgtataggcagcctgtctaaactgaaagaaaaaaaaaggagcaacagaagagcaagggcggcatgagcgtggcatgtacagtatatatgcacgtgcctgcatgataatgcaacttgtcctgtctgcctcaggtcgtcatgattctttgggagctcgctcgctcgcacgcaaacatcggtggtagccttcattgtgtcgcgccgcccgcccgggcagagacaccatcgttagttcacaggcttcctttcttttcttttttttttaatttctcccagttctcttctctgttggcttcagcgatgagcttagatctactccgtccgtcccaaactaaacgcaaccataaattttcgtgtcaaactttaatagttaatcttatttaattttttatgattagtatttttattgttattagattataaaacataaattgtactttatgtgtgacttatttttttagtttttttttaaaaaataaataaaacgaattattaaagttggacacggaaacttatagttgagtagtaactactccctccatctacttttaatagttatatttctaaatatgaaaattctatttttataagcatatttcaatccaacaacatatcctcttaataactttctcggatttaatacatgactctccattattccacacatgattggctacatgggtatcgaaaaatgtaaatattaatgaatcgcttgtttacgaggaatgactagtagcatgtttaaattaatgataagtagaattacttatccttagtctgtatgtcaagatgaaatatgactatcaaaagtagatggaaagagtattatacaagttgcattgacttttttttatttaaacttatattttgattaaatttatagaaaaatttaacaacgcctttaatactaaaatgattttattaaatcttaga

SEQ ID NO: 45206 - DNA, 1501 bp, Oryza sativa
gattaccgggtcagggacttgtaccgtctctatgaaaattgactaaccacgtaaaaatccaattctgcccttccactagttccatacacgcgaacaaagggggaggtaccctgcaccggattcctgtacctcgcggtaccgatgattgtgggtcgtttgatctggctgaatggacggttacgattgcagtaccgcgtggtaccaaaaattctgctggacagtaaaaaatctctttgatttgctaataagcagtatgaataaacatatgcataagcgaaaggctaggtgctactacttctactgtggaagtgctcatggaggggggccgaatggccgatcgatcgagaaagcattcatccattccattctctcgctctctcaaaagttgcaatcttttttttttctcctcttcttctttttctttttcgttttccagctcatctctgatggatcatctctctctccccgtgtggtaattccgatgtgatcgatgacgcgtgcatgcgtcggagtaggagtacagcctctgttgttctttttggtcttcttcttctacttcctcccaaaaatgcgttgtgagcgagaaaaagagaagcttttttttggtgtgcgtgagtgtgcaactctcaatatttgttgcccgaaatctttcgagtttgcgtctttttgggcttacactgtcccttttttatcgctgcgtccaatcctaatccactatttatgcctaattaattactccgtctgttcttgaatatgacaacttaacttaagtagtggattgaaccttacgtggtactgtactatatatctagacatacattatatctagatatattgtaccaggtaatatctcatatagtactaggatgttatattctctggtactctctaccggtagtacagtaggaatggtctgaattgttcgttattaagggtaaattataaatttactaatataatgattacggaatactttattatttatgttttttttgtctaaatcaatttatggtcatccattttattggcatcactcatattttatcgaaaagaaaaataaaagagaaagaagatttagtcactaataaatgacgattataccttacacctattttttttacaataatgctccctcaaaatttctataaccactaactgaaatggtaatataaatagatctaaaccactagataaaaaagataaactgttcatattgctttctatcagtagcctgggattgggacggaggaagcgaagagagagaaagagagaggtggttttgttttgtttgtccggtaatggctgccgcattggtggtggtggcctcctctcctcttcttttatttcgaacgcgacgccacccacgcgcctccccctcccccctgcggtttccctctcttattcaaaacctgtctcgattctcactcactctcactcactcggactcctcacccgctagctaccccggagcgcgccgcgccaccgctcgacagcggcgaga

SEQ ID NO: 45207 - DNA, 1501 bp, Oryza sativa
aggatcggacctgcatgtcacaaagttaccacaacgaatggccgaaaataactcagcttaggtcgtgttctatagtcccctctcccaattttcacttccttgtttttcgtgcgcacattttccgaaccattaaatggtgtatttttttataaaaaatataggaaaattgcttttaaaattatgttaatctaatttttaaagttttctaaactaatgcttaattatttatgcgctaatgagttatcccctttcctatgcaggggaaaagttcccaatcagcatatcccaacacagccttagtagtagtactccagtttaaaacatggcaaggaaggggttgctttgatactggcacacaaatcatttcatgttccaaatttgaatgtgatgctatccagatccatatgcaccccatccatacattataccaccacttgagcatgtgagatagtagaagttggcctgaacacagtcaggactcaggacccagggagagactctggccactgctgttgcctattgctgctaactgatctagcagcagcagtgaactgaaagtctgaaaatcaccctctattcaaccatccatgcatgttttgctctgtttgtgaggggctacttgctttcttttcagcaatgattaggttctgatttgatagatgaggaggggatagatacggtgatgctgatgctggtgtttgttccctggagtacattggggtagtactgccacatttttgttcttttctcaagattcttgtccttgagctctgttttcctttcaccttgttccaggccggtctctgcacctttccaatcactccgttctttgcatttgccacttgttggttttacatttgacatccttttcaaaggagggactttggagggtttttgaaggaatttgatctaaattcaacaaaaatcattaatacccctaaccttctgtcttagtacgtgttggttggatagagacagagtaacatgtcctaagggttattttcgtcggaaacaagacaatgtcaaaaccggtagagacaattgggcataactcatcgggggttgaacgaattgtgccatttgtagtatctaaacaaacctttgtgttagatcagtttttaagatatggacataaacttatacctcattagaaacacataatttcacaaaaattctaaatatagcttaacatgaatcgatacatctacaagaatcaaagaaaaaatcttgacatttgagatgagaccttataatagtttgcgatgaaacaagtcctaccagttggtcccatgcatgaaccatgggggaagaaaacatatggccaatttggttatcatcaaactttgttacaactggtgtattgtttggttagagaatgagcagtcccaccattttatctacggttaattatgagttatagagcttgtttgggggagcttctagctactgcagcttctctcaaaatcagaagctctcccaaacagtctagcttttggtccaa

SEQ ID NO: 45208 - DNA, 1501 bp, Oryza sativa
ccttgcgctcccactaatcgtagtggaattcatcagcaaaataaataaatcatatagaaatagagtttttttactattttcatcatacgattcttgttggttgacctcaagcactgaacaagataatgcaaattatttggctatttcaatgtctggctcgccagtagttggaacttgggagagaaaaaaataagcagcggctgcaaagggttcaagggagttgagcctgttgtagttaggtggtactgaaaggataattgattcagaaaagtgaaatactccaacgtcctttccattccaacttctcgcttgtccaattaagaactttgaaaaattccgtactaattaagaatttcacggaacgaatttaggtagccaataaatgagcagatgcatatttttttattacaaattaaaactgattgagaatttctcgttgagaaatctgtgtgtgaaatatttctgatttagaatttcatctctggctggtaaaactgatatattacagtttggcacatcaggaagtatatttaattttttttaagatgatggatagaaatccgatcctatattcacacacatacttaaagattacatgggtacttaaggcacattctaaagagataattgagcttaactactactcgttttctattagcatgttttttaaactattaaacgatgtatttcgtgcaaaactttctatattaaaaatactaccttttcaaaataaaataatttgatttatattttttaataattaatacttaattaattatatgctaataaagtttttattttgcgtgtcgctaaataagacaaaacgttaagctggaaagaacgtgtcctaacactccaaatcccataactgacacaaaagaggaaaaacaacaataagaaagataaattttacagttcctaagatgtactgtatcaaaacttttaatgcaaacttagctcctctcggtacctacttaactactataaaatcactaaaagaaaaggtaaacacgatatgtagttagaaagattgtatggctaacattcagtttagctatgcatgcttgactagcatagaaacattcgcaagcatgcatgttcagagcatttctgttcttgctgcgaaaacgcaacgacttgtgttcagattgaactgaataatgctaatatacgacttatcatttctgatggaggaaacggtacgtagagcttagaccagcaaaccaattaatcatcatttcgcataagtcaatttctggacgttgcagagccatcagccatgtgcaacgatcgttggaacagtgatcgcatttttcaataatgcctacgacaatcattcccttgcaatatgtaatccacgcctctgcatgcaggcctcctagatcatagtactatataagcaccaccattgccgcatacatccctcacctccaaatccattcatcacaacaatatctagctagctagttatctagcttaattactctcgatcgactgcaca

SEQ ID NO: 45209 - DNA, 1501 bp, Oryza sativa
taattttcacatccctacttcttctaggcatgcaacctaataaaagtctttactcataagtgcttaacgaatttttttgtgatttttgtgttgaaaatttccattttttctttgcatatatgaaaatattgttgaatttcggtcaggagcgagaccgagaccgaatttatcggtcctgactttttgcgctgaaattcggttttcatttttcaaagaccgaaaagaacgaaagaccgaagaccaagaccgaaattttcggttagaccgaatgcccacccctaacggggatggagctggatttttgctgctccacagctccactctaccccaaaagacccactaccctttaattttttagtctatttatacaaaaatgccactcaactgctctttcagtcctcctctcctcccccatcttcctcccgatccaaaccgagctgcatgcggggagcggtggcgtcggtgggtagcggcgacaggccgaaggcgcgcggaagacgacatgcggccggcggcggccggcgcgcctggggacggcgcacggccggcgggccggcggcggatgcggaggaggatgacagagcggcggtcttcttcaacccaggcatgggctctgggcgcaagggtggccggttgtttgtgcctgggtgtcacgccccgaactagtcccgaccggaactagcccgtgacgctccaaattaacctgttaatcgataccagtcccaggaaacagtgttggtatcacagggagacagaatatcacagcaacagaggtctctttattatagagtaggagtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtctcgtccggtcggagtatgtgcaatgtatcaatctttagatcttgaaacaaggttggctcccggccaacagcttttcaaacggccacccgggccaacaacttttcaaacggccacccgggccaacaacatttcaaacggccacccgggcctagctgatcccgtcagctgctgatttttcaaacatcgaacccattttctcaacagcaatttcacaagcggtagtcaaacaaaactacgctaggaatcacctcacatccgcccatgaccgtgggcatggctgttcgaatagtttgttaacctctgcagagggggtacactttacccaca

SEQ ID NO: 45210 - DNA, 1501 bp, Oryza sativa; identical to SEQ ID NO: 42391

SEQ ID NO: 45211 - DNA, 1501 bp, Oryza sativa
ggacaacctccgcacaatctccaagagaaaaagagagaatgagatagtgtgggagtgaaccaacacaaaaaaaaatgatgtttgtgtattagaggtaatatgttgtacatgttgcctcttaattaatggatagatgacatggctaaaattagaggtagtagccaactctactataagatttgttcttagtgagcagttttttttaagtatttaaacttgatttagtgagcagcttaccattacaaatcttctcttcactagatatttcagaaagggtaaacatgacattcaaatgggctgtaaatggcgtggcatgctgtataaaaggaacattctagggaaatatttttggtttctgatcttcaaactgacattatttagtttcagtttgtaagggatgctgtactttactgatgatctttagagcagcattatttagttccaatactttacattcaaaagcttgttcaccttttattacaaccaattgggtagctctttatgctatatctgcatgacatattagtttgcgtgtctacctaggtaactcggcctatatctgcatagcgtcttagcttgtatgcgcacctttggcgtaacgttagtagtaggaatattggagtactcagactgttgtgcatgcccaacttaagtccagttgcatccttgtagaatcttagtccaatcttgtgtgtacattggatctggatccacatgttgaaatgtgcgcacgacgaacattgccatggcgcaaaggaatgcaccattgatttttaaatagtatattttttagcaccctagatgatctcacatgccaggaagcaggccttctctattttttcttccttcttaacgcaggacttcaaaaatgaattgagagctgtttcattactaagttttacttgccaagttcctttggttaaaacttaatgtatatcacttacaggtacactcttaactgattagccactaggaaaaactgaatgtctctgaacgtaatgctagaacatattacgaggagaatcttatctagtgatagcaaacaagttgtcaataggtgtattcaataatgatcttaaggttttcctatagattggaattgtgatagcttgacaacactgttatttatcattctacttacccgcatattcacttaagttaaaaatatctaaatagtaaccaccaactcatctagaaatcactcatctatcctccttgattagaaatcactgtaataaacttctacagtagtagccttttcttttgtcaatcttctgaaacaatatgacttgaaggaaaatttcgtttagcctgtgacaccccaattgactccccaagacgttagaaacatcatgtacttttggtttcctatcatggcttcttgcttgaaatgagaatgacatgaatatgttttttttttaattctaattcacattttctccatacatctgagttctcgctgtgtttcttgcatacttactttacagggtgacaaattgcg

SEQ ID NO: 45212 - DNA, 1071 bp, Oryza sativa
gatggagtatcatataaaaagtacttcaaaaatatgaatctagtgatataacatgtataatacttagtatatatatatatatatatatatatatatatatatatatatatatatatatatatatatatatatagttagtatgattattagtaaaaactaccgagtttgatttttctttaaaaaaaaaaagaagcgccctataatttgggacagaaggagtaccatgtagctttagtgttagattgaagccattgacgctaggatattctgccacgtggccaccaccccaaccaccatcatcgctaaaatctaagaggaggcgttagcttggatcaagacgggatccgcaaaactcgctgagttaaccccgttggaagaacctacgtagtttccctttttgcggactcagttttttttacggcagggacatgtaaataacttatttggttgtttggtttttcctcctgctctatcaatatatacgaggcaaaactttagccttcttttttttaaaaaataaattgctactgatagaatggttagaagtgatctatcttcgggcttgttctctttcatgttaattttaaattttgacatttaaaatttggcaaggtaacacatactaccactagttcactagatcaataccaagtcaacacaatcttatcaagttgtggcattttcagtagtttctactgttgaaaccttaccagaatgtctcaaacctaacaccacacatgtccgtcttactttcctaaaatttgataatgacataatttgatatcaccaaagtttcgtaagggacattattactaataaaacgtatcattcacagataataccaattgcagaccatacaatggcctgcccacaactttgttatactcttgagcacaactatagagatgaataagattttttcccccaagtaaataggaaggatctctgtgccagaagcacataacagcaattttgccgaagaaggcagatgtttcatagcggcagatcgatgtccacgttcgaccaaatcagcataaagtatacataacatgaatacgattttcaaaagaa

SEQ ID NO: 45213 - DNA, 1501 bp, Oryza sativa
tgccacaaaatcaagggaaaattgcagaaaacaaaaggacaacaaaaaaaacacacatcagaagtcacttgaaatttaacatttcaccgcataaatcattttgttgcaaatatcaacctccctatcagttttgttgtaaaaaaacactttaatgcactcatgcttaattgaatcgatcccttatagctgaatagcgaatctcaacgcgataacatttaagctctcatcaccatttctatttgtggaatctccgaaaaagtatccagattatactttaaaagtatttaatttggtaaacaccacattgatggcttataatttatgaaaacatgttgattcagttaaacacatacgcactaaggtggattttacaacggaactgagtagaggtgggcaattacaacaaaataacttatgggatggaatatcaactttaagtgacttatggatggtttttaaaaaattttcctccaaatcaatattgctaagccatccgcaacatacaataatataatatagtaaaggcaaactgattctacagcatcgtaattttgcgattttagttttgtaccacaaacaaaatccagtttactttactggcaccagaagttcccatcactcgatcggtgatctgtaccacctaacagtcaaacttagatgatctctcaaggtcagtgttcacaattccagtttcacgaaatccgtgtttggaaacgataggaaaataaacgataaaaaataatagatcaatcacagaagacactggattttggaaaactctcctaaaacagaagaaaaaactacggcgccagccagcaaaatatcttcactatatcgaggtgaggttagaacgtcgaacggcgtcttacaagagatatatatgaaggtgaaaccctaaaaggataatgatccggcccaagcctccgcttcattttggcataagctagcctttattatgtgcaaatgaatttaaatcacaactcaactatccggactttctagatcagtcaaaaatgtaaaatcaaaggtatttttaattgttattctgtgatgaacaattggcattggagattattggttttgttatttggaatttatttgcgaagtggttttggagatgattggatttcacatgtgagtactgctgtttgttggaccggtcagaccgggcatgtgctgccggtcagaccggtgcagcccgcggtctgaccggccgactctatgtcggtttcggtttcgggttatttgtttggatatccgtgattgtttcatgattatggcttctagatggatactatgcgtatgtaatactgtcgttagctactaatgagtcaagttggggatagtttggtctcggaatatggtttctttgtttgttctatgtgtaggtgactcgggatgccgggagagtatttgcggtgatggaccgggagtcagcttggggataagacgacgtccgtggtggtcagagatcatgcgggatactaagactagagttcaa

SEQ ID NO: 45214 - DNA, 1501 bp, Oryza sativa
ttgtggacatgatgttagcaccggcagtgggattatcgagaacattcactgtaacctccatcacgagacattggatagttagggacgatagggagctagtccgaattacttcggaagaaacctctacatctcttaaccattcatcgctcatgatgatagttaattccctcacaatttccttgagaaaattatcttctagaggttcatagggagtacccggagcaggagatgtttcgttgtggacgaacaagatgttccatggacaagatccaagagtttccttccatttgttgtggttttgtgtgcaaacgaacctccgggatatgaggcagagtccttgtttagacccaaaccgaaatattgtaacatggtcgagtatagacaaatctgggtcaaattgagttaacaatgaaatcctagcctaagctacttcaatagattccttcttgcactattgaaaaccgagaacttccatccgtagggagacaacataggttaacaagacaaaagcaagatagaacctacttttgagttcctcccattcaccgtttgttttcctaatggtatgagagtatcattgttccgccctctccatgagagagaacggaaacaacttccacttcaaagtttcttgcgtcatgcctgagattgtcaggcatgaacacaattgctaactctcgtagatgatggtaggggttttcactgtcgcaccccgagaaggattttgcccctgaaccatggttataaagccagtcaaatgtgagaatgagttttgaatagatagctactccatggcaggaaagaaaagaaaagaagaaataaaaagaaaagataccagggagaactaggttcaaagataatataacaactattcccaagcaacgacaccagaaatgcttattggtatttgttacgatcacaaataaatccgcaagcgcacggataacgctgtaacacttcacctcagagtattccaagggtatcgaatcacaaggaacatgtgtataacatcaagaaatcaagttcatccaacaacaacaaaatggtaggcggagagtagggagggtttctatgggttaaaattcttcaattaagttaaggtaaaactctatcacttgcttcaggcaccgactttcccctggtctgccaagcgaatccagcctacagcccaatgacgtaccggaatgtggaggactacaaaagacgatcaaggctgttaccatttgtcgcctacctctatagcccatgaaacacacaacaaataaatgtaacctataacctaaacactacgtttgcattatcaattactactctagccttggccaagaacttcattttttatccaaagtattagtactagagtacttaacataaatattaagcgatgaacctgcaatgataagcatatattttacttatacaagaagagtaaataccaaaagaaagcatgaacacttacttttataaaaagaaacatccatcgaggtacaagagtggaaag

SEQ ID NO: 45215 - DNA, 1501 bp, Oryza sativa
ctgggctgatatcaatcctctcccagaagctttgggcgatgtgacagttttaggcaaaagtgggtggccgatcctaaattaaatataacatatactagctaataattaaataaataattaaataattactatgtagtattggacaccaggtaatttttattattcgtcacatggcgctcttggcacagcaaccaggtgaactaattagccgttcgattaatccattggaagcttttttgtttgtaacattccatcgatggaaagctaacacggtcgaagagattgtgtgaccagctcctgtgtgtttggccatctcgaccagcccattagaaaaaatgataaagaaaaaaaagcatattgactcagtcgtttcagctcgccgccactcccctgtttgctccagtattttggaccaactattaactgggcctaatacatgcaacccgggccaatgtaagtgtttttctttttttaattctttattcttttttttctaatgtaagttacagtaaatacacactacatcatttttttcgaaaatttatatcccaataggttctattaatatcatagtatttataagattttatttgatttttttatcaatttaaatttgaatttggatgaaactccctgaaatcttagacggtttatacttccgagcctcgtcggaacatcgaaattttacgaaatccgtccgtcgaaatcgtaaatcctgatgtcatgtttatatgtattattttttagacacaataaaaacaaattatatgatgaaaatcctaatggaaccaacacttgtgttggcgagataattaaggtcgtggcgacatgattgacggctaacacttgggaatcctcggaatgtggatttgacgtggcttgcattggtgtatggagatcgtgataccctcgtctcatgggaagccttgtctttatgtccctgtgttctcccttgttagggtagaactcgagagataagttgagatacaatctaagcaatcccaatctgtaggcagtcgtttttcttccgggatcactctcctcatttgctcaagagttatcaggaatgtaaaattttgacgtgtcacatcggatattatataggatatcacatggagtgttcgggtactaatgaaaaactaattataaaatccgttagtaaaccgtgagacaaatttattaagcctaattaatccatcattaattagtaaatgtttactgtagcaccacattatcaaatcatggagcaattaggctcaaaagattcgtctcgtaaattagtcgcaatctttacaattagttattttttagcttatatttaatacttcatgcaggtgttcaaacgttcgatgtgaaagggtgtaaaatttttatgtgggatctaaacaggccttagatgtgatattcctgttcagatatgtccgtgtacgtggagtatcctatattttgtacactaaagattaagtatggtccttggtggagaatgttctctcattatttt

SEQ ID NO: 45216 - DNA, 203 bp, Oryza sativa
agtttagagtaatctgacttaataatctagattacaggaattttaaactgaaacaaacaggaccgaaaaatatttaggtgagcgattattgttgattaattgaaagtatagtcattttaaatttaaaaacaggttaatgtatttcttttaaaaaataacttatctatattttaaaaacacaacatttaacaactaaggaaaca

SEQ ID NO: 45217 - DNA, 562 bp, Oryza sativa
aatgcacttgtactaaaagtgtgagaacgaacgcgagcgaacgtgtacgaacgagataattaaacgattattaaacttagcatacatatatgattatatatatatatgttaaaacgtgaaatacaatatatgtaacttggcccgtttagactaatacattttcctggtaatgttgcagagaagacgtcgtcgtcgtccctcaagccgaagtggtagctagccatcaaaggaattcgcgcaggcaagtgatgtaaagaagtgtttgttagagatttaatataagattattacagttttaatataagattattagattattagagttttaatataagattattatattattagagatttaatatatagatatatatatatatatatatatatatatatatatgattattacaattttaatataagattagtagcgatttaatataaaattgttagacttagcatatatgattattacaattttaatataagattattagagttttaatattacgcttagcaaatatgacctatagacctaacaaatattttttgtatgcacaga

SEQ ID NO: 45218 - DNA, 1136 bp, Oryza sativa
gtcacgataagctatcattgacgatatctttagcccaatctttttttttcttatactacctctatattatgacgccctcgactttttatccaacgtttgatcattcgtcttattcaaaaaatttatataattataatttattttattatgacttgattcgtcatcaaatgttctttaagcatgatataaatattttcatatttgcataaattttttgaataaaacgaatggtcaaacgttaatcaaaaagtcaacaatgtcatacattaaaatacggagggagtacttacgtttatcagccaaaatttaaattttcaaccttaaattcaaaattaattttaaagttttcccatcaaaatttattttgcagtctttgtttgtagatagttaataacacatatataaaaaaattataaattatttttcgtttacaaatataccgcgtttagcgtattccctggataaacgaaacaatcgctttcttggatggatctgcgtctgctccatgagatgtggggtacgttacgtgccggatagaaatcacgtgtttaattgtgttatttgtttatttatttgcttgatgaggcattgtttgactcaatacaaaataaccgagagttgacaataagggcatgtaaaaataattatcgtgtcatgagtttgtgactgttgatactccattagtcacgagactcgtttttggtttgtttgaagcattatatggctgcttctctgatccgttttttatttaagtaaattttatagaactatttctacttttatcaaactattataaaactatagatttaaagaggtagtattacaaaccacatattaacactatatttttcacgaaactctatattcaaggtatgatatcataaaatttagtgatgaatttgtcaaaaacctaccgtactctctaccattggtcatttttagccgttagattaaatgcggccggatgtgatcgatcgctacggtaatcaacagtaaaccgataccgtatgagtgaacagtactccgacactgttcgcacagcgtttttactgtgtttatggcaagatattgtagctcctggcacattttactgtgcgtctcaggctctcagccattctctccgtaatatcagacga

SEQ ID NO: 45219 - DNA, 1501 bp, Oryza sativa
aggcttcaaagaaaggctggtgtttttgcaattgattttattcgaactcttttctgaaacaactaagtgagtgcttctcaaacgacacggatgagacagtgcgtctcgtccggtcggagtatgtgcaatgtatcagtctttagaattgaaacaaggttggcacccggccaacagcttttcaacggccacccgggccaacaacttttcaaacggccacccgggcctagctgatcccatcagctacagatttttcaaacatcgaaccccttttctcaacagcaatttcataagcagtagtaaaacaaaactacgctaggaatcacctcacatccgcccatgaccgtgggcacggctatttgaacagtttgttaacctctttagagggggtacactttacccacacgacattactaacccggatcacccagcccgtggaaatcagccacgtcgggggacctccaagctttcatgacaaggcatttcgaaagccgacacaggtttaccatatgccgacgagaggggtcccagaccaacaacaggttaggtcccagaccatacagtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttagaaatttcatttagttcacaaacaccaacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggagggatcagatgcaacaagttaggtaggtccgccaaactgtcatgcggacggaacaagcagattaagtgcgatcctatcaatgcataatatttttcgagcaacataattaaattcaaatataggatcaagatgttcaaaggtggcttgccttgctcgagatctggagcttgatcctcgaaatcctcgcactgcgggtcttcgggctccgaaactacacgcaaaacgggacaactcaacaaacggcgaaaataaagccctattgatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaagaaaagaaaagaaaggagggagagaaaacagacttttcttgggcggctagggcgcggcccgagagaaagagcggctcggccgagcttaacgggccggccggc

SEQ ID NO: 45220 - DNA, 955 bp, Oryza sativa
gccatcagtagtaggactattgcgagctatcgtgtcagaatcatggccaccatcttccaatgcaaatatgtattcttccaactccttgatgctaccactgccatcactatcactgctaccatttgcattgaactggtcaattgctagtgaaccatcagcttttgaacaaccaacaaataattcttcaaagaggtgaaagaatttgataggcttagtcaagtagttatatttagttgtctgccatgagaagaaacatagttagaaataaacaaatttagcacattcttgtatgaattataactcagaaattattgcacaataatatagcttacaccaagtttgtttgaatccttctcagatgggtcaatgttaaatttgcatgatgctgcatcaaaaccatagccacttttccctaaagctacacaaatccaactccatttttccttgcatagccttaagtgcctgtggacttggcttttggtgactctaatcccaaacttgtcttttaaagctatagcacattgctggtggtgttgtttcttccacttgaaggtactaggtttgtctttgcggagctctatataccactcaagcatgaactgagtagcatcatcactccaactgatatacttctcacgagagccaccttcctcgctagtaccttctgtacgctttcccatactacatacagtgaaaaaattataagttaatattgcatatgaacagatgatagtcagttaatgaagtaataagatgattggaagaaacataaatatattaatatgataatgtctgatacaatagtattaatacaacatacaatcctcacaactattacaaaatataatatcattaatagtccatgggactagtaattcattcactagtcaaaacatcatgaacatccgcattgtgtctgtcattccacatctgctgagcgatgttatcacgcttg

SEQ ID NO: 45221 - DNA, 271 bp, Oryza sativa
ttactgaagaagtagtaatgctatgatagcagctagcagggtcaaagatgatcagttctactaaaaaattatatagaaattagtcttgttttgtctttcctcggtacttgtcaattatatggaaatatttgtgacatatttttttttgccatttatttacatactgtgatagcacaggtttgagaacattagtgcttattaattatatggaaatatctgttacatattttgcttgctatttattacttgttgtgataacacaggtttgaga

SEQ ID NO: 45222 - DNA, 1501 bp, Oryza sativa
agttattttagcattttccacatttatattgaagttaatgaatctagacatatatacctatctagattcattaacatcaatatgaatgtgagaaatgctagaatgaattatattgtgaaacagaggaagtacctgctattttgctacactgtagatgccctggggatcagagaataaaactccgaaccccctgcaggcagcaagagaacctactcagcacaggtcacaggtgatcgttctgtgtgttgcgctgcgcccaactatcggctcgccttcgccgccgtggcgtctctgtagactatcatcccttgctctcgcaggctgcagcacaagttctttagtggaaatggacaattctgggctaataatgcagttatgtgtttggttgacttgtcgatttcttgataatagataggatcttgcttccgaatcgagctcttagtcatcgtcttgaaggcgtcgatcgtcgacggacaagaagtttgtcaagttagaattcctgcctttcaaatttcgaaggagattagtcattttggtatgaattgctgaggtgcgtcctcttagtaaaactgtaatggcatggacgtacaaataacagaaaccaccattgagttttgatgcaaagttaagaagaaaatcgtaacaaattttgggacttatactcgttattgttgcccacaattgacctatgaggcaagtaggaacagatatgtcgcgctctgaacaagtagcagaaagacagaacagttaaaaaagatctatcttttcgtggcgcaatttatatatatatagttacaaacttctctatgtccaatcatctggtaagaacgggtgccatcctagcagaaatccagactcctgttagtgcactcgacgaccgattcgctagctggctgaagtcttcgttcttctcagagacatgtacgctagaaccctgtagccgatgatcatcgcgaccagagctacaacttctgtcacgccgttgtcaagaggtatggcattgatcagaatgtccgggacaggatgatattgcaccttcagcagtagcctgtacgtgtggtagttgaatgacaggtagcggagccaggatatgaatggtggaactctctgcatatcatgatggagaagagggcaatgcgtaagacggagtaaagacttgttcattcagtatgttcttcagcattgcatcagtaacacagggaagtgcttgctctcacctttacaaagaaccctcctgctagcatgaatgtcatgactgtaactgaagctagagttgttgccttcttgatatccaagaggctagctccaattgccaatcctaatccctgcatgattacttttttcttgagtaacagatttctaatcactgctaatatccttttgaaatatctaagatatatgatggatcaaccaaaatgttccctaacttatgaataaacacaggtgatgactacaacttcatgggaaaattccttggattttgttcccatctcaccatcta

SEQ ID NO: 45223 - DNA, 393 bp, Oryza sativa
tgatgcagcatcatgcaaatttaacattgacccatctgagaaggattcaaacaaacttggtgtaagctatattattgtgcaataatttctgagttataattcatacaagaatgtgctaaatttgtttatttctaactatgtttcttctcatggcagacaactaaatataactacttgactaagcctatcaaattctttcacctctttgaagaattatttgttggttgttcaaaagctgatggttcactagcaattgaccagttcaatgcaaatggtagcagtgatagtgatggcagtggtagcatcaaggagttggaagaatacatatttgcattggaagatggtggccatgattctgacacgatagctcgcaatagtcctactactgatggc

SEQ ID NO: 45224 - DNA, 1501 bp, Oryza sativa
gccgccgccgccgccgccaccctctcggccccgctcactccagttcttgaaggtaactgacatgcctacctaacctccctgtctctgttttgttcgtcaattcggattagtctggtgtgaaattggctcgatgatcttatatgaaactgcttttcaaatcgtattgcacgaattcaattgatacagcaccaaaacatagattgaaacaaaaacctcgcagtttgaaccaattacgattccaactcaaattactccatttggtgtgaccagtttactgcgggagaggggacaagaagaccaagaggggaaaaaggttcaaccactcgtacggaaatgtgagtctctagcacaaaaataaaattaataaaaaaatcatatgcttattgcttcctgtgctgctgtttgctgcaattcttcagacttgccatctgctgactgctgtttgctcatctcaggcgaggccgcgcaacaagaagaagggaactggccctgcacggctgttcgcgccgcctgcgcctccgaggaaggaccagttcgacgacggcgaggtcaccccgatcgacatcgacgatgacatcctggaataggttgtctgaatttccccccttgaattatggtttaccttgagcttaccttttgtctagtctgtaccaaacactgtttcttgaaattaattacagtacattacatggtctcattctacataatgtagatgcctatgatttctttccttgtaatatatatgaatggtgctgcttagagtcattttttatgcattaccagctgaagcagaacataagtacagatacaatcaccaaactttcatgttcttgctagaaaccagggaagatgcagtatctcttttttttttcttttctagctgtgtccctgaattcaagcaccttttgacatgcttcgaatttgttgtgatgatctgggaagcagttcttaagaatcaactaataaaccagtccatcagatcgggtcagaaatctgccccttttttgttgttttgtctgttgactctgttatgcgcttgagttttgacacaagaaattgttttgatgatctgcaaaacatattcctttaaagctggacaacaaaccagttcaactggtcagcttggtggtaattgtatgttaaaattctgtcattttttgttgtttcgtctgcaagtttgttgtgagctgctccccccgcccacaagggtaagcaactatctcgcccgaaatatactacaattttggcccaaactggaagtgtaaaccctgctacgcaatggctttaagaaccctaaaccctgaagcatgttttgtttgctaccatttcaagccatcacaaattttggtaagataacgaaccaaatatgttcgagtatccctaccttaccaaaatttggtaacgtacgaaacaaacccgccatctgttcaaaaatttggtgaagtaacaaaccaaacattttcccacagtcctaacatttgataagttcacacctctacag

SEQ ID NO: 45225 - DNA, 1501 bp, Oryza sativa
ataagctataagctgcttgtttctcagtattattagatgtttgttagttgttagccacccaataatctaaaaagcacctttaaagtggattactagattatagaaatctggcttgtagattgtaataatatatcataataagctattatttgtttcagcttactcctaataatcttaagcggaatcaaacagggtctagagcacttgcaacgcgtttggttgggggaattgttatggggaacgagagttattaaatctattgtttggttggagggcatggaagttctaggatagattgggaagaggggtttaagagcaaacgcttaccttttgagataaatcttagtcctatatcatgacttaaaattcaattcccacccattctttacatgatactcatctttattaccgaacaaaagataaaaatgaaactcccataaccaattccttcaccaactctctcttttaggtcctctataaaaaggaacgggaaaaacgtagaaattaaagtagattatagaaattgaaaatatggtaaacagagagaaaaactctttgattacaccacaagagacactcaacaaagaaaagtttcacaagaggtctaaccgcttgcttattttcctatgaaattgacggtagaaatgcaatcctatgaaaaattttctatcctcttcttatgaatcaaagggctttatagaaaataaattctctaaaattcatttgctaatcctcaatttcaaaggggctaaaaaaagccgttgtggattgtgaaattggtttgcatcttggagcatcatcactcacgccgccgcctactccttccgtcccaaagaaaaacaaaccatgggtttccgtgtacaactttgactgtccgtcttatataaaatttttttataatttatattttcattgttgttagatgataaaacatgattaacattttatgtgtgacttttctttttatttttttaaataaaatggacggtcaaacattagaccagagtttgtcttttttttttttcggagggagtacgtaggtactacagtcccagaagaaagtggatcctctcaagaaagaagaaaaaaaaataaataaaagaagacgaaaaaggaaatcgtcgtgcggcgtccgctcgtcgtcgactcgcgagttcggccgccgccaccgccgccgccgccgccgccgatccccatccatcccgcgagcaagcaagggcgcaggcatcctggtgagcgcccagcccatcctctttctcatctctagaaccacgcactttacttcttattcttctcgaatttgcgtaaaccctagcttctgttctagaaatttgccgcaaacaacagtttgtttgttaaaaaatatagtaaaagtttgcggattccccccattttagatccgcccctgggcttggctagcacaacattttttagtgggggaaggaagggaaaggaatcggtgggtggatcgatgcgagcgttcgcgcgaaatctggcggcc

SEQ ID NO: 45226 - DNA, 1501 bp, Oryza sativa
cagcgttatccgtgcgcttgcggatttatttgtgatcgtaacaaataccaataagcatttctggtgtcgttgcttgggaatagttgttatattatctttgaacctagttctccctggtatcttttctttttatttcttcttttcttttctttcctgccatggagtagctatctattcaaaactcattctcacatttgactggctttataaccatggttcaggggcaaaatccttctcggggtgcgacagtgaaaacccctaccatcatctacgagagttagcaattgtgttcatgcctgacaatctcaggcatgacgcaagaaactttgaagtggaagttgtttccgttctctctcatggagagggcggaacaatgatactctcataccattaggaaaacaaacggtgaatgggaggaactcaaaagtaggttctatcttgcttttgtcttgttaacctatgttgtctccctacggatggaagttctcggttttcaatagtgcaagaaggaatctattgaagtagcttaggctaggatttcattgttaactcaatttgacccagatttgtctatactcgaccatgttacaatatttcggtttgggtctaaacaaggactctgcctcatatcccggaggttcgtttgcacacaaaaccacaacaaatggaaggaaactcttggatcttgtccatggaacatcttgttcgtccacaacgaaacatctcctgctccgggtactccctatgaacctctagaagataattttctcaaggaaattgtgagggaattaactatcatcatgagcgatgaatggttaagagatgtagaggtttcttccgaagtaattcggactagctccctatcgtccctaactatccaatgtctcgtgatggaggttacagtgaatgttctcgataatcccactgccggtgctaacatcatgtccacaacctttgtattaacttgcttaggtgacaagccccaaattcaagttcttgattaatcatttatctacaattgagttgctatctttcgtgttcttgcttgtgttcttcaatacgcacgtagggattagtcttcttggcaagatctatcgggtttcgacatggttgatactagaggagaagtggtgctgcgattgcagagttcggtgttcttcaatacgcacgcagggattagtcttgttagcaaggtctatcgggtttcgacatggttgatactagaggagatgtggtgctacgattgcagagttcagatcaacgaagtcagctcgtgttgccatcacgagccattagtacgaaccgacaaaacctttcggagttcctcaagtcctatcatagaagtttatgggattctacgtggagtgcctatgaggaacgagaatgtcgaagccaccctagacttccacgtgttcaaagtccctgacttcgatcttctgatcgactatcccatagaaaaacttctataatgtgcctaatccagattgtgcctaaggagtta

SEQ ID NO: 45227 - DNA, 1501 bp, Oryza sativa
ttacttcctctgaatcattgatatatcctctttctctagatgactacatttgaaattgaaaattgaaatacgaaatcattgaaggcgtgtttcatgatttgtaggattaggtaaattgaatcagtcaattctgattaggaacatgggcatttctttattcagcaagtcaccgaaaacttctgattctaccagttctacattacccatgtcttcactcctgtcacggtgatgaggaaattccgaacagggaggaataataagtaaagaaaataggaattaattggaatttgtgctgtccattcttcttcaattccatctcagggtgcattatcgatccaatgctaataatactatttgtactaatacttttgataacctgatgcctaattgtattagcgtgtagggaggctttaatttggcttgtcacatgggcacaccgacgacaaaaaacctgggtctgccactgcattatgggacggaggaagtagatgacaattgacaaaccaacaaagccagtcgcacattcaaacaaatcaacaagataattcaaatgacatatatattacaaaagttcaactggtttttattgcatgcacttgtgtataaatatgggtattatgtcaaaaagtttgggggtatagatgtacccccatgaatcaccctagttcgccactgatgtgaaccatcccgaaacctaccaaatggtcaaaatgtgagatgaagaaacaagttagtggaaaaacatatatgtccatatttatatatttctcgatgaaaaatgtattgcagcatatattgatccaagcacacatatctataagttctaaaaaaagacgcacgcgcgtgcgcacacacatgtgtgtgtgtcaaagataccagattcaacattcagacaccagctagctggctagctagctagctaacttgtgctagaaagaaaaaagaattgttacggcataattatatattccaagttctaatttaatctgaatagcaagaaaagcaacagtagcgtaatgtctaactaatgaaagaaatgtctataaacacacacacacatatatatatatatatatatatatatttgcgttgtatgcacccatgcgtatatattagggagagagggagggagataatttgctgacagaaagagaagtgagcacatatagcttcaagcacatgaactctctctctctatatatatgtatctcttcagtcaacacacatatgaccacatatgcaaggaaagaactatatatgctcactctcttctgtcggctccctagctcttttgttccttccctgtatacaaatcagcaagacatgtcatcatgcttgaaagttattgattagcaaaaaggaaaaaaaacacatgcccaaaacaaaaggtgtggcctctcattctcttgattgctttccaagaccttaacttgtgactttagtttcatagactactgttttatttgaatgtgtggcttatgggttctgaaggggatggcat

SEQ ID NO: 45228 - DNA, 855 bp, Oryza sativa
  unsure (1)..(855): unsure at all n locations
tgagctcaaactcttgtatgcattatattcctttctctatctagtctctcccctatccaaacaaatttcctgaaaagtttatattcctatgtttgattcgtattctcgtgacctaaaattctgcagacaagagcatagcattctattagtatgtttttttctttctctgttttataaatcttactctctttatttatgttttataaaccttactctcttcgtttcagattataagttgttttgactttggttacaatcaaaccgctttaaatttatctaagtttgtagaaaaaagtagtaacattttcaacccaatacaaataaactatgaaaatgtatttaattatagatttaataaaattaatctagtgttataaatattattatattgtttatacaaacttaattaaatttaaagtaatttgatttagagtaaagtaaaaataatttataatataaaacagagcgagtatttccaagcattcctaaaatattcacagtgtagttgttttatatagccagtatttttttttgagggggggatgtcactcgtataaaactttgcattctacttttaacccgcagtataaaattaggacgccacatttgacactttgacataacaaccttcccataactcctgttttatcccgccgctgatcgcgagagtcctctcccattanaacccctccgcccaccagcgccgagacacagacaccaaaagccgtctctaagaagaagagagggagagagagagagagagagagagctcggtcggtggaggcgacgacgacgacgcgcgcactcgggccgccatggaggagagaatacctctgctctcgaaacgattcccgg

SEQ ID NO: 45229 - DNA, 1501 bp, Oryza sativa
atagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccaatgcttccgctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgcctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcacaattatacataaatctcaaattaacacaggtcacaatttaacttattttcacataagtcccaataacttaatttcacataactcccaatttaacataagtcccaatttcacataagtcccaatttaacataggtcccaatttagcataagtcacaattaaacagaaatctccaattgacataggtgccaatttaacataagtcccaattatacataaatctcagtttaacaaaaatcacaattatacataaatcacaatttaacataggtgccaatttaacaaaagtcccaatta

SEQ ID NO: 45230 - DNA, 472 bp, Oryza sativa
tctgaaagctagttgaaatcgtgacaattgactagctcaccatctgtgcaggcaatttaaaattcatcctagaaaagcattcagcgtggagtagtagactagtagtgtaactgttatttatctctatatttaggagaacgttgattttaaattttgtaggtttgcaaactgctacttgtatacccaaaaaaaaaaaatctgctacttactatgctatatccatgatttatttcagaatgtttggacacgccaaatgttcaaacagtattccagcaaaaattttaggcactgttccaatcaaaatcccccttccaaactaaccagccgcttgtacggctaaactttttgcctgtcctcctactgctaaatttgaacgccacattgaacaatatctgaaaccgtgaaacgtgcctctctggctaaagtgctaaacagttaatccaatgagaccaaatcacgcaggcaacaaata

SEQ ID NO: 45231 - DNA, 330 bp, Oryza sativa
catccatagcttcacaatcaagacttcaaatgttttgatgcactagaaagcaaaatcagtaacctttactatgatcatatatcacacacgaatggtgcagctgttagtgtaacaccacgtgttgagatttgagaaagcaggcccaaatcaatgcattattgtagctccatttcactatatcaagtaataatagtaatttatatatatcgtagcagcgaacatgtaccattagattaaaatatgaaaggctcagattcattgcagttctttagtgtgcacttgcaatatcgaagtgcaccctgatctcaatccatcacacatgcacacaga

SEQ ID NO: 45232 - DNA, 1501 bp, Oryza sativa
tacaagcaagagaagatctattttttaaatcatgtgcagcattaacatctctaatttttgaaatctcattcattaaaacctcacaattttcacaatcatcatcattaggaataagagattttaatctatcaatttcagatttaagagattcaatgataaattcctgttttctatacatcttctcacacttcttattttttgcactcaaaatattaatagcttcctcaaaagcattcacctcattatcttcatactctgtgtcagattcaccacgcgccataaagcaaacatcggagatgttctttcccttatcatcatctccactttcaccatctacatcacttagtggctcgaaggcggcgcaaacttgttgaaaagccttcctaagattctccatcttcctccctcggtatgaacccttcgacttgttgttgttgggcttgttgttgttggtcttctcaccatctttgtcttctcttttgcctctcccaagattaggacaatgcgaacgaagatgatgaattgaaccacattcaaagcaacgatttggaccacctcttttcctgttcctggcattattcatagctcgagcaattctgttagcaaccaaagccaaatcctcctcctcgatttgttcgagttgatcatcgaatgtggcattaaaaacagcaagaaaagacgacttagatgaagaagcatcaacatccaaagaggaagaagaagaaaccaaagcattcgacttagaatcaacttttcgagaaagaacattcatctcatgtgttttcaattttgtataaagtgaatccaaagtcaaagtagacatgttaacagactcctgaatagatgtaactttcatctcccaaatagacatgtcaagaccattcaaaaagtggcgagaaatctcagattgtggataattaacatcataagaagaatcaacagatctaagatcactcaaaattttattaaatcgagaaagatagtcatccaaagcttctccggatttcatctcaaatttaatatactcctttttgaaaagatcacgacaaagttctttaatattatttgttccttgatgaaaattactcaaagcagtccaaatctcatgagcagtttaaagatgagcaacacgatcataatccgaacgagaaataccactcaaaagaatattgcgagctttgcaattttgttcaaaagcagttttttcagcagtagtattaatagcttcaggaatcacataagtgtggagattatgggtaccccatacccacacggcatggttatccgactagttataggggataacttatatttatgtaatatgtaacagatcatgacttgggtgttacgtttccttttatattatggagtggcctaaagtcctgattcgataatattgtaaaatagatttaggaaaccgataccgtattggttaaggtttctatcttgtaatcctgccccccatcctatataaggtgggcaggaggccctctagggggca

SEQ ID NO: 45233 - DNA, 153 bp, Oryza sativa
aaatatagttacgtataaaatactatttacattttatcatctaacgaaaataaaaatactaattagaagatttttaaataaaacggagagttaaatgttgtattaaaaactgaattttttttaaggaagtagcgttttattgtagtcacaaga

SEQ ID NO: 45234 - DNA, 174 bp, Oryza sativa
cttgtactagtatgagtttaggactcttagtatgagtttggttcgtggctttaggctgcctacctcatgtataaatagagggggagcgtgaggcttcccggtatcgctttagagagcaattgagttgagtttggagttagggtttcgagtttagtcgaaatttttgtaaggagt

SEQ ID NO: 45235 - DNA, 1501 bp, Oryza sativa
agcctgaagatattaattttcacccagtcaatgtcagtagtgtcgaaactagatttcggcaataataaaagggggtggctatcaagctggagaagtgtatgggtttggagacaaaagatttatacaggttcaggccttcttattcaagaagtaataccctactcctgtccggggatgaatccgccgagtgtcttattgattgtatgatttggagaaaatcaacatatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagagacaaacccgagacacaaataagatattctatctatatttggtatcctgtattcaatccaaataccatcgccgtgtagatatgggatatccataatctccacagtagcccccgagacctttgcagtcaaccatcatagccttctcaaagataataatccgagtgcttcaaacctttcatgccaagatctgccgagtagcgaagacaaagactgtaaagggcgaaaagataaagaatatggtgcatcgaatagatgcacctaattaggtgtagcccccaactatgtgattagttaacagactaaacatatagttgagaacaaaataatagcacaatcgtgcatcgtatgacaaaagcatacgtggcgcctaaaggggcattctagccaactgctttttagccataataaaaggaatccgagtgattagcactctaaaaggttcacgaatgaacacacttgacgggcatccgaatataaaactctaaagattacccaccaaaaattataaaaattatggtaatgaataagtctaatagcctaggctatgactatttaccataatgaaaacaggcatataacataccaaggaaatggctatggtaaaaacaagtcattccaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgtcaaaagtactgggctgaggtactgttcaggcctaagcccatttgcacctccgatacccttaacaagaaatcccaagatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaacccctcacttctccttagccatccctcgaatcaaatcagcgcattcgggtaaaatcaa

SEQ ID NO: 45236 - DNA, 285 bp, Oryza sativa
cctgcagccccagctgtataggacaccctacaaattgaggccctgaattctaatgcacttgcttaagtaccatgcttcagagagaaaaaaaaaatagcccatatgttaaccaatagaaagcacaatttagcccactctttcttcggttcgtctagtgaatgcagaacacaaactggtgatttttttccctcctcaattcaatatcagttgtcttactcaattcaaggtttcacttcaatcttgctttattttctttttttttaatctcgctaagcccagaagaca

SEQ ID NO: 45237 - DNA, 450 bp, Oryza sativa
tggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaacgcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagt

SEQ ID NO: 45238 - DNA, 229 bp, Oryza sativa
  unsure (1)..(229): unsure at all n locations
acactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggctggcnnnnnnnnnannatactgcatgtaga

SEQ ID NO: 45239 - DNA, 1501 bp, Oryza sativa
ctcggattcggttggaaaccgctcccctaatcccgccggcgccattgatggcggccgacctcccgcgccggtttcctcccttccccggccaccctctctcgccccggctctatttaaaccctccccgcaccccctccgtccggttccgcctctcgccgctctctctctccgccggaatcgagctcgcgccgtcgctctctctctccgccgtcgccgccgagctccggtccgccgccgtcgtcgccccggacctcctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcagcgaccatcggggcgcgggtgcgccgcctcccgtcggctgtgccggcctggccgccttcgggcgcgccccgcggctgccatgtggggcccggccgtcagccgcccgcgccctcgggtgcggctgacacgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaaatttaaatgaagaaattcgcaaatatccatttaaaaagcatataaacttcaaattgccataacttggccatttgaactcggaattggaccgttcaagtctctaatttttccttaagaagtcaagaacccatttttgtgctttgtttctgcttgttatatggagtttattagagtaaaagccgtttcttttccgttggacgtgtagacgctgcagcttcggaagatccgctcttcgtggaagttgaagccgacgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgacattattattgctattgttattattaccttgttcaccctaggaaaataaaaccccaactagtgggtactctatttatggttccactagtgtgaacttaggtagatgtttcgctggttaattaggcaacattaggtggttttataactttagactctgggaaatctcatatcatttggacattatggaattgttggattatggtggaattggacatacccctcccttcctctttcaaagcccctaaaacctgtttttcggtggggtttgggtgcatgccagttgtgggaagtagcaccccggccactataaggattaa

SEQ ID NO: 45240 - DNA, 1501 bp, Oryza sativa
tttgtggcttttattgtttgagattgaaaaaaaaatcaggttgctgctcaagagcaaaaggcaaaaacatagggcagtgataaaactatttttgggcacagttagtctgtgaccatgtcttcataggcataaatgaaagggaaactcattgttaagaaactgaaatggaaacaacttttccatggtgatccaattgaccatgctaggatcttggatatcaatactgtaattcataaagtgcagaatacatgattcagttggagaaaggcaatacatgaggaagatgttttgaacaatatattatcttaggttaaactattttttttctcatctggtgttttgtacccttacaatcgtctagctgtctagctgttgtaattcatcaagtgttaccaatgttgaattggttgtactctatagcaacctagcaggactttatattttgttctttgcaaaatttggcatggagtgagaaagggattatgtttacaattttcaaataaattagtgttaaacaaaaatccgagcagttttatacctaaccaaggcattccctttagtcttcttgcccccttggcacatagggtgatagggaacagttaaaattctaagaaattttatactgaacatgagcaaattttatttctcttaagtttttctaacagctatattgctcattcaaggaggctgatgaaaaatccaagattgcagtcacactttgatgcatgaatattacttcctccattttaaaatatataatattattgacttgtaggacatgacgcttgactgataattttgttaaaaagttatgtatatatgtgacttgtttcattatcattaaagatacctcaagcgcaattcatattttctcaattcatataaaagtattatgatgcaagattgggaggatttccttggtactaaatagcaaaaaaaaatagttatgttatgttattcaaacttataagtgaaagtatattgattttttaaatgtatgtcgtagcttttaattatatactactataaatttgattttaaaaataatataattttaatacaggttacgacgtgtactacacgtgcacagtaacgtgcacaggttactggtagacgaaacgatggaatcggttgggcattttggcctaccgcctccaggtgtccgcagttacaggggttgggcgggtcccacgcgctggcttgccgcgtacgcctcctccacgccctctctctcgtcttctctcgcctcagttttcaaaaatcaaatgcccaaccatttttcgcctctctcttccccacctcgcctcctttctctctctctctcaccctcctcttctcagtctcacccccattcgcaaaaccctactccctcgcgcttccccgacccatccgccatggcggcgcggcgatctcgcctcgccgctccgacgtcctcctccggtaagcccccaccccccctcctccccgcgccttgacccgtacgccaaaaaccctaactaaa

SEQ ID NO: 45241 - DNA, 1501 bp, Oryza sativa
ataagagcaggtacaataggctgactcagcgggctccaaaacagtgccacatcatcattttcctatgtggatgagagagaaaggatgagagagaatgaagcgagcgactaaattgtcgccgggcgctagcgcttctctccacgccgtatcgctcgcgagcagtcgaccctagcgctaaacaacgcggtttgtggggcccgcacatcctcagcccgatcccgtgaggcgcacgatccccttcccccccaccgtgcgcgaatccatctccatcgtccgtgcgtaatcgtcgtccatgcatcagcgaaagactcggccggtgaaaaactctcacgccacaccgttcaacaaaaatccggctaggaaatatactccttcctcgtgagctcttcttgcccacgaaacactagtgctttgtatgaagtaatttttatacaacagataacttggttggcatgatctgtgaaatgatcttggtgtttggtgaacaaagttcatctcacaacacaaatagctacaaggatacaattcactcctgatcacatatattgatatgtgcatgttataattaattatttgattataagatgcagctagctaatagacaatctattgtactagtaattgtctttagccatgggctattagccagcagcgggctatactattagccttgctctaagcgacgtgggacaaaaactgattgcgggatggattcagtccgagccaaagcgcgtcgcgcagacccgaccttagcactagaggcgggcgcgtaccccgtacctggtctccatggaggctcggcggcgagggcaccgtcgatctggctggagctgaagcctcatgccgtccggccgcagccgtcaccgatgccgcggagaactacacaccggcacgatcaagatcctcctggagcatccgcagatggctgctcgcctccggacgtcgggcagcagcgccatcggcggaggtcgggaggagacaggaggagagggagcgaccaaggggatgtttggttgggcactttggctattataattgtaggccggttgggcgggccatatgactaatctttctcaccttcgttgctctgtttcactttctaattcattttcgctgctctgtttttccccttcggcctccgcaactgacaactgggccgaactctggacagctactgggccgaaggacgatgaaaaaggaaatcgcgccgtcgccgtaggattcggaatgacgctgatgaagcgaagtacgtccctctaacgtaggatctgcttccctccatccccaccctatcgttccccattcccacctcctccccactacgccccgcgccgccgccagcctggggctgccgcccggccgccgtcctcgccgtggtaaggcctctcctgtcgccgctttcgtcgtccgcctcccctcccccctccctcgccccgacgtggtgtgcgccctctctccgtcgccgccatcgtcgaccgccttcctccgtcctcgccacctc

SEQ ID NO: 45242 - DNA, 1501 bp, Oryza sativa
  unsure (1)..(1501): unsure at all n locations
ctacaagcaagagaagatctattttttaaatcatgtgcagcattaacatctctaatttttgaaatctcattcattaaaacctcacaattttcacaatcatcatcattaggaataagagattttaatctatcaatttcagatttaagagattcaatgataaattcctgttttctatacatcttctcacacttcttattttttgcactcaaaatattaatagcttcctcaaaagcattcacctcattatcttcatactctgtgtcagattcaccacgcgccataaagcaaacatcggagatgttctttcccttatcatcatctccactttcaccatctacatcacttagtggctcgaaggcggcgcaaacttgttgaaaagcctttctaagattctccatctttctccctcggtatgaacccttcgacttgntnngtgtgggctttgttgttgtggtcttctcaccatcttttgcttctctttgcctctcccaagattaggacaatgccaacgaagatgatgaattgaaccacattcaaagcaacgatttggaccacctcttttcctgttcctggcattattcatagctcgagcaattctgttagcaaccaaagccaaatcctcctcctcgatttgttcgagttgatcatcgaatgtggcattaaaaacagcaagaaaagacgacttagatgaagaagcatcaacatccaaagaggaagaagaagaaaccaaagcattcgacttagaatcaacttttcgagaaagaacattcatctcatgtgttttcaattttgtataaagtgaatccaaagtcaaagtagacatgttaacagactcctgaatagatgtaactttcatctcccaaatagacatgtcaagaccattcaaaaagtggcgagaaatctcagattgtggataattaacatcataagaagaatcaacagatctaagatcactcaaaattttattaaatcgagaaagatagtcatccaaagcttctccggatttcatctcaaatttaatatactcctttttgaaaagatcacgacaaagttctttaatattatttgttccttgatgaaaattactcaaagcagtccaaatctcatgagcagtttaaagatgagcaacacgatcataatccgaacgagaaataccactcaaaagaatattgcgagctttgcaattttgttcaaaagcagttttttcagcagtagtattaatagcttcaggaatcacataagtgtggagattatgggtaccccatacccacacggcatggttatccgactagttataggggataacttatatttatgtaatatgtaacagatcatgacttgggtgttacgtttccttttatattatggagtggcctaaagtcctgattcgataatattgtaaaatagatttaggaaaccgataccgtattggttaaggtttctatcttgtaatcctgccccccatcctatataaggtgggcaggaggccctctagggggca

SEQ ID NO: 45243 - DNA, 1501 bp, Oryza sativa
ggattcgcgcacggtgggggggaaggggatcgtgcgcctcacgggatcgggctgaggatgtgcgggccccacaaaccgcgttgtttagcgctagggtcgactgctcgcgagcgatacggcgtggagagaagcgctagcgcccggcgacaatttagtcgctcgcttcattctctctcatcctttctctctcatccacataggaaaatgatgatgtggcactgttttggagcccgctgagtcagcctattgtacctgctcttattctcagaacgcgcgacctctttagagcacgtataatagtgagctataagcttactataagcttaggtggaggagagaggtagtgaaaaattaaggatgttggctctcatgcaagagctagcttatcacaagctccaacacaaatgcattaaatgtgtaagtgagagatagagagaggagaagaaaattgtagccaaccttatagctaatctattatatatattggctttaaaataggctaatagtaggaagtgggctctattattatccttgctcttataaacgctagttgattatgtggtgtcgcctccccggagacacccacaccgactagatacaacagtaagatccccaccgtggccacggcttggcggataccttctgctgtaaaaattaaaaatggagcagtcataaggtcccctcccattacggggcacggcaggcgcctgccggttaggctgcatccataatacgttaagatgtcaaatacggcatacatatagtcgggtctcccggtggaggcagcgctagacattagcgctttgctttttgaaattttgtatgatcaaattattatttttccgttgattaattatacaatagcagcaatggaggcctgcattagaaccccctctgcgtttgaattccaatttcctttgcgtttgaattatacttaccagcttaacttatctgaagatgttgtccttttttctttttataattttctcggagtgaatcaaccatgatgccataatgcatgctaacgatggagtgtttaaaatcttgtcttgattgcccctgcaggaccttattgttcagcttctatactcattttgtttctgccactttctagagttaaaccctggctagataggtcttctccatgtctttgtattttaaagcattctaaaactatgctctacctttgttagcacattagtgtgtgcatctgggaatttgggtctaggggtgggcaaaataaaccaaaatcaaaaggcaagcatgccagaaccgagttgctacttgtggagattatggatatcccatatctacacggcgatggtatttggattgaatacaggataccaaatatagatagaatatcttatttgtgtctcgggtttgtctctcaacttgtacatcaaggaaataccttgagacttagtcggttacgactgtattttatctgtatctgcatattccgttagggatatagattatcttttgtaacacggactcc

SEQ ID NO: 45244 - DNA, 1501 bp, Oryza sativa
agcgaagatgcccactaatggcggcataataggtcagccgtgtaagcggaaacaccagtcggcagcggcgaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcgtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccaatcggcggcgacggaggcaggccggcggtgaagtcgtagactcccaacagcggcggcataataggccagtcgtgtaggcggaggcaccaatcggcggcgacggaggcaggccggcggtgaagtcgttgacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggataagccggcggagtggactcgcggccgatcgaccggaaagctgagaagcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaagaaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcagagacaaaagatttagacaggttcaggccctctcaatgagaggtaataccctactcctgtttggggatttgaatccgccgggtgtagtatagatctgacgatcaggttgtgtcatgccccctagagggcctcctgcccaccttatataggatggggggcaggattacaagatagaaaccttaaccaatacggtatcggtttcctaaatctattttacaatattatcgaatcaggactttaggccactc

SEQ ID NO: 45245 - DNA, 1078 bp, Oryza sativa
atcctttttgacgcagttagataattctttggaattactacaatgcaaataaaaaggtgcccaacagaaaagtgttatactaattttgtaggcctttttaggctacaaagctgttcgggtcttattgagatgactgattttgaatagtcattctctcggcacgttatatgctactttggtaatagcgtgagatgtagcttaggctatttagactcgtcgtttatcatgttttataccacatttgatggatctttttgagagtttttactcggatttttatcatatgtattgatttatagacctttagagtgtttctcactcgggcctcttctatgtctcctttttggtgtgttaaagctaaggcagtcgactggatattttattaaacgccgcatatgcttagctatatgatcccttggatgattcggttgtaaaaccacacggatggatgttcatatgcactttgactatatgattggtttttagttaactaatcatatagttgggggctacacctaattaggtacatctagtcgatgcacctgattttttctattttcagcccttcacagtctttgattttagtactcgggagaccaaggcagaggaagttgaagcactcggattatcattttgaatgacgagagaagactatttcgtcgactgtaaaggtctcaggggctactgtggagattatggataccccatacctacacggcatgtatatccgactgggtatggggtaccatgtatagatagaatatctttaaagggacttgggttaaattccaaacttgtatgtcaaggaaatacccgggatcctagttggatacgattgtatcttatctgtaactacctattccgttaggaatataggctgtaccttgtaatacggaccccttcccctatataaggaggggtccgggtgcctcttggggcacgatttttctcccagatcatacgatcaataatacactcggcggagtaatccccggacaggagcagggtattacttcttgttaagaaggcctgaacctgtataaaattccttatctctcaacacatccacttttctagc

SEQ ID NO: 45246 - DNA, 1501 bp, Oryza sativa
cgatgcaaatcaactcctcgtcatcattgcttcggcttcacacgtctctctgtcctcccattgcgtctcgttattgagcatggtgtcttaagtctcaaactgtcaaacatctaatgatacaactaaaaagctaaattcaagcttttttatggcagaatacattgtgtattgttttatcggcgtagaggattcccttgacttatgacttgttcaccctgcccacaccccctagctataaatcctggcttcgcccctgggagtagagtgttacgcttctcagcggtccgaacctgtatagaccgctcttgtctcatcgttcttgaggggcccgaccccctctacatcacaccttccaccgagtcctcgattctcacccgctgcccccagccgaactaacaagggggccttactatcccccacttgaggaattcaccctctgacacagcgcgtctgcagcaggaggcgacctggtgcgcacatcacgtgcccacgcgggcctagttacgcgcttagcgttaatagcgtttaacattaattatggttttgaatcatttttcgtaataaagtattccctccgtttttggttataagatgttttgactttggtcaaagtcaaactactttaactttgactaagtttgtagagaaaaatagtaacattttcaacccaagacaaatttattatgaaaatatatgcaactattgatttgatgaaactaatttagtattataaatattactatatttgtctataaacttggtcaaatttgaaacagtttgactttaaccaaagttaaaacgtcttataacctgaaacggagggagtaatatataagaaaatcaagttaaaaatttaaaattattagttgaaagtattcatagcttaagttgaaagttttagattttgagttgaaagttttcaaatctaagttaaaagttttaaattttgagttgaaagtttcaaaatttgagctgaaagcttcaaaatccgagttagaagaattcaaaattgagttgatttaaaaaaataaaatagagttgaaagtttttaaggcatcgtatggtatggttgtaatagaatcgtatcaattaatccccataatatttatcattttgaactattctattcatttgcctggtctgtgtcactgtccggccgcttgttatggtgagatatgcttgaaccctctcatgtgtcaaattctatatggtttaacttagatcacaatatcactcatatctaaggtccatacaactattagcgtcttacagcgattgatcaaattttacatatgttgatagaagttagtagcaaatccggcaatgtgcgaagtccaggagatgcctacaccgctgaaattaagcctaagaccaggtaggttgcaaagcctcgagcctttcccatcaatcctaaaatcaagttctaaaaattaaaaaatatcttttgattattatccaaaaactttgccaggtaaattttgaaaataatgattatcatttt

SEQ ID NO: 45247 - DNA, 1501 bp, Oryza sativa
ggcctcctccccgcgcgcgcgccgctgacgggcgggcccgcccgccaccctcgctgacgggtggggcccacccgtcatccccttcctcccgccgctcccgccgtctcgcccgtgccctagcgccgccgccgccgcaaatcccgccgctcccgtccgccccgcgtgcaatcaagaggggggaaatattccccgtgattccctccctctttccccccatttttccctccctctcttcctcggattcgttcggaatctttccccctaaacctcgccggcgcatcaatggcggccggatcttccgcgcccgtttccccctcatccggccgccctctctcactcccaaccctatataaacactccccgtgcctccctccaccgtttccgccactcgccgctctctctctccgccggaatcgagctcgcgccgtcgctctctctctccgccgtcaccaccgagctccggtttgccgccgtcgtcgccccggaccttctcccgcttcggcgccgcctcctttggtttcgccgcaacctcgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggccgcgaccatcggggcgcgggtgcgccgcctcccgtcggctgtgccggcgtggccgccttcgggcgcgccccgcggctgccatgtggggcccggccgtcagccgcccgcgccctcgggtgcggctgatgcgtgggacccacggcgccggccggtgtgagccgggagcacccggtccaccgtggaccgtgaggctgccgcgtgggccccactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcagaattggaccgttcaagtctctaatttttccttaagaagtcaagaacccatttttgtgctttgtttttgcttgttatatggagtttattagagtaaaagcctatttacctttgttatgaccttattattgttattgttattatttccttgttcaccctagattaaacaaaaccccaactagtggacactctactcatggtaccacttgtatgatgttaggtagatgcttcgctatttaattaggtaacattaggcggttttacaactctatactttgggatattcatatcacctggacactttggaattgttggagtattgtggaattggattcacaccgcccctctattcaaaattcccaaaatggttttaggctgggctcggggtgcatggttttgatagtagcac

SEQ ID NO: 45248 - DNA, 1501 bp, Oryza sativa
agtactaccgtacttccacatgtctagtgggtaaggcttagtttgtggctcagtctggttataaacaaaagtacacgaatggagatggacgaagtcgggggtcgatggacatctctagggcaaatgaaggctacacgagctgcggcccggtagtcgagatgtcgtggcacagggccggtgtcctgctgctaggggctcagtcctgcctgcctgtcccgggggttccggccgtaggtgggattgggtcggtactcttgtctatggctaggatgggttggaaactatgtcatgtcttccgtccatataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaatttttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgcatagttctaaaatcgtgtttacaaaatagctttgagcaactaagcatctttaaatgctgtttactgcaaccctaaccctttatattataactcccttgtaatcccttgcatttattatgcacttgtgggtgtgtcttgttgagtacggtggttgtactcagtcttgctcaatttttcccaacccagaagaggagcccctcgttgatgaaggctttggtgtctagctcgtgcctgccgtcaagcgcctgtggtcgtcgccctagtcttccgctgtttctcgtttgtctttgtgtgtgctgggccttcgtcgcccatgtaataaattatctatttatgcttccgcttgttaaactctgaattgtatcaactcttggtgtaccttgcctcctgggacaaggaataatacacgcacgaaaggaacgcccgttgggttaattccggtcgtgacagccattacaacggaatcctgttttgtagcagctctctatagattttgccttgaaaactactatcacaatatcataaaacttatagtattttatattctaatataaaaatgccacgatatgagcacctaacaccgacctgaacattactagttctcatgaaaaaaaaagaacattagtaattaattaattaattaattactaaatttgcatgttctagagtcacatccgatgcaagccacgcacaagtctgatccatcgttgcggccaccaaatcaatatatatatgtagctaagtccacctctgctccctactggtgttttttgcgccttaaagcgaggataatagtaagctacaaataagctattgttaacttggcggttcccggtgactcctcaattacgattatgggatttactgacatccccaaccgtcatta

SEQ ID NO: 45249 - DNA, 1501 bp, Oryza sativa
tgctctccctgccgctgccttttccccttcctcccctgctatggtggctcgtggcttgagcctcgccgcgccgcaactgcccgcccaccgatgcctctcgctggatctggcgagcttgtcaggagaagggagaaggagcttgggggaacggcggcggcggcagccgaaagcaggcgcggtggcatgagctagggctggaaatcgatgggacgccactaatctggtcccagcgcaacaccccattcacgagattagagcttgaggttgacggcgaggtggttgatcccggctcaggaaattgggcggtccggacggatgtgcagaggtaattctccaaagtaaacctcccctcatgtcccagccacttgattgttcttgctgccatcctcaagagcaatggatctagcgagtggatctgcctggaacttgttcgttcttgagtgcattctgggagcactgcatctagcaagtggatctttgcttgtatccatttttgctttgacgtcactctgctggtatttggtgaaaaaaaaagacaggtatactttcttccctttcccccacctctaatggtttgtgcctgcaatggagcaatcgatatggtcaaaaatgttttacccactgcaatgatccttcagctgataacactcggtttcagcatggtcaggatggatcgatttgttgcagaacaacagatccatcaccaagcagtccattgccatctccaccatgggttccttcattcttagtagtccgttgccatcgtcatcttgggctccttaattcttagtgcatgtagattgcagacccgttggtgcaagacatgctctgcaatgcagaaaacttcgcacctctggctcaagttagtatgggaaaaggtggtggctgctggactatcaattgtctggcttactatatttcttgcaattctgtatacacacccagtgataactttaggttgcacgagttgaaattatctagcaatcaaacttagtggctttttacgatttactgtcaagtgatagagactcccattacctgaccttgtactgaatatatatgtctctttcagagctgcaaatagggatagcatttttttactagatgttaatcatagatttgcatggtatgcaaattgcgcttaacatcttctcttgaaactaaattgtagctgtggcttttcttccttgccattcgtgttatggattgcacgaatgagtgctgtatatattttttttcgtgccttgccattcatattaaggattgcatgaatgactgcacagctttttattctttctgttgttgatgcactgaccttagtttccttttggcaatgattggctcattatcttcaaagggtttaggtggtatgcgctgctgggaaaaagatgaaatttgtcactagcaaatacttaaggtaaactgtgatgaagtttctagagaatgcaaatttgggaggttgtgttcggggatacaagttgtgattttttttttgaactac

SEQ ID NO: 45250 - DNA, 1501 bp, Oryza sativa
ccgcaaccacgctcgcctgccaccgcagacgtcgccgctccgcctgcctccagtcgcacactgttgccgctccccatctgcgtcgtcgcgcaccccgcgtcctccgcccctctgctccgcccaagcccaaagccgccgcttgcccgccgcttgccaccgccacagccacgctcgcccactgacgccgccctccgcctgctgcagccgcgcaccgtcacccgctgcctctcgcactctgcgaccgcgcgtgtccgccgctttccatcgcctgcagccgccgacaccggccctccgcctgctccggccgcacgccggcgctcgccctctacgatcgccgacgccgcccctctgcctcactgctctcactgctcgtcatatctgctatcactcatgccgaaagagaagaagaaaaaaaatgaaaagagagaagattgctgactaagatggttgatcctatatttttttctcacgtacatgtgggccccacgaaattttttattatttttgctgactaggatgccacgtccccaaaatcaggcaaaaatactgccaagggacctccggtgaatggtttgaatgagtttaggagcgaacatttctggttttatggttgagggatctcagaaaatcttgctgttaagttgagggacctctggtgaacttattcctctgggattttctgcgtgcagatgcgtgggcagccgctttttcggccggtgccgcgctggtgccccgggcgcacggatgggccaggccaccccaacacgccagcctcccgggccgttgagtcgcgccgagatgaggccgcggcttcaagaggggcccgtgcgcgggctgtggttccattgatcgcgctaagcttctcggtgggtgcctgcggaaaaaactgaaattcaatggcaccccatgccatatagaatgcatggcatccattacaagattttgacacctgacaactaaacctctacgtttccagttttactagcgaagaaattgctaggctcgccgaggccggcgacagcgacgcacacagaaatgaggcggcagcgggcaagcggccggcggcggcgacgcacgcatgaaatttacgcggccaccaccgcatcagatcgcggggcgtgttaattcaaatgacgttagtcctgaagattgcgcgaatgaacaaagtgcctgagtgtgttatgatttgagagagttaatatgcatgctgtggcgatgccataattaatttcagcctggtacttcactaggctagctgttcattacttcatcggttaaattaaaacctgccctgaattggcgagctgagagcgattcagggcggcgtgttcgcacgcggaactatccacgtcgcccccgcgccctgggaggcagcctccctccttgtgcccgctcgccgtccgatcggcttcattgaacggtaggatgatgagggtggagattttgcaaaaagaccctttacattgttagtaatttgttgtaggcccttcacaagaaggaa

SEQ ID NO: 45251 - DNA, 1501 bp, Oryza sativa
tgttaggttatcgtattagtgttattaaattgctatacatttgagaaaaaatatataatggggtaaaattaagtcacaagcgtgtttatatgcatattggaaaaaaaatgaccaaagtcgttaaatattgtaaaatagtaccatcaaaatctctattcttaattaataatatcaccgaggtagagtgatgaggtcatgcagtatgaatgcagcaatgttatttctgtgtctgatttttccttatcatgagcagctgctgcatgcctgcactagaagcagcagaaatcactgcatcagcaatcctttcaactatcgtgctgtcagggagtcgagagtcgagcaggcatgtttttactgtattttccgtcctctgaacgaagccacaatgcagacgtgcagtgtggactgtcgttttggtacatggtagtagatggtacgaacagtcgtcgcaggcaatgttgacgacgtaagtgtacatgaacccatcgccttgcctctgtagatgaactgcgccccccgacccctcatggcctgtgacgcccgtgcgatctcagtggcgcggcacaacacaagcgagcacggacgcctcgacttccataatttctctctcaagggtccgtagcagggcctgatcgctcgcttaggatgcgtttgattcgtagtcaagttttgataggatacagtgatccgttttttatgagtcggtggatattattatcatccaatttttttatggatagaaggaatataatgaaaacaataacaaaatatgttattatcggaaacggatcctctattgtagagctaatactgcacaggtgctgtagcgatcaaatcaagccatctgattagattaagcggctctgattccgtccttaaacaccgaaaatatttttgataatttggaaactaacaaactgattttaaggaggaaaagtcaagatcaccttgatggagggaaaatcacgaatcctctagagtacttggcgccaaaataatacaggttctccctttgctttcttcctccttgggacttggtgccaaaaggagatacaaaggtttcactttgccttgttctgtccagaaactttgatgatcagataaagtaagccatcagtctccaacaaacaggtatgtatgccatgtcttgtactctttttgtgatcatgtcctcacaaaaaaaaaaccaaaagcattgttgtgtgattcttatgattggagtggatacactctacactcgtgtagcgctaaacagagtatacctacagatctgaggccttatggcgaacgactcaaactccaaccatcataattcaaataggtgagatcaatttcattcaggtcaacatagttttatcatctacatttttcttttctctgactatgttgttgatctcattactgaataggatcttaatcatgaccacatagcaatccatatttaacactgtatttctttgttgtaaaaaaaaaagagttgatccctgtttctttttacagc

SEQ ID NO: 45252 - DNA, 646 bp, Oryza sativa
tattttcatcatcttgcctagatcttgtacttatttttatgcttaatgctgcatcggttgagttcgatctattaagtaatatttattattatgatatctggcttgttttatgattgtcgagagagatagtatcggggtttcagccgatcttacctgatttagctattctatatcttatatgcttaattgatatgctagatctgccctttatattaagatcttattcgcaataaagtatattaggctcctgtttgatatattatatatgttttaatatcttaatataaagtggtatcggagtattagccgatacatgctagatctatctgatcggctatgctataaacatttatagtcctcatgttaatgtatattttgatctaagtgatttatactgtctcggcatgatgactgatctatcccaatcacttggtttaaatatacatcgatagaaggattgtatatcgttaatatctacagccgatcgagcagatttagtcatatcttgcttgtttacaactactgatcgattcacatatgacatcggcttgaaaataaatgatatgtcatcggcggctggccgatcagctatcgtttatagatttaaccatggtttttcttgtctttgtttcttgttgattgcagg

SEQ ID NO: 45253 - DNA, 1501 bp, Oryza sativa
tgctcacagcgttcccggcgtcgagcctcctgtcgcggctgtactacaacaacggcgggcagagcaagtggatcctgtcgtggtccgccgtcgccggctggccgctgccggcgctcctcctgctgccgtgctacctcgccggcaaggcggcgccgacgccgctgtcgccgaagctgtgcgcctggtacgcgctgctcggcctcctgagcgccgccgacaacctcatgtacgcctgggcctacgcctacctcccggcgtccacggcgtcgctcgtcgccgcgtcgtcgctagcgttctcggcgctgttcggctgcgccatcgcgaagaacaggctgcggctgtcgtcgctgaacgccgtcgtcgtcataaccgccggcgtggtgatcatcgcgctggactccgggtcggacaggtaccccgggatcacgggcaggcagtacgcgctggggctcgtctgggacgtgctcgggtcggcgctccacggcctcatcttcgcgctgtcggagctggtgttcgtccgggtcctcggccggaggtcgttccacgtcgtgctggagcagcaggcgatggtgtcgctctgcgccttcgcgttcaccaccgtcgggctcgccgtgagcggcggcggcttcccggcgatgcggcgggaggcggcggcgttcaggcacggcgaggcgtcgtacgcgatggtgatggtgtggtcggcggtgacgttccagctcggggtgctggggggcaccggcgtgctgttcctggcgtcgaccgtcctcgccggcgtgctcaacgccgtgagggtgccggtgacgagcatcgcggcggtgatctggttccatgaccccatgagcggcttcaagatcctgtctctgctcatcaccgtatgggggttcggctcctacatggttggccactcctctaccaagaaagcatccacaaattgatgtactcttattgttcttctcctggaacatgaaaaatatgtgaactgagtatgttcttgtattgaccaatgctgctgtgctctcattctcctgaaaacatccagtgcgttctgcttctgcgccaaatattcgatcatcgtccagcaaggacacggagagggatgagtagcgagagatggacgttgcaggtgaagaggttggggttggggcattgcgtcgaacagctggcgggctgttgggcgcaaggtgaccagactgcctcccatatgcggcatagcacgtaggagtgaaaacggtacggaaacggacggaaaccatctttatcgttttcgttttcatattttttttcagagtcgaaatcggaaaccccggatacgaaaacggaatcgaatattatcgaaaccgaaaacggagcgaaaatgaaccggcgcgaatacggtaacgaaaatttatcgaaataaaaaacccatcaaagtgataaatccaattgaaagagtaatgttgttgataaattccaatgtaggacaaaaaatattcttatgtaattttagatttgcataacacat

SEQ ID NO: 45254 - DNA, 1501 bp, Oryza sativa
gtgtatataagaaaagggattctattctacagtcactatagggtttgttctttctttcaactagcatctttttcttgcaccacaacctgtaatacatgccatgttgcttaatcgaactgggttgtgtgaaatgcatgaattttccaatgctccatcctgtcgctgctttctccgcctggaaattttttcctgaatcctgatgctctatcatgaaccaatattcttgctgaattaatacttgaatataaatctgattttggtgctacattaatcaagtccctgataaaaatgcgagcaaaacacacaatgtgccaatgttcttgagttcttccaagcacaagtgcagagattaattaatcatggcaatatggcgacagctgcggcggccacggcgagcactgccatccacacggcggcgcccggcatggcggcagcggcggcctcctgtgcggctccgtcgccgccgtggttcttggcgccgtcgccggtggcattgtgcttcagcgggtggacggtgatggcgaccttcatgccggcctggcagaagccgttgccgcagatgaagtagtagcggcgtgagtcgttgagcgggatgaagtccttgccggaggtccagttgccggcgaccccggccatggtgcagttgtcgtaccccgtctggttcacctcgaacacgttgtgcgtccccttctggtacctgaacgctgcaacgccggcacaagcacaagcatctcgtcgtcggaaatcattgctgctggagcgaaagaaaggaggagatggagagaggaggcttacagatgaggtcgccgacgtagaaggtctggttgccggaccagagggagtagtcgatgtttgggttccagccgtggttagcgccgacgatatggtccgtcgcaccggcgaggctcacggcgaagccggcgacgacggcgacgagcagcaggtggcacgccattgcgccgccgccgagctcaacccagggagccaatggaagggtaagaggaggggagagagaagcacgggcgatttgatttgatttatgtgccgttcgtgtcagaaatctggacccttttttgttcagcctttggcctgaacaaggtaccatggattagtgcaaattgggcgaaatttgaatcatcacgcgccaccgccctcgacgccggcggcaaacacgccgccctggccccagcttgtcgccgccgtctacacgccgtggaacgtgaaaacatgcggacgcccacatggcagggcaactcagacgacaagactgaaaaagacattgatcatggcaagttgatattgattccatgtctcccgacggtctgagaaatcatgccacagaatgcggagcaatttcataccgatgcctccaaagttccaaccacaagcaaaattaaaaatgggagaaatgtcacacacccagagcacaccaccaacacccaggttggatagtacttgaaagcaaaagggacatttcattctaataatataacagtgatta

SEQ ID NO: 45255 - DNA, 1501 bp, Oryza sativa
atatatcctgtcaaactccgtttgatccttgcgagtatgaacagagtttcgttcagaagtgtatccacaggttaataatgaatacttttccgttcatccaatatgagaagtaattttccgtgccacgtgaatagataaagctttttgcacaaggtgacaatggaaggtagatactcacatttgtagcattgcaatttgatgatggaaggtagttttggatcaatgtcattcatgttttaagctattaattaagctgcataaagtacataatgtttcgtttttatggaacaaaataaacgtgtgagtattgtacgagaaactagtacacctaagaagttgccaaaagaaactagtagttgccatgataaatgtgccacgatttaacctatattcttagcttctgaattattatgtgcacgtttcctaagcaactaaatagattttttaagaaacattatatatagaaatttcttagatacttttcaaaatccatctttatttttttatatttaattcattttatatgtgcctttgaattgtaataaaaaaccaaaatattaactataattatcggctgcaatctaattcgaatgtagtaaagcctctactatggatgtggttgagaatactattatttcatcatatatactcagtaatggctcaaatctaattgcaattaacaataatcatttataggtataccgtaaaagtaaacttcgatataagaaaaggaaaagtaaataaagcaaactattcaatcactagattaattcttacaactatatgctcatgttaaaaacattagattattctcacaagagttattcgatgataatacgatcgtgatgtaataactgcagatatattttaacaaagaagcacaaatcaaaacaagaaattatttctttactagagataaattctctatttcaaaagaaagaaaaggctagagataaattctgaggcaggagtatatgtatctgttgataaccaccaaaacggtggatcggtgatctaccggaggaggagagggcattgcaacagggcggcgagcgagagagagaagggagggtggcggtgaatagaaaaaggagatacgcaatcttccccgaatcccccacccctcctcatctccctccttcccttccgcctccgcctccgactcctcctctccggctctcctctcctcttcccgtcgcttccgccccctacaaatactcgcccacctcctcctcccctccccttcgcttcctcctcacctcgcctctcctcgcctcgccgccgcctcctccctcgtcgtcgtcgtcgtcgtgagtaccctcctcctcccactcctcatcccctgcttcgattccgcgatgtttggttccgtggcgaagatcgcccgcggggatcgggggagcgccactgtttttgcgattgtgattggggtttgcgtttgtaataacggtgctggttggatgcaggggggtgtttggggggattcggttgggcggcgaca

SEQ ID NO: 45256 - DNA, 1501 bp, Oryza sativa
aaatcttagatcatgtcatagttactatacagcccaagcatacaaattggcaaattctctagatgaaggatgatgaatcaactgatgaccacattttcaaaaccatatgcattgccctaacggaaaggactttaaagttgcatggagaatatgccatccaagtcagtggtgagcacaaaagagtgtactcatcctccaaatcctacctaggattatgatggttgagtggtgcccactgatcaatccacaaacatggagcagaggagacgtccaggtcaagctcctcttgaatcttgatgatgagcaagcagcagcagcagcagcagtagagggacacttgccgacctgccgaccactctgctgctgtctgctccatgtttaaccacacgtttcccattcactgccagctttgaggagccatgaaatagtaacacggcacttaaccagacatttctctcactgaaactataggatgcagtcatgttgctgctcatgttcgggagaacgtactctctccgtcaaaaaaaaccatcttcacttgtccggattcattccaagaagctttttttttttttggatagagggacttcagttaaggagatgcaaaagaatttgacgatactgtttcttcagggaagaaaaaagaatttgacaataccagctggtaccagtgaaacactgcatgttcagtgtacagtcagtaatgaaacatgatcagataggcagcactgatgtctgatggtgtcgaggcactcatgatagcagcataggaagcctttcatggagacattatcaagagactggacgccttcatggaaacagaatgactgaatgagagttggaagatgtgtgcacagtgttttggaaaataatgagcgtataattgtgactgtcagacaaagcagacatgtaatttcagacgcctaattgctgactttacattcattgcgtcttcacaggcccatggaacaaattcatgagtggcataaactttgaataaaagctgtaaagctctgataagtccgaatgttttttagtacactggtactactagtttcagcttccaatactcaataaaaatgcagggattgtgacaaaagagaaggttggtaaaatgactgtaggagtagtagtcagagtgatatcacaatttagacttgcaccaggattataaattattggtactgtgtgtaaggcattatttggcatgaatatgagttatccaccatggttctgagtaatagctcttgaaatttaaatgaacaaaactagttgaaaaacagatttttgctgcgattcagtagatcatttgtcccctttgtcgataactgggcacctggagcagaagtcagaaatgaagaggagggggcacctgaaccagaatggattgaaacaaagctgatcatgacgtagactatggctgtgtttagtccagcgcaaagtttgaattttggttgaaattggagatgatgtgactgaaaagttgtgtgtgtatgacagg

SEQ ID NO: 45257 - DNA, 1501 bp, Oryza sativa
aattgcatattgacaacatatcgcctcctgtgtccacctgttcgcaactgcggatcaagctactacattaaaaggggcaaactaaatctgccgtataaattgaaactttcctccttacatatgcttgaaagaaccgaaaagaattcctcttctgcatcaagagacgaaaaggaagctacaggattaaagaatcacaagctggcagcacgcacctgttggtagtcctcctctgcatctccacctcatcctggactcgggacccaaacatggcggctgctccccttccccccggaccaaatcttgctgtgtcaactgaggaggccgatcagaggagcagacggcgagcccgatgcttcttcccgccccaaatcaacaccatggcaagtcctcctcctgcttgagaagacttgccaaggactaggatggaacggacacagaaatttttcttcccctttttcgttttcttttcttttcttttcctttcgggagaggcgaggaagaagaagagggagttggaccaattactccctgccttcctgcttgttagcttgagccacacagagagtccacacgaatttgtaccatgtaactgacatgtggacccacgacaaacagccttggaagtatctaaaaaatcgccccgtagtttttttagtcaaaacctttcgcatgtaatataatggaattgaagtgtaattatattgtaacttagctttaactatactgtagctacgatataacttatataaaacttatattcaaatatggtttggtttgttagtgctaggatcttgcacatgagatgtgtaaaaatttctttcgagcaaattttcttcttcatacataaatcttgagttctcaacacgattctatagtcacaaatatgaaagttttaggggtaaaaaaacttatgaaagttttctagcaaatctgaacagccttttctgttttttccctattttttaccggtggaaacggagagagaggtatcagtaggggttcgaatcacgataaattcacgaaaataataaaataaaaatggtagtatcgtttttaacgtttttgtttctagctaaaaataaattttaccttttatttatatcaacatcgtaatacatgaatatatataaaaaaaatctcgaccgtgtagataaattcagggatgtggagtcattagagggcaattaaatgggatctggtttcactatctgataaagtgataagtatgctggatcaaacaaagtcggatgagatcttggaataccacattacagcataaaagtaaacgacagtgtaagttccaaccattttaatcctgcaattaacacggccaaagccatattatcaacgcaataaaatatcccgcaagaatcttatcgttggatgttgcttcagaaaacacttcgcaacaatgagatagtagaataatgatacatttggctgtgtatataattcgtggatttggctgtgtatatcatttgtggatctagaggccggatta

SEQ ID NO: 45258 - DNA, 1501 bp, Oryza sativa
gttaagacattattattgctattgttattattaccttgttcaccctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttagcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttgtacccccttgcattaatcatgcatctgccggtgtgacttgctgagtactgtggttgtactcactcttgctcaatctttcccctcttcagtaagagaggctttggagaagatgtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgtcttttatatcatgtttgtgtggtgtaccccggcttttcctgggacggggattaatacactagcgttcgggaaaatgcaaattttctcggtcgcgacaatatataaaactactaaactgttcatttcttcaaaattctcgaggttggttcaactgcaaacaaaatgcacacgattcacagctc

SEQ ID NO: 45259 - DNA, 1501 bp, Oryza sativa
gctcgtcgtctcgcggcgccgcctccgtcgtcggcatcgcagcggcgtggtccgcgccatcctcgcctccgtgcagccgctgccggcagccctcatcgcctcctcgccggccccggtcgtcgtcgtcgtcgtcgtcgtcctctcgtcgttcccggtcgtcgtggcgttcgtccctccgtcaggccgttctcgtccgtctcgtccgcgtccgtcaagtgtgccgctgcagccccgtcatcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcccccgtacccgttgtgcggttgtcgaccccgatacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctctgaatcgacccgttcaagtctcctaatgtttgtataacctaaagaaccgtgtgctttctttttatgtattgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatccttgagcatattgaatcccagtttataaaattattttgatttaaattaatgcattatcgttttattcccgcgttatcactgttttatttagccatgcctatttacctttgttaagacattattattgctattgttattattaccttgttcaccctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 45260 - DNA, 1501 bp, Oryza sativa
ttctgcatcttgtttttcttttggggaaaccttgtgatgaataccatagtaaacctgattcaaagttggctctcataggactttttttttatcatatcatactttcataggacttggcgtgaagggttaggcacatgtatctgtaggctatttgcactaacacatgggcacttaatttgttttgccgttttactggtttgcaggtttaaagcgaaacctgaagcgacctttgaagttccatatacaatatcctcacaagcggcagggtggacctggttcgaaaattagagatgaaactgaagatgggaataatcctatggagttggattaattagtatacgaattgcgatacaaccaaccgcatacgaattgtctgtattcaacaacaaatggtagtgcaccagagcaccaatataatcagatgagcgtgcttagtgattttctcaaatggaattgcagtttttctactagaactgagccactgaataagctaaaacccatcttattactagagtcatacatggcttgaacaataggattgagctgttgaggtggataatttacatggcatgtatgagagcaacttttaacaccacttcccagaggcctgcagccttagttttcagttcccacaggttgaaactatctccaaagtcttgctgataccagcaaggaactcgaacattcagacttcaaacattcaggaaatcaaattacaatgacaaatggataagactgattgctaattctgggtaatgaattataaaagaactagattggctgtcgatattcctactcaatttgaaatatcacactccaaaatgtgaacaaggtggtcaggcacatatagttaccgaatttctcattccagtgatgtaaacttatagatgaaggtcacttaaaacatgtccatactcctgaatttcgtattggattattggccttgctataagttaacaatgctaacctacctgcttgggtaaaagggttaacgtctcacactaacagatacattatttaagaaactgcatgttccatactggagtatgattgataggaagaaacctcagaaccaacatctgattgtgtaactcagtatacatttagtgcatcaataacaatgttctaaaacaaggtctacaaggccgcacaaaggaatggatcttaaccttgtactgcttaagccacacaataggccagctatgccatgtaaggcaggcgacaacacataacccttgacatcttttagaatcttgataaaaaatgatcaaaggaattgaatttcctagtactacctgttctgcagtctacaggtcgtatggctcaactcaacagaaaagggaatcaaggcaaaatgtccagggtctccaaaaatcaaattttgtggtgactgcaaaattgacagccataacttattgatctattatctctttatccatttagactagtcaggggtaaactcatcatagacatcaagaaaatttaagtttcaaaatctcta

SEQ ID NO: 45261 - DNA, 1501 bp, Oryza sativa
cagttccagacaagatgtagagagcacatgacatgcaagctatgtggaacacaaacccagtcaaatgcaactgcattttggattctagattgccttcatatgaaaattttcttgtcagtgcacgctatatcaagaacatacacataaacaaagtgagcctttaaaagaaattgtcagaaatgaaaacagaaacaatttttctgcccccaacaaagtggagagagagaagaccattttaggtgctcttgcattttttaaacattcttgaactaaattggttgatgctctcgtaggttttctttttgtcatactctcatagggcttgggatgaagggttaggtacatttgtgtgtaggctatatgcactaattcatgggccctttgttttgctgttttactgggtgcaggtgtaaagggaaacctgaagagacctttgaaatttcatatgcaatatcctcacaagcggctgggtgaaacaatcagcaggagcgataatcctattgacttgcatgagccattgcaactggatactggatctggtatgggaactaaagacgaaactgaagacagcgttattcctatggacttggaatagccatgcatgcactaaacgggcataaattaattagagctgttatgaatcatgcccgggcataaattattataaattaagttgagctgttgaaaataatgcccgggcataaattaattagagctagctgttgaaaagcatgcccgttatgtattttggttattgtgcatgactgcatgtctacattttagatttgccttgaatggatatgttcatgctcttgttggactctgtttgatcgttcagagagttgtctttggagcctggtgttaacatattgatttaatttataattctgtttcagaaatatttttttcctactctacaattcagaaatagcaggggaagcccgctgctccattttcatgaaaccagataatagagtttgttgcggagagtggtcgttcgccacgacttgacctcctccgccaacgaaatgtattcgccaatacgcatactccctcctattctatattaattgacgttttggacatagttgagatcaaatttttataactttgaccattaataactttaaaaatatttagtttaaaacaactaaaacaacatatatagatttgttttttaaagcactataataaaagtaaacatacatttatttattgtatatattataatagaaaaataaggtcagagatatattttgtaaaccatgtcattgtccaaaacgtcaattaaaatagaatcggagggagtagttcatatgctacagatcgatctgagacgtccaccgcctgatctgatcaggaaagcagattgctcgagtggccttaccagacatcaggctatcgtcaggcacaagcaaatcaccaccggcgataatacaaccaatagcaattcaaaacaagcacagtaggagatctacttatattgtttaaaataaaaatg

SEQ ID NO: 45262 - DNA, 1501 bp, Oryza sativa
gcctggtgttaacatattgatttaatttataattctgtttcagaaatatttttttcctactctacaattcagaaatagcaggggaagcccgctgctccattttcatgaaaccagataatagagtttgttgcggagagtggtcgttcgccacgacttgacctcctccgccaacgaaatgtattcgccaatacgcatactccctcctattctatattaattgacgttttggacatagttgagatcaaatttttataactttgaccattaataactttaaaaatatttagtttaaaacaactaaaacaacatatatagatttgttttttaaagcactataataaaagtaaacatacatttatttattgtatatattataatagaaaaataaggtcagagatatattttgtaaaccatgtcattgtccaaaacgtcaattaaaatagaatcggagggagtagttcatatgctacagatcgatctgagacgtccaccgcctgatctgatcaggaaagcagattgctcgagtggccttaccagacatcaggctatcgtcaggcacaagcaaatcaccaccggcgataatacaaccaatagcaattcaaaacaagcacagtaggagatctacttatattgtttaaaataaaaatgaataggcgagcaattgccatacaaccaaccgcataagaattgtctgtattccacagcaaatggtagtgctccatagcaccaatataatcagacgagcgtgcctagtgatcttctcaaatgtgactagaattgaaccacagaatatgctgaaaacccagctcattgctagagtcatacagcacgaacaatgggattgaaccactgaggtggataatttacatggtgtgtaggacagcagctcttatcatcacttcccagacgctatttgttttcagttcccatagtttgaactttgaaataagtccagagtcatgcggataccagcaaggaactcctgcaaatgcaaaatggagttcagacttcaaaggtttcaggaaaccaaattacaatgacaaatggacaacactgattgttaattcaggggtaattaattgataaaaaggatgaacaagactaattgttgatgctcctacttgatttgaaataggacactccaaaatgtaaatgaggtgatcaggcacatatagttaccaaatctcattccagtaatgtaaactgcttactgatgaaggtcacttaaatatgtccatgctcttggacgtcatattggattgttggccttgctataaattaacgatgctaacctaccggcttgggtgaaagagttaatatcgtttcacactctgacagatacattatttaagagactgcatattcatccaccaaaactagaaagaaactgcatgttgcatactagagtatgattgaatattgataggaagaaatctcagaaccaacatatgattgtaacttagtatctttagtacatcaataccaatgttaacataaggtc

SEQ ID NO: 45263 - DNA, 1501 bp, Oryza sativa
gcagctcacgttgggtttgatggtacaagacgaggatcattcccaatgcaaacctgtctgtcagatttgttgtccctggatctcgtaatcttgtaatatatccgcgatcaaagcttttttagtgttcacgaaaaaaaaaatgatctgtacgtgggcactttattggacttagaatttgacattgttatcgcagattgatttgcatttgaggttgctaaatacggtaaactgtgcgattagcatgctaattaagtagtcatatgatctagctggcatgggattagtacgggtagatgttaatgcgatgcttttggttagtttacagccaattggggctcctggtttgctaggctggtcccccaggggtgtacgatggaatcggggacaatgcattttaataaaattaattaaaagagggatatgatttgtgtttttctaaacaaagaggaaaagaacaaggagagaatccgtacacgataccggtgtcgcgtcgatgatactgcaggctcccgtgtccggttttgagggtgctgagctaatcaatcaatccattaaccattgtcagatatcgttttagttttgggttatgtcgagcatgtctattttaactattatttcttataaattcgtatattctaatatcacaaagtttttatttagcataagaattcgtaatttatataagtcttaaaataaacgatttttcaaaagttaatggtaaaaatagacatagacatgtttaatccatattctttcacaattgaaacacatattttatttgtttttgttaacaagttttttaaactactaaacgatatattttacgtgaaaaactttctatataaaagttttttcaaatatcatataaatttatttttaatcttgaaataatcaaaaatcaatgaatcatactctatccgttatatattataaatattataagttgtttgacctttttaagtaacatattatagaaatacatttaatattaaatttgataaaactaatttaatatcgctaaatttttctacaaacttgataaaagctaataaaatttaattaggaaaaaatcaaacgacttataatatgaaatgaaggaagtccgtgctaatgatttctcatttttatgtctctatacttaatctttcatcggactcgttcaacgtgacataagttagattaaagatagaatgataaatcaatttgaaacatttggaataagtaattaaccatcatacaaatcatgattaagccttactcataaactaaccaatgataagtaattaaggctaggcgacgtgtcggcccataccccgtccgtcctgtaataatctcctcggcgcgacgccacgccaccgaccaacgcgacaaggcgagacgacgcgcacgcgacacacagccagcggaagcagcagcaggacgacgaggaggaggaggagatagcttagatcccgctcgcctctgatccccccggatccgatccgagatcctccacccatgg

SEQ ID NO: 45264 - DNA, 1501 bp, Oryza sativa
tccacaagggtaggagtgcatgatcagactcaaaaactctggtgagcagtgagctaaataaattgcactttttttttaacattaaataaattgcacttgtgcacagttctgcacttaatatgcaagcatcagataactgcaactagtcttgcatatacggtgatgatagtagcagtacgccagtaccatatgcttgactttctctataattattgacttccacttaactgccgtaggccgtagatgttgcaagatcccactaatggtcaaccagttgaacagaacaatgatagaggtagagtacagtagagtactactagtatactccctccgctatctatatctattataagagattttaacattttacttacactatttgactattcatcttatttacaaaattttaaaattattatttattttgtttatgacttactttattatctaaagtattttaagcacaacttttcattttttatatttacataatttttttaataagacgagtggtcaaacatagtatgtaaaatatcaaaatactttatattagggaacggagagagtattatctctgttaaaaaaactcaatctatctttttagtactgcaaatctgaataattctttattcagattcatggtacttccttttgggttattattatttttttttaacggagaagaggcagtactcggtgcagttgagtgcagcgcaggctggagttgggagttggctgcctgcgatgcgagggcaaagaaaaggaaaaaagatgccgctgcaggcggctgccgccacccaccaaccgcggacaagtggaagccccaaaccccaaccgaaagcgacggcgcgcgcctttggtggatggccgttggcgccgaggcaagcgaggcgcctgtattttcttacatttcagcccttccctaaaaacttattttacgaatgaaccttttaaaaaaactcttataaatgaacccttagaaacttattttacttttgcacctaggtccaacgctatgctgaagtcaatggcgtcgagggagttgacaccttgtcactttgtgtgagcacgcggaccggcattttggcgattgttaagatctctagccttgatcctcggtatggtgaagtgagctatggttgcgtggacacggtcagtcagcagttgtagttgtttcatgacagtccatctggttgtggccgctgccgtgccgaatcagtgaccaggatttattagcaccaaagactccggcgctgtgacgttggacctcatctttcccaaagtctaaacttgaaataaagctttgctgatggtgtctatatatgtaaaataagtttatagaaagggggtaaaacagaagaaatccagggcgaggcgtggtcagtggtcaccaaccgcgggcgccgcgactgcctgccttgctgtctcgtgcctgccgtggaaaacgagggaacgggaacccaacccaggcgcgggccccgccggccaccgcgcgcagtcg

SEQ ID NO: 45265 - DNA, 244 bp, Oryza sativa
ttggcaccaatgcacgatcgatcgatttatacaaatccaccaccaccaccttcgcggcggttatccacttcatcaccggccactctgcctagagcattatcatcgatcgtcgtctacctagctagcttcacttgtgctccactgcaaccagtacgccacattaacttaattcacacctagcttagctcactatatagcttagcttcgcttaagcttaagctgatctcggagaagacgtacatga

SEQ ID NO: 45266 - DNA, 373 bp, Oryza sativa
aatttaagaatacgacttagtgtacactggtaacccatgtcaatgaaatgcccgtgtagattataataaacttctcctacatcaaataatcataaattggatctatgctaatatgtattctatcactggatcaaggaaaccgcctgattagcttggaatggttttattggtactgtattcttgtattggtgaaagatgatataattaagtgtaacaacctgatatgagctgggctccatggcctttgtctagtatatgactaacagctatcctgattgattgtgatgcaatatgctgtatgtctagagtgcaacagtatattaccctctcaagtgtttgttatggtactagtgtttactgcttgttcttcatc

SEQ ID NO: 45267 - DNA, 1501 bp, Oryza sativa
gagatgatgtatttattaatggcccactttaagaaaccatgggttgtagattgtagtttctattgtgatgtcttattgacatggtaccatagacactgtttatggacactatgggttaggtctgcccttaatagcacactttcacattggtctaattattgctaattactcctttttaacacgttctttaataacacactttgactatgtttttaataaatatgaaattagcatcaaatgaaaatatatcaaaatctaaaattactgatataacatgtataatacatggtatagatatagctagtacgtatggtcattagtcaagggctatcgagtttgattttgataaaaaagcatgggacggaaagagtaactaacataaatatcctcatgcactgcatcatgattcagcctgcatggctcacttgtgacgtgcatcatactccctcgtctctaaatatttaatttgacactattgattttttaagcttatatttgaccattcgtcttattaaaaacttttataaaatatgtaaagttatatatatacataaaagtttatttaacaatgaatcaaatgataggaaaaaaaataattacttaatttttttaataagacgaacagttaaacatgtttaaaaaaaatcaacgacgttaaatatttagggacggggagtatatgccaagtacttttagatatcataatcaacttttgaacatatatttaatcattctttttattcaaaataattaccttttatcgataaacatgacttgtaaaattttcatatttccacaaattattatgtactatataagatgaatgaccaagcgtatacatatatctaaaaattaacaacatcgtctaactatcaaacatcgatgtgagtataatctagctagcccttttctttggattaacatttttgccgatcaagctatcattgggcacattaattcacaaacgatatacgtatatccacgcaacgaaagatttgttggtgcagttagttgtgcatacccgtctcgttcagtttcatatcaacctcacgtcatgcccggatcggatcgatgatcacaacacctacatatacaccactctgccctttacgcccggggaccatgcatcatatcgacaacgacgacgacgtggcctccatctgcaccgtcggttgcctcatccaacggccaagattaaaccacgtcacctgcatatgcccttcttcctcgccggccacacacagttcatccaaccacttggcaccaatgcacgatcgatcgatttatacaaatccaccaccaccaccatcgccgccgttatccacttcatcaccggccactctgcctagagcattatcatcgatcgtcgtctacctagctagcttcacttgtgctccactgcaaccagtacaccacattaacttaattcacacctagcttagctcactatatagcttagcttcgcttaagcttaagctgatctcggagaagacgtacatga

SEQ ID NO: 45268 - DNA, 1501 bp, Oryza sativa
catggcgcacgcggtggtgcttccttctctctctaattatttctctatctagggtttaatataatttggtcgatatgatattctagcttaattattttgctatttaattaattagggccttggagcccggccctatatatctcgcccgctcgagcccatcagttggcccatccaaccgacgtaaataaccacctggtaaattggaatagttgatcccccagttccccacacaacacattcttttttttctttttctttttctttttttttgagaactagtaacacacaattaacacattacacacgggtttcagcttttcacgaatagaacgctccatttgtttcggtaaaaaccgaaaccccagaaaagccaaaccgactttaggtatttttccaaaaaaaaagatcctattaattagacgtgccagtcatgggctcgattggttggacgagagctattagttattaggaattattcagggtgtagaatagatttattactaattattatagtaactagaaaaattacaagtacgttgcggtgcaaaggaaaaaaaataaaactaagataaatattaatcatttaggttcagtttttatattctaatctctttaaaaaagaatcaaattacttcaattgattttgttgaacttaattatactccattagtatgtaattaaccacttatagcaagagcaattaatatatcatgagcatctatcattaaaaaatgacgtcgaaaagaaacctatacgaaacttgaatcataaaaaatgaacttggatcgaataataattatatctgaatgacatgcatcatgcaagtaaataaatgcagaacggggagagggagcaggacaaattagcagcgtgagatcgcgctagagacaacgagattaaagcttaattaattaaggttgcggttcattggcagcagattagcacatgtacaaatagatatagatcgagaagagatagagattaatactccattgagtgaattttagacatgtacgtacaaattaatttagcgaccaaattatcaacttgttggagctttacataccttttttttttctagattcaactttacctacataataatttcatccttaatccttgcagcaatgaactaggtgaccaattaatgttgtagtaaatattgataatttagttattaaatttgcatttctctaaattttactctagttaattaataattagtttttctcttacaacaatcaacagggagatcgaggcgtgacggtggattttttttttaaacacaaacaactttattaagtaagaacagatattaggggataaaccccagtacacaacaaaggatagtagctgaaagcattagagacaaccctaaagaaagaggattaaccaaactatggaagccttccagatgtaacaaaatagcagaaaaaggagcaagccgatagggagctgcgttgatgccgtgacgattgtagagccacgacgtcttaaaacc

SEQ ID NO: 45269 - DNA, 1501 bp, Oryza sativa
tggactccacgttggggcacacgccggcgtagtagttccgccggagctgcgccgcgcacacggtggcgccgcccgccatagcgaccagcaccagcatcgccgccgccgccatccgccgcctcatcaccaccaccatcatgtacgtcttctccgagatcagcttaagcttaagcgaagctaagctatatagtgagctaagctaggtgtgaattaagttaatgtggtgtactggttgcagtggagcacaagtgaagctagctaggtagacgacgatcgatgataatgctctaggcagagtggccggtgatgaagtggataacggcggcgatggtggtggtggtggatttgtataaatcgatcgatcgtgcattggtgccaagtggttggatgaactgtgtgtggccggcgaggaagaagggcatatgcaggtgacgtggtttaatcttggccgttggatgaggcaaccgacggtgcagatggaggccacgtcgtcgtcgttgtcgatatgatgcatggtccccgggcgtaaagggcagagtggtgtatatgtaggtgttgtgatcatcgatccgatccgggcatgacgtgaggttgatatgaaactgaacgagacgggtatgcacaactaactgcaccaacaaatctttcgttgcgtggatatacgtatatcgtttgtgaattaatgtgcccaatgatagcttgatcggcaaaaatgttaatccaaagaaaagggctagctagattatactcacatcgatgtttgatagttagacgatgttgttaatttttagatatatgtatacgcttggtcattcatcttatatagtacataataatttgtggaaatatgaaaattttacaagtcatgtttatcgataaaaggtaattattttgaataaaaagaatgattaaatatatgttcaaaagttgattatgatatctaaaagtacttggcatatactccccgtccctaaatatttaacgtcgttgattttttttaaacatgtttaactgttcgtcttattaaaaaaattaagtaattattttttttcctatcatttgattcattgttaaataaacttttatgtatatatataactttacatattttataaaagtttttaataagacgaatggtcaaatataagcttaaaaaatcaatagtgtcaaattaaatatttagagacgagggagtatgatgcacgtcacaagtgagccatgcaggctgaatcatgatgcagtgcatgaggatatttatgttagttactctttccgtcccatgcttttttatcaaaatcaaactcgatagcccttgactaatgaccatacgtactagctatatctataccatgtattatacatgttatatcagtaattttagattttgatatattttcatttgatgctaatttcatatttattaaaaacatagtcaaagtgtgttattaaagaacgtgttaaaaaggagtaattagcaataattagaccaatgtgaaagtgt

SEQ ID NO: 45270 - DNA, 412 bp, Oryza sativa
gcgaagacggactctccggacacgacggaatctaagcagaaaagaacaaaatcaccaaaacagcacataaacaagcatgaacagtacatgtggatatttttaacatgtagatctcaattttagaaaaaattagagacttgaaccaactaaatcggagctaagatgaattagttatgaatttttaaagattaaatcggattaaaacacttatatcggttaaaattgaattatgacgcaataatgaattatttttgaaaaggaaaagaaggtttattgcgtcagcgggctagggtttgcggtggaccgggcgcacggcggcggttcacgcgaacggacggccgagatcgaaccgatctaagatggacggccgagatcgatcgggtccacggcggctcacagcggacgacctcga

SEQ ID NO: 45271 - DNA, 425 bp, Oryza sativa
tggttggcacggttaatgtttcacaaccgaaactcgtgaaccggtccttaattgtcatgagcacgaccatcaaaaccatgtgctcacaacccaccattatcaggttttagttggcacgttaattaattaaccaatcacgattgaccatcgtgaactatcattaagccatcattaaataacagtgagtcataagttatcccaatagtgtgctaatgtttctaagcagggctgagcaattatatctaatatctagttgaaccaataaataaagcccaactagtcaagttataataacccaaggtatcaaggaataaggtaatcaagaacaaaagggctataacaaacaataggttaattccacccaatggcatttgaaaataaatgcaatagttgaatagaaacaatagctttaaataggatcaaca

SEQ ID NO: 45272 - DNA, 1211 bp, Oryza sativa
ataaatacataaaacaatatatatagtcatgcttaaggaacctttaataataaaacaaatcacaactaaataaatattacttaggttttttttaataaaatcaatggtcaaatatcatatccaaaagtaaacaatgccgtatattactagaaagtacaaaacttaattaatcaattgaagtagacatgcatgggtacgcgtacattcaggttgtattctgagaaagaaagaccagaccaagttggtttcactgtatgatcagtctgaccgactttgccataacacatgccatatacccagaaaaggtctaaactttatatttacaaaatagagagaacaggtcaacactatatcgatctgctagtagaattcttatgttgaattactcaacagaagaccagctgcattagccaattaaccctcaacgtttcgaagttgcacgaaatcgattttttcactgaaaaatcacgatctcaaattaaggcgatcatacaggcaaaagcatccgcaagaattgtcaatttccctgcctattaatctaccatcatttgtataagttggtgagatctcggtttcgatcgtcctccagccaaggcatcaggcatgtcatgaacaattgaacacacaccgggcatatctatcgcgcaagtagtagtagccgacaagcttgcctgttcccagcgaccttcttctgttccagccgcccccgaactcaaaacgatcacgccaagtcgccaacaatgcatgctggaagctggatgcctcgaatctcagcatgaatgattgaatgattgctcactgtgtacttgttattttaatcaaatccctttcgaattttcgatgtacccctgagctgtccttccatacattggcgataaaactagagctctggagggctggggtatatccccggccgtctgccacctaccatatggcgttggccgttgaaacatcccctgtcatgtggcacgagacaacccaaaattatccagtaaacttatcgagtaaggttccttgtcgccgttgatgacggcagcctcgacgacgatcgatcgatcgagcccgtgtcgcgtactcccgtgggtgatgccacattgccattgccacgacgacttcttccgcgaagaaccgttcgtttccaccgacgcttttgacacgagatagagagagagggggaaaatgctgaaattttagtcccacatcgctaaacc

SEQ ID NO: 45273 - DNA, 1501 bp, Oryza sativa
gctacgcgacgcatctatattctgtagctgctgctgctgccgatcgatcgagctgtgtgatgtcgccggcgcttggagtcttggagcttcatcgatcagtttcctccgggaccaaactccatccggcgacagtgctgttgcttggttccttccgtgtacaagtacacacggccggtcccctcctcttccatgtccagggaccagtgggatggagacttgtgaatttggaggtttaattttccgagtcgtttccgatgacctttgacctgaccagggtctcaaagatactcctatgacggtaagtaatcggtcgcggttatcaatcttatcaagtcggttcgaattgagaaaccgtgcagtaagccggctaaatacgggaaaggttcagtgtatatatctgcaaaatttgttcggatttcaccggtttttgtcgattgatttcgagctaatcaggtaggactgttgggtatcgacaagttttctttgtctccagaaacgcggggagcacggcttgaaaacgggggctcctcgccgtggaacaattctgctcgtacaggctagtaattacttagccgagaagcacaaagatgacgagcaacaggaagaaaacgcggtacaaattctggacgaaacacgactggagatgacaccagcccatgaccaggattcgtcacatgaaacagcgatgtgcgatttgattggaatcagttcttggtagcccgttactttcagagccatgaacacaaacaacaatgccatcagcatgtgcgagcatagcacagcacggcacggcaactcagggactaaaatttgattaatactggtatctgtatactacaggcttcgaccctactactagggaccatatggctttcttttctgcctcatattcagaaacttctctgcattattgttattattattattcctgttcagagtttgatccgatcattcaccggtaaggctaggcatttcgcagcggggaagccgtcgtcgtgaacggcacttcacgctctcctttgactcggctgctattattgaacggcgacagctcaacgtgccatttctgaacctctatgggatatggactcgtttcgtgattaacttaacctttgtgtcaataacgagacagagcaaccgtctctgtcaaaagaaaaagagaagatgttttctgtttaatcgttcgaaagctataaaactattacacacactcatatatatatcgtccttggcgattaaaagatcaatgtaaaaaataaatcataattgaaaactctaaaattaaattcaatattaagttttatttgtagataagttaaaaggtaagcgatgggtgttgttattactgcacgtggcgagttctaactggccagcgcatcgcgtcaagctagaaagaactcttgtcttgtcagctgttctgttcgacgatttgtttacaaaaaaaccaagttaggcagtggaatttcttaatggaaattcttgattacgtgagcttgattag

SEQ ID NO: 45274 - DNA, 453 bp, Oryza sativa
tttattaaatttttgttaccacccttggtggacttacttttttttttatttttttgacaccttggaatgccacgttaacctccccagttcaaaaccatctaaaacaggagttagggggttaattgtctagtatgaaaagttgatggtattggccccgtttggcacagctctacctcccaactccagcttatctggagaactgtgccaaacggtactgtcatggttacggataaggcatacctcatatcccacgccttatggaatatacggatacggtataccttcatgtatacgatatgtttccgtatgcgataagggaatttacaagatattatggaaaatatccttatgggcaagtgattatcagagtcctattcagagaggattaggtttattctatatcgtgcagggtttgttgtctctgagttctacttggagactaaggcaactcac

SEQ ID NO: 45275 - DNA, 1501 bp, Oryza sativa
aattaaaaataaggaatattagaagtagagtacagattccatatagaaatacaattaggaaataacagaaattcggaattaaaaataaggaatattagaattagagtatatagtccatatagagatacaattaagaaaaaaacagaaattcggaattaaaaaaaggaatattagaagtagagtataaagtccatataggaatttaaaactaactaaaattcggaaaaaaaaagagtctccatgttcactctcatgacctagaaattctcatattaatcggagaaaaagaaaaagcaaagtccatatagaaatacaatttagaaatagctgaaattcggaattaagaaataaggaatattagaagaggagactagagtccatatagaaatacaattaggaaataactgaaattcgaaattaaaaataaggaatattagaagaagagtatatagtccatatagaaatacaattaggaaataacaaaaattcggaattaaaaataagaaatattagaagtagagtatagagtccatatagaaatacaattaagaaaaaaaatagaaatttggaaataaaaaaaaagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaagagcctccacgttcgctctcatggcctagaaattctcacattaatataagaaaaagaaaaagcagagtccatatagaaatacaatttagaaatagctgaaattcagaattaaaaaataaggaatattagaagaggagactagagtagttattacacattagtagtttcgtaaagttattgcaaaatttaaaattatgttgtcattgtaatatattttaataataaaatgagaaaacatatatgctattatacgtgagaaaatataatgatgctaaccgcgtaatctgcgcgggccaccatgctagtttttttttttgaatgccaaaagaggtagtatatgacatggtacatacggagtaccttctattagtatcttctcaagcaccgtgatagaacaaatgtccatctatctcgaggcaacaaattgctcaccttaggagccaaactaccgaatgtataataagatcgtaggttgtgatatacaggtttaatgcttgagaatgcaacggacattgctccagtcaaggttaagtacatcttgcactattgttatgcacttttcttttgagtgagaccaccaaaaacaacataggaaatccccaaaattgata

SEQ ID NO: 45276 - DNA, 1501 bp, Oryza sativa
tcgacggtcgccttcaaacttaaaatctgagtaataacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagacaagtacaaccacatgggtggaatgggacacccctggctgagtaactagcttatcaggggagccttgatgccgagagacatgtggattcgccggggtggtgtcggggaggacccctgggcttcctggcacagtatggtctgggagctaacctgttgttggtctgggacccctctcgtcggcgtatggtaaacctgtgtcggctttggaaatgccttgtcatgaaagcttggaggtctcccgacgtggctgatccccacgggctgggtgatccgggttagtaatgtcatgcgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgctaaccttgtttaaattctaaagactgatacattgcacatactccgaccggacgagacgcactgtctcatccgtgtcgtttgagaagcactcacttagttgtttcagaaaagagttcaaataaaaattaattgcaaaaacatcagcctttccttgaagcctgcattaaacacttatttcccatggcttgctgagtactcccgtactcacccttgctctatataaataattcccccccagttgctgaagaagatgaagcggatcctgctgatgaggagtttttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttgaagcgtcacgggctagttccggtcgggactagttcggggcgtgacagggaagacatgacccaccctgcatgagctcacctctccgtcggctggctgccactgctatcatcgtcgccttcctccacgggccaaggagggcgcttgctggctcgctgcctcctccgtatctacccggctggggatgaagaaaatgggggaagaaaagagaagaaggtaacatgtgggaccattcat

SEQ ID NO: 45277 - DNA, 1501 bp, Oryza sativa; identical to SEQ ID NO: 25151

SEQ ID NO: 45278 - DNA, 1501 bp, Oryza sativa
aacatttctcgatccgtaggaacgggcggtgaggtgaccagtgtacgtaacatgttcgattgttcatcgatcccaagcgtatactacctctatcccaaaataaatgtagccgtgaaaatccgtgtccaatgtttaacttttcattttatttaaaaaatttatgaaaaattttaaaaaaattagtcatacataaaatattattcatgtttttatcatctaataataataaaaatagtaattataaaaaaattttaaataagacgaaataggatgaatagtgtaaaactagtacgagcgagtcgatatcaagcaaattaaaagcgagcacatgcacatgcagaggccaggcttgtttaattgtgttacaagcttggccaaccggacattccactccactgcaacacccttctcttgctcagcgcgctcacgtcgaatcgtaacagttctacttaaaaaaatatgttgtcatataggagtattttttttcttgatttgagttattttgtgattactatctctccgttcatgtttctatctctctgctacctcttctttcaaatgggaaatttattgttgtaggctgtgttcttccctcttttttcccaactcacctttcttgttttccgcgcacacgcatttattctcaaactcctaaataacactggtaggaaaacaatctttctgtacgaggacccctttagattgcagatgaaccgtaactaacggcgtctgcaaaaatcgacctccattttaacgtacgactccctaagagacccgcatgtaaaattctatttttacagacgggtctcttaaggggtcgcatgtaaaaataagtctattcacatgcgggcctcttaaagatctgcatgcggatctcttaaagattcgcatgcaaaattatcttctctttattacagtttttccctcctcaccacttcaaaattttcacctcttatcctctcctctttctcctctctaatatttccccctctctcttccttcacctctatctttctctcattttctcctctccctctctttctcttcgtctcctctctctctctttctctcaccgagcgggaggcactgggcaacgggcggtgcggccgacgagcaggcgctgggagcaggcaccaccccacgacacagactacggcggcggcactggggggcatgggcgacggcggcggccctctcccgcctggatccgccggtggttgccctcccctgctccgatccgctggcggcggccctcccccgcctggatccgcaggccggtgccctcccccaccctgatccgtcggctgtggccctcccggtgcctcctcaccgtgacaggaggaggacgacgtcgacagtggctgcgaaggcttaaggacgacggcgaaccggtagtgggtgtatttttcgacttttggaatttttatttttttcacgatttttccttttcgcttgcagttgcacgggccgcatatctcgtcctaagcttcataatccgttt

SEQ ID NO: 45279 - DNA, 1501 bp, Oryza sativa
ttgaagcaggcacgaatctataggccacgcaaaagaaactcctccaaaaaaaaagaaaaaccgcgcatctttcaactgcaaatctgaaaattccagaggatgatcattgatcaagaagctcctcatcaagatcaaagattctcactcgtgcaagaatccatcagtagtactacctccgtcccaaaataagtgcagctgtggatattcgtgcccaacgtttgatcgtccgtcttatttgaaaaatttgtaaaaattttgaaaatatttagtcacacataaagtaatattcacgttttatcatctaatagcaataaaaatattaatcataaaaaatttttaaataagacaaacggtcaaacgttgaacatgaatgtgcaaaactgcacttattttgggatggagggagtagattcgacccgttacattccaaccagaggcctctgccgctcgatcttgctacactgatactgacatggatttggatgcttgacgcgttctccgcctaatcttccccccggcagattgatgaggcggtaggcatcactgatgctgtgctccctgttggaagtgaaagcggaccggagaaccaattccacaggggcagctgctgctggaccactcgaggtagaggtttcatctcgttctaacagtagagtgatggacaggaggaggcagggacagctcgacaaatcattgctctttcctctctcccgagaaacgatagaatttatagttataccctggttgcataattggaagctcgccgttgatgaggaagaaagggacgccgacgatggggacgccgcagcccggcggctcagttcggtcggcttatcaactgggccgcctggtccgtgtcggggacggcgcgatgggcttcctcaacggcccaagtcacccagatgggcctatgaaagtagcccatttgggtcacttcgatcgtcagatcggatcgagactactcatcttttcgcttatacttatacgagcaaagttttaaaattttaattttagatttagagttaattttaaagttttttgtcgttgtttgttttccagtatttgcttttagatcgctaaaaacacatactgtgttcattttttaatagatgacgccgttaactttttctcacatatttgactatttgtcttattcaaaaaatttacgtaattataatttattttgttatgagttgttttatcacttatagtattttaaatgtgatttatatcttatacatttgcataaaaattttgaataagacgaatggtcaaacatgtgagaaaaagtcaataacgtcatctataaaaaaaaaacggaggcagtatatttttcgtttgtaaaatatgtagtttgagtcctaccgctcttccctgattctggcggcacgcagcgccgcctccgccgtctctattttcttttctagttgaatctctagtcgacgtagaagaattcttctatactttctggttgaatgtctagttgacgcagaagaatcct

SEQ ID NO: 45280 - DNA, 1501 bp, Oryza sativa
gccgaagaggcgcggcacgctggagaagtaggcgtgggtcttgccgttgtccatgttctccgggcagtcgagctccaccacgtcgccgtacgccatcgcctccagggacaccaggacgcggtcctccggcgagccgacgcggcagaagacgaaccggacgtccacgcgcgccctcgacgccaccgccggctgctggagggcgtacaccatccggagcaggtgccgccgctcgtaccgcgccgggagggtcagcacgccgatcagcagccggaactccggggccgcctgcacgccaccgccgccgccgccgccttgatgatcgccgcatgcggcggcgccggccagcgaggcctgcagggcgaactcgttggggtagacgaccaagagaagggcggcgaggagtgcgacggggagcaggaggagcgccgcggcggggacgggcggcagcggcagcctctgcggcttcatggcagaatgcgtgcgtacacggtgtgtggctgtggcccaaacgaagttggttttggcagaggcagaaatggtggtttttctggggatttttgcagcaggttcacgcggtgcggagggaacacacgatcgagtacaggctgctgcatatttgcagcggagtagagagcacatacgctgtgaagaagtatagtgcaagcatatactcccttagtctcataatattaaaaccttagactggatggaacgtttcatagtacaacgaatatggacagatgcatgtccagatttgttgtactatgaaacatcacatccaattctagattgtaatattatgggacgaagagagtaacaagtcttcttcgcctttgcgtggaatatagttgtggacttgtggagctgtggtggactggtggtggcagaggaaccttggtagtagtatttggtttctcagaagtccattggccgggccatgcttcgattcctggatggcaggccatatcatttgcatgaaaaagggtccaggttttaacgattcacaagtaatcaaagacggcatgacacgtagctttctagactttttaccgaggaaacctgcacatgctcatcgcctcatccgtagcacattgccatttgccagtgcgcccagcgcagcccagcccagagctccaaaaataccaaaccaaccaggcaaggctgtgccgactgccgaaatccatcacggcgcaaaactcgcaaagctcgcgccgcgcatagtccaaaccgcgaaaatttcgctctcccaccacgaaatccccaaatttccccgcgcggtctccactctacactccccgaaaccaacctcgccgatccgcgcctccctcaatccaacggcccacgctgcactcctcaccactcacgcggatcgctccccatccgacggctccccactccccactcccccacccaaatcctatataacatcgccctcacctatctccccaatacagatcaaccaaaaatcgccaccaaaaatccccaattccatcgtcgtcga

SEQ ID NO: 45281 - DNA, 1501 bp, Oryza sativa
atgagattgttttagcgctacgttattgttctcatggtttttgttgaaccatgttatagagcccgaaacgaaacaatagtcacataggataaatccaaatcatcttatctattaggtgtatatggaagttttatgagactgttttagctttacgttattgttctcatagtttctgtagaaaccgtaacctgaaacaaagcaaatggttacataggacaaaccaaatcacacaaacttcactaattggtaagcttggtaggctcgcaggaacgaaaacacaactaattggtaaaataaatcgcatttgacatatctagctaatccgattaatcttatactctcatcatctaatttttagctgaccaccagcttccaaattttgaaatttgaagctttgattataggatttatttttcatctaagtttactttccggtcttcgatttcaaattgataatgatacaaatataaaaacttttacttttatttgaaagccaaatgaaaaataccctgaaacgaagaaaaagtcatttaagacaaacttagagataccccgatgtgtatgatcaaaatggggtctgatacactgctgatcagttcccacattgattttggtgtgatattccgttccataatcgtctttaaaaaacaaaagagggaaaaaaacaaaacactatgcaaccgtgcaaatgaaagcatcgtcaaatgattaaaaacgtcaaaccaattcaatcaaccccaaactccaaaccaactttttttttctcttttcttttttttctttttgtcgatcttgagcgaagcaatcctccaaagtccaaaccaccaatcgaagcaagaacacaaaaacaaaaaacagcaccagcgaattcggtgccgcccatcggttatggctctcgccccacacatcttgcgttccttctcgcagcaaacatttcccaaatctcaaaaaaaaaaagaaagaaaagaaaaaccaaaagaggaggatgataccgtgatgacaccatgcaaggcagttcgtcacatgatctggttcgctccaaaaagctgatagtaaaaatcatcccaaaatatctcctcggagaaaaattcttaccacaccgtccctctcctgttcatccctgttcgtggccgaatcttttgtttttaccgaggaatcttttgattagtggttgtagtgacatcatggacagaagaggaggttggtaattaggcggggtaaaaaaggaccgaggcgacgcgagagctcgtctcctccactcctcgtcctcgtcctcctcctcctcttcctccatttttttttcttttctttttatttgattacgccgtcgctgtcgagtagcgcgtcagctgcatccgcggttataagtagcggccaccacccaccacccccggcttcctctcccactgcgccctccgcgtgagcggcagcaagtgttcactgcgttcttcttctcgatttatctttcttggtttcttgatctgtagcttattagcggcca

SEQ ID NO: 45282 - DNA, 771 bp, Oryza sativa
tgcttagatgtgatgacgttgttaagggccttcatagggcaacgtggctttcagcccgagcactccaccttggagactcagcatcacgtccgcgtctgaacctatcaaaacctgaagatcacgcgttcaaagaggatcatgtgttctttgaagttatcgagagcgtgtagcgtggagagggagagatcttggccgcactacggaggtgaggcttgtggcttccaatacgtgactttgggtatactccctcctaccctaaatgtttgacgccgttgaattttttaaatatgtttgaccattcgtcttattcaaatcttttgtaaaatgtgtaaaactatatgtatacataaaagtatatttaacaataaatcaaatgataggaaaagaattaacaattacttagattttttgaataagacgaacgggcaaacattttttaaaaagtcaacggcgtcaaacattttggaatggaggtaatatttattgaagcttctacttgatgacacatgcaccatagaccttgtatctttcatgggtcttatgcctacgtggcacctgggaccaaacaggtttgtgtctggttactggtcaaacaaaaaaaaaccagtgctcctatctgataaagacatcgaaaagttggcatagccctagaaaagtcttccctagaaggggtctcagggtcataggtaggataagtacactgttaggatactaactcttctagtggagcggccacggcaaccacaactttaggtttcaaagcagctataa

SEQ ID NO: 45283 - DNA, 1501 bp, Oryza sativa
cgtatcccttgaatgagagtacgagatcaccaacaaagttcaaattaacaacctaaagtttcttctgtttagaattaacaagaaaaaaaaaagaagggagctttgacagcatcacctaaagtttcttctgtttagaattaacaagaaaaaaaagaagggagctttgacatgcatctaacaatctatataaagagtggaacaactaaagaacccatcattttttttatttttagataatactacagaacccatcatactctgaaaactaacagctaaatatgataaatcaagagtacaagaaaaaaatatgcctcaaagagtactccaaatctcaagatgagatggtggcacagatgaaactttgccaaggaaaaaaaaaaggccattaagttttgcgtaattacactactagatcacttattagaaacaaagcaagtaaatccagcgacagaagagcatccataaacataggttaatccaagaacatactacaactctacaaagccaaattttctctaatccaacacaaatattagtgattaaaacacataatgacactgcgaaatcacaagaataaatatctaaaactcatcactctctctttgctactccaattcaggaaaaagaaagaagagtagaatctaggacaaagttgaattcctatttcgtagtgtaaattcgtaaaccaccaaacctacagatgctatccatctaaaagaaccagattcgctagcaagtttacgtacacaggtattaatgaagttaagaactaataacacgctagattgaagaaaaaaaaactatactacacagtgccgtcccatggttcgcatcaagatcaaatccatggcgcaacctgatgaagccccatttggcagctaccccatgagaccccaattctctccccaaatcacacgaagaacgcaagaaacggacccagaaaaaaggccgcatcttgcgctcgtctaacgagaaaagggggaaaaagagctagctttatgcgttattttttcacctgcagttgggggcgccgccttggccgcggcacggacgacgaacctcgccgccgccggcggggggaccaccacgaccacgtcgtcgtcgtcctcctcctcctcgccgccgcccccctccgcctcgtcgtcgctcatgccacgctcgaactcgcggaagtcggcctcaaagtcctcctccgccgccgccgccttccccttccgcagcatccccggccacagcacgtcggccgtgaccctcctgccctgctgcttcttggccaccgcagccgccgccgccgcagcggccgacggcgggatgaacccggagatgattgctccgccgcacatggccgctaataagctacagatcaagaaaccaagaaagataaatcgagaagaagaacgcagtgaacacttgctgccgctcacgcggagggcgcagtgggagaggaagccgggggtggtgggtggtggccgctacttataaccgcggatgcagctgacgc

SEQ ID NO: 45284 - DNA, 1501 bp, Oryza sativa
attgctttgtttcaggttttatgacatggttctacgaaaatccaagagaacaataacgtgaagtaaaaaaaaatctatgaagcttccatatacacctaagatatgagatactctgtattggacaaccatacaaaattttgcgatgaaacttaaattcatagcatgatattaaaatgacaaacaacaaacaaaaatacagaagccaggattaataatgtactccctcttcaaaaatataagagattttgggtggatgggacacatcctagttccttgtccagattcattatattaggatatgtcacatcatccaaaatctcttatattttggaacggatggagtactaatttatttgtcgtttgtccatgttaagaacaggtacaataatgggcggtagtagttctacgtaggattttgtgatgatttggaggagagctgggaagagagagagagagagagtgagtcggcgactaatttgtcatcgggttgcacgcgccgctcgaggagactgtggggcccgccttgcgctgcctcttctcgtcgccaactcctgcatcgggcatgcctttcgctgcttgcctccgtcgccaactgccgcagccactggaccgccgcccctcagcctcgccggcaccgacgcacgcccgccgctatctcccacatccggcgcacggcccctgtcacccccgcctgcacaatcgccgccgtcttctgcctccgccgtgcgggccagccgccgctgcccccgccgcctgccgcacggcagccaccgtcttccgatgtccgccgcatggtcgccgccgtcttccgcctcagccgcgcgacccggtcgccgctgcccccgtcacccgccgcacagccattgtcgtcttctgcctccgccgcgcggcctggccgccgctgtcttccacctcagttacgcggcccagctgccgccatcttccgcctccgccaccatttcctacgtccgccgccgccgtctttcatcatcgatgacaggaatcgagggaataggagaagaagacatgaactatgaggggatagaagagagagagaatgtgaggtaggagaagatggtgggtcccacgaatcaataaaatatttgtgttatagtatttctattgtattgacattagctatactgcttaagctgtttttttttggagccaacagcgggttatattattgaccttcctctaacatgaatgaaagttgtttgctattttgtgtgtggttgtctaaatcatttctctatatgtgggatcgtttttagaatttttctaatttttaacatggaagtttccaagtttctaatactagtcattaattatctcatttacatatttttaacttataaactgctcatgggtaacttctaaaatatcctggttgctttcttaaaaaaaaatcctggttgcacaattgcacgtcgccctcacatatccttttttatttcttttttgtacatgctcacatcttctcgatgcatcatgtatgtaa

SEQ ID NO: 45285 - DNA, 1501 bp, Oryza sativa
ccgcggtcacgcaccaaattgcggcgccacgcgcccagcacacgcggctacggggaggggacgggaaaaggttgtgccgagtgccgacgcctgtgggggaatatctcgatttgactctcctaaacatataatctaatttatatccttgaagcacaataccgaacatcttaatcttttaactattaaaacatgtataatttaacttacttatcgattttggagagcggcttatgtcattctcactcttcccttttatctctctcctccttatctcccttcggcccctcctatctaactctcctgcactaccagcgccactacctccactgcaccgccagcgccactaccgccactcccccatctgccacttgcgaaggatggcctagatccaggtgcctgtggaggagtcgacgacagacattgccaaatcggggtcatcaagcccgccgagctcttccttggctgttgatctacattgacttttgcgccgacctgctccatcacgtcgcctctcataagtcataactggactagcgcactgccgtcggctgtatcttcatctcctgagctccgcgctattctccgtcctgacgactagccaccgtcttcgccatggggaccccgccactgcccagggagcgttgtctcatcctcggatccacgccatctctcttgaccagccgagcgcaccgtcatcaggctacatctccatccctcaagctccgcgccgttctccatcccaacgaccgctcgccgttttcgtcgtggggtcccctcccctcccaccgtctagggagaaccatctcctcggatccatgcccgggcctccaccctcgtcagctctgttgacacagtgataaaagtggagaaagtgtgtggaatagagaaggagaggaagagagagggggagtatgacaagtgggtccccactttattttttaatttttttttctgatgactagtatgagacgtgaatgccaacgctctcaatactgtcctaggagtaaaattgcaccgttttaaaatagttggaggggttttcaaaatatccggtatcgcggttgagtgacatacgaattgaattttacccataattgaggggcccgacttattcccgcacgtggccgtaatgttggtccgtcagttacactgggcctctctgctgtgtttcggggtcgcgagggccgtcgatggacggcccagtaggccagtgctgaaggcccacacagtttccccgattccccacccgtcacggcgccgtctgcagtaaacggcaaagtcctcccctccgtctccgtgtccgtcgacacgccgccaccgccacgggggttggggatttctttcccctcctccaagccaagccggacgcggacgccaccgccctcgccttcacctccatttatacctccggcgagcgccgcggcggcggcgacgcacgcatccttccttcctcctcccgcaccaccggcgaccggtaaaacggagagacccgtgggcgagc

SEQ ID NO: 45286 - DNA, 1501 bp, Oryza sativa
tcgtttatcagtaatgtaaaacctggtagtagtagcctagcagagtaggttgtgttggtggtcacttgaaaaattgcgattccatgggctgatgcccttacgtgggcccaccacccacccctgacgagtggggcccaccaggcagcgaccccatcacacgtgagaagtccagtccacagctcgctccatcgctgcgatttgcaacacggcgagacggatcaaacgggcgcctgcccccacgaactagacaagcagcaggtcaagcacccaacccaaaatcccagagaaaaacacacaaacaaaaacaacatacaactgcacacaccctgccgatgcagcgaacgtgtccaaataaattaaaaatcccccaatcgatcaatatacgctgcaccacaccacatactcaaaagaaagaaaagaaatccccccaatccccatttccagcgaaatctaatctaatcatctaaaaattcccttcccttcccttccgtccgagccagagcagtagtagtagtagaagtaatgaggaaaagaaaacgaaaagcgccaagaaaacaacgcaccaacacatccacagcagcagcagcagcagcaagcatcatcggctcaggcttcatcaggagaataggttagatgtgagaggaaggaaaaaaatccgaggaaaagtctcgagcccaccccccacatctccactgctgcagctttgcttgctcgagagaaagaaagagagaaagaaaataaaataaaaatctctcacaaatctctctctcgcagccgtcaaaatccaatcttggcgcatccccggccgcctactgttctcgccccccctctctggtaataattgtcaggctggtggttggtttgctgctgctaataatcgagtcttttcctcccaaggagaggcgttcaatttcttggtcaggatttgtggaggtttttcttggattcatttcgtcatctcgtcgcggagccaaagcttttggtttttttttttcctttggttggtcttggctcgatcgggatggatgcggggtgggttgggctcgcgtccaattcgcctccaccaccacaagtacgcttcttttttattgtttccggagtggggattgtagagagctatttcggcaatcgctagggctccgtgtgtgttctctctcgcccactttactctttttttttctatatcattattcccctttgccctccaaatcgaatcctctctcccctcctgcggcgccgcggggagggagcgatctggggagggggaagccgtcgattgactcgattctgtgtcgcgggggctccgattcggcctctgaattgcgccctggtatgtttgccccgcgtcgattcgtgggttcttgccgcggatttggttggatttatttaattttgtgtgatttgttcttgctgttgttgtagggttccatgagggcgtgaggtgaagttggggaagagagagagagagagagagaggggggtagggttgctgcggcggcca

SEQ ID NO: 45287 - DNA, 515 bp, Oryza sativa
cccaaatactcctttggtctcattttaaacgcagccataagtttctgtgtccaactttgatcgtccatcttatctattttttttaaaaaaattaaaaacataaattacagataaaataatattcacgttttatcgtctaataataatgatgatgatgatgattcttttttaaataagatgaacgattaaagttagacacataaactcatggttacgcttacaatgtgacagagggagtagaaggcctcttctatcatcgaagtattcagggaactacaatatgagacattatttggcaccaaaactaatttgataggtatggtagaaagattagcatttcaacttcgtatatgctgtttagtagcattatcttaaaatacatatatatgccgtttaatttttctcttgtagtagaaaaatacaagtattgagtgttagccaggagtttttataaattaacaaagtgttagccggatgtataaacatactaagaagattgtagaactacatatagg

SEQ ID NO: 45288 - DNA, 1501 bp, Oryza sativa
aagttttttagaaagttcacatatatatgcgtaatatttgtgagcaccagcattaatttgaactctggtgggtagagtcatacacccacgactttaccaccacatcactggtgcttcctaagtcggcatgaaatttcttacattcatgtgataaattttgtttgcagatgtggcactgtgttttgctacgactgcggttcatcctttaatccgagaatgtattcatgcaagtgtactcctcgcaaatcttcacaatcggaggaggaagacggattcatcgaccttacttgctcagaccgtccgcttaatctggggaatcattgctagtaatgttctgtagcgagtcggcgatcattcgattcaacctgtttccattactccatttgtatatgcggagttcttgttcttgacggaaacgataatgatatgtcgcgatttctcatcgaccaatatttggaacatttttttttcatctgtatatggcgactagtgagtatgattggacaaagctgaggcgcgttgatattgtcttttgggcgagagaaccggtagaaacttggttaaggacaaggggatgagcccagtagcctgttactctctgttagtacttcagcccacgataggctgagctaacgatttcttacagattgcccacttttgataaaaaaaaaacgaaattttatatatggctccctgcaggttagcgcaggctgcgaatataatgtgtttttttgggtgaatcctaattttattacatggaaaatatgtgtgtgcactattattagcatgcgcatccatataagtgcacgcctttaacacacacttaggttgtttttgttccggcatctaggcttaaggtaatatctcattcttaattagcataattcccgaactgctaaacaatatatttcataaaagaatcatataaaagttactaaaaatcaaataaatttatttttcaaatttatagtaataattaattaattaatcatatgttaattgcttgctccaatttccatctcagatgttcagctcaagaacgaacgcagtcttaattagatacctatagtatatttcttttttatattaaagggtacattaatttctaagcttgttaaatttctaatattgctattggttacttcatccgtcctaaaatataaaaatataagtattttttagaatagtactaagtcaaacatttttaaaattgactgctaataggaaaaaaataaaaaagatcgatcacgtaaatttgatgttactatattttcattgaacaaactatcatagtatgcaatatttttttatttaaaacatcttacttttatagatattattggttaatgtatagcatctcgaagactgtattgaagtcaaaaaatactaatatcttgggaaagatggatttttgaagatgtacatgtacatgcaaaataatttcagcacatttctttagtgatgtcacggaaccttctcaggtcctagctggatctgccaa

SEQ ID NO: 45289 - DNA, 273 bp, Oryza sativa
tgtgggtttttggggccaattcgaattgtatgttttgattgaaataatcaaagagcatttttgggtccccagtccctgtatataggagtcgatgattgcttaagaataattggtgacttgctacgaatgtgggatagtacgaagtacattatttctaacccaattattgtttcgagatatggtagctttaggatggtgaattttgctgctgtcaagtgattgctccattcataacttttcatttgaactgaagcttgttcatgtctgattcaa

SEQ ID NO: 45290 - DNA, 733 bp, Oryza sativa
catgtttgtaaaaaataaaaagatgtaagagtagccaaacatggtaaacatgcaaagcttgcatcttagttgattttgatttcttagaataatgaatattttagaagttgtagaagaatgaaggactatgagaagttaaacaagtatgttgggaagaaattaacatacaaggtggaaagggaattatgttggtgttaatcgatgtctactagtttagaggcagttgccaaaaccatagcgatccacccgccgttttccctttccaactcacttaggaattggcatcacctccaactcttgctgaggccccctaacctcctccaaaacattagcaagtgatgctaaccactacaaacctcatgctagtttctccctttggcaacttgtctttgtcctcccaacgttaattgttatctctaaatattttcctcaccacctcctgaccaatgatcgtagttgttaatcaattattctgcctattgaatcaacatgcaaatgctctctgtgttcgtgaaaaagtagacaattgttgataaatttttagctgattttattttcaaaaaaataaaaaaaatagaagttgaatatgactgaaggagtaggataagttaaaaaagtaggtggatgaggaattaaaataggaggttggaagagaacatttatggggcattaatggatatacactagagaagtttccttataccaaataaatcgtggccgtcggatctcaatc

SEQ ID NO: 45291 - DNA, 504 bp, Oryza sativa
ggctaccttcctagttcatacaatagttgcttactatattattattaccgggttccacatgtcatacacacattacgtcttggagtccgtgctgcagctggctatagatatgtagctcgctgttcttctctctcttcatttatctgtttaaaatatatttatagctgacttatagtctgctattgtacctgctcttagaaactacttagtctgctattgtgggaaatgctagatgacttacatcgtaaaacggagggagtagtatttagaaagtgtatgaatcggagctcgaaaactgcagtagcggaggtggaggataggagtgcggatcatttttcggccctacgcgcggcctcccttccgggacgaatgaacgcgctcgccaacgcccggcgatcgaagcggcggcggttcgatggattataaaactagtatatctctcgcttctctctatcattctccgttgcccggctaatcgctcagcgcggcaactgttcgacggaa

SEQ ID NO: 45292 - DNA, 1501 bp, Oryza sativa
gaaaaccagccaaaaaattacacgccccctaatctgggatggaaggagtaacatattgctaaagctctctgtataattgataaaaatgtgcataaccgttgtttaaccagcggcttataagttgtattctcatgaaaaaataaaatctctagccgatgcttgctaattttcagaaaactagatcaccccacttgcataagctttaatttgttttaattgtgctaacatacaatagaaatattattgatttgttcgatccacacgctactgaaatattttcaatgtactgttgggtcattgtcaatgagctgtagtgctggaatactaagaaaagaacattgtgaagcactataataagtgaattgcttgaacctatttccataaatttaagtttcgatcattcatctctatcataaattaaaatgcatatgacagggaaattcatcgtatagttatccatttcacacatctcattctttttctcacgcgcgcatcaagaaaacggtataataattaattaatctatattaattatggcacgaagagtacttacccttttgatagtggcaagttgtcaaccagttaagcatatgttcagctaagaaacagtgagctcacacggacgtcgtttgacgtcagctctcaaaagatgacgccgctacttggatcggatgttggagacttggagaattttgtcctactcaccccataactgaacatgtgtgtacagatgaacccggccgtttttagcagtgacatgcacacacacgtgcaaagcaaattaaattaacgagtatccttctgccacctagtccctcgagtagtatgtactttatatatatgcatgcatgaacctgattaaaattttcttgtaatttgatttgctgcaaacatttggaaagacatacagacttactggaatttagaaatgacgataggcaaattttagtagagaacactcaaatttcgtggaggataccggtgaacatcataaaaatgtgctacagcttgtggagattatgggtatcccatatctacacggcgacggtatttggattgggtaccggatacttaatgtagatagaatatcttatctgtatctcgggtttgtttcttaacttgtgtatcaaggaaacaccctgagatttagtcggttacgactgtattttacctgtatcttcatattccgttaggaatatagattatcttttgtaatccggactccttcccatatataaggggggtccgggcgcctctaggggcatatgctgattttttcccgaatcacacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 45293 - DNA, 1501 bp, Oryza sativa
  unsure (1)..(1501): unsure at all n locations
aatatttcacttgtaattagcagttttacctaggtaatctgtgactaatgcaatgctgacaccacagttgagctagatcagtggataaagtagatattatctgaacattatttgtgcctaatgtaatgctgacactatagttgagctacaccagcagaactaaattaaaatgataaattctatctgattcctggacaacagtgtatggtttacggagtagtttctttgaattgatcggttgttgtttaccatgtgtttcttgtcttctggtattttttaccatgtttatttggttgttcatttcttgtccgttcttgattttgtatggaagatactgggtgttcttcctggacgccgttggtcatgacgaaggaggagggcagggtaggtagacgtcgcaaatttgtcacaccatggaagaaagcggctcagaaggtcggcgacgncggtgcagaggatcgtgtcgagcgcctcgccgccgcggcttcgtcctcaactgctctctctccaaggttcgtattcgattttttttcgatgatgtattttgtgttcctaaaatgtgttattttcaggaaaactctatagatgctcactattgcgaggttaaatgaattttcacatctaacctcacatagttcagttcatggctactgcttgtgcaaaattcgattaattagagcaaggaaatagcattgtatttctatttacagggagctattgctggttgttctagtttatgcaaacatttagcataagtcttttccttatcttattgcttcataaattggagttcttgttattgtataatttcttgttagatcacatggttgtctgtccagttatgctatacaaccagtactagatgtcttacagaatggatgcttttaccttttctcagaaccttactatgcttttcactcttaacatttgatgcaacttataatccaaaatgtgcattcatgacaacttcgttgcaacaccttttgcagggttacactagatgggtccaatgttggagggaaaaaaggcaaaaaaaggaagtctccctgcgtggcaatgccattctttagaaccccgttgagcagaatgttactgtcccctagcatacggataaggtctccttctatacaacaacgaacatcaccttctgctacaacccatggaatttgtcaaggtcgagagcaaagaacaatggatattgatttaaatttggaaccgggagatacatatgctgccacagatcccggagaggctggatttgatcacagtgctgccacagatgctcaaggcaatggagaggctggattcgatcacagtgctgccacagatgctcaaggcaatggagaggctggatttgatcccttcgattcaaatgctgatgatgatgtcctagtcactctagaggagataggtgttgaccctggccaggagaatgtacagcctcagtttgatcctttcttcgattctgatgttgatgatgctatcctagttcctcaggaga

SEQ ID NO: 45294 - DNA, 1501 bp, Oryza sativa
ttgcgagaccgtagacggtgagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgtatgattgtgtcgcgaagatcgatggggcggcgacgaggcggtgaacgtggccgttctactcggcgctccccacggtagtcgggaggcgagtgcacggaccgctcgtcgtgacccctgctcctgcgattggatcctgcaccggtgatgctgaggcttggatgacggtagtcctgagatcggaagtgggggactcggctgccagtcggcgtgtggacgctttcggagttaactgggaccgaagccgcgatcatggtcttcgtctggttcaagatgttgacgacgtggtcggaacgattgagctcgttttggttgaggagggtgtcgagaagggtgatcgcggcaaccgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgttcctgttcttgtgcttgctgctcctcttccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgtggtagcgagagctaaactcatcgtactccacgatgtcggtggggcgcgagtcgacggtgggagagctgtagtggtcatctagctgatccgtcgaaaccgtgccgagtggttggaggatgacgccgacttccctgaagctaggcgaaatcggtgttgagaccgacttccgcataggcctacgggatgaagacgctgtcgtggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttggaatccaaacgggactgagatccggttctctcccgactggtccgattccaagtcaaggagagaaatcttgccgaaattgtcggtgacgaagtcgaggctgccgaaccgaaacgtctgcccgggtgggaagacgaggtcgtcgatgccggaggaaggacccattgcactgatcggcgaaaagcttgacgctacccctacctggcgcgccaactgtcgaaactagatttcggcaataataaaagggggtggctatcaagctggaaaagtgtatgggtttggagacaaaaga

SEQ ID NO: 45295 - DNA, 1501 bp, Oryza sativa
tacttgacagaccaaaacaaaattgatcggctgaagtggtgtattgaaatgcttgacccaaggagtgtgcctcacaatcttgtcttcaaaccactgtttgatttcattttcatagatgagaagtggttcaacattacgaggaagactgtgcgatattacgcagctccaactgcctcgcgtcgcatcaggacaattcaaaacaaaaacttcatcccaaaaataatgatcttaacagctctcgccagaccaaggtttgactcaaatggaaactgcatctttgatggaaaaattggatgttttccttttgtgacatacacagctgcaaagaggtcaagtgtgaaccgtcctgcagggacaatcgagatgaagcccattgagtcaatcacaaaggaggtaatccgaagcttcatgatagaaaaggtattgccagctgttcgggctaagtggcctcgtgaagacgctggcaaacctatatacatccagcaggataatgctcggcctcatattgcaccggacgacagaatgttttgtgaggccgcgaagcaagacggctttaacatcaaacttgtttgccagccggcaaattccccagatttgaatgtcttggatctgggtttcttcaactccattcagtccatccagtacaaatcagcctcaacaacaacagaagaacttgtagccgccatcgatcgagcatttgaagattatccagtgaggctatcaaacaggattttcttgtctcttcacgcatgcatgagggaagtcatagaagtactcggtgacaactcctatgatcttccacacataaaaaaaggagtgcttgaaaggcaaggtcgccttcctttgcaactaaggtgtgatgctaagtcagtaaataatgctaacaattatctcaggtaaactactttggttatattttattttcatgaaaatcgcttcatgtgcctaactagtttgatgtgtgctaattagtggcattctttttactccttttcaggaccatggcagatacctgatatgaatttgtttgttgctgcagcagggtgcggatatgaaattgctgctaagctaatctgaaattttttggtgttgctgctgttgctgttgctgctgttgttgatatctgaaattgttggtgttactgctgttgctgatatctgaaattgttggtgctgttgttgatctgaacagaatgaattggaggctttcttttttttctctctttttctagaaagtagcccatgtgtgcagtcattctgtgcagaacatgtcctttgatttttgagaaagcaggaggatatatggacctgaatatgtcctttgatttttttattagtatttttatttcacatgaacacattagctaagcttatctaagatcaatggtgtgaactgtcaatggtcctttgatataattacagactagctatctcaatttacaagaaacagcaactgggatggcagcagccactttacaagctctgtgtctgaatactctgtt

SEQ ID NO: 45296 - DNA, 1501 bp, Oryza sativa
cgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgttcctgttcttgtgcttgctgctcctcttccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgtggtagcgagagctaaactcatcgtactccacgatgtcggtggggcgcgagtcgacggtgggagagctgtagtggtcatctagctgatccgtcgaaaccgtgccgagtggttggaggatgacgccgacttccctgaagctaggcgaaatcggtgttgagaccgacttccgcataggcctacgggatgaagacgctgtcgtggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttggaatccaaacgggactgagatccggttctctcccgactggtccgattccaagtcaaggagagaaatcttgccgaaattgtcggtgacgaagtcgaggctgccgaaccgaaacgtctgcccgggtgggaagacgaggtcgtcgatgccggaggaaggacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtgtgattcgggaaaaaatcagcatatgcccctagaggcgcccggaccccccttatatatgggaaggagtccggattacaaaagataatctatattcctaacggaatatgaagatacaggtaaaatacagtcgtaaccgactaaatctcagggtgtttccttgatacacaagttaagaaacaaacccgagatacagataagatattctatctacattaagtatccggtacccaatccaaataccgtcgccgtgtagatatgggatacccataatctccacaagctgtagcacatttttatgatgttcaccggtatcctccacgaaatttgagtgttctctactaaaatttgcctatcgtcatttctaaattccagtaagtctgtatgtctttccaaatgtttgcagcaaatcaaattacaagaaaattttaatcaggttcatgcatgca

SEQ ID NO: 45297 - DNA, 832 bp, Oryza sativa
cattcatattcctcagtcctgatgcacatggagtataatgaatatatatcacattcttatagcctttgtgtgtccgtcatgtttagcaaggcacgctcagtctacttgcatgtatgttctcgtttgtgagcaactttaacattcgtaccgtcggttgtacatttgtacgagacaacagacaagtattcgatacgagctaagttcattatttcagtcacctttcttgtcaaccaaagcctaaagtccatgtatgctcattaaggtgcagtgggttgatgattaaataaaaatatggtacatgtcaatttgtgttacaatgtaaaatagtcctatacgatcggcagctttaagtctgtaaatttagaaacaaagagtatatccaacggtaatttctaaaacaatggtgtgaaagcgtcccatacttttttctctagcctaaacaaataacttttgttgcctatacaggcacgtccattctccttgacttacaaccattattagaaattaattaatgtgtttgaacacgcctttgtcactatattttccaagttcacattataacacaattttgagatataaacgcaactatacaagaattataacttatatggcatttggccgcatttaatgcatgcaacggatttatccagaatttcatccaaatgggataaaaaaaagaattatctgctattagcaatgtgaatccgttccaatttccatgctacatatacctcctgtaaccctcaatagcatgtaccacaaaaacactactatctacacttctcgctacttctgctcactagttacatcctactacgtgattacctagcaa

SEQ ID NO: 45298 - DNA, 345 bp, Oryza sativa
ggattatatatatttttttcaactggatataatataataaagatcaacgctttttaaaaaattttagaggaaacaatagctggctagaatattgtactgtgtcctactccggtgctttctactcggagtagaaagtaatctaggcccttgatcatatttaattataggattaagatctagttctactcctatcagaattagtggaagtagaaatgtggaggggtgtttttgtccaggaaaaataattcgcgaaggggtattattggtttccgatccatagatcgatcagcatgtcatcctcatcggagttggtcgtgcaagatcttaatcgatccatgtaatcca

SEQ ID NO: 45299 - DNA, 282 bp, Oryza sativa
ctctcttgtatatatatatgggtatgggtatcctaacactacccataccccttctccctcactcaatctcccatttcccctctaattctacttacttaagctagctaataattagcccaagaaaaatcccctctctcctcctctcctctcacttataagagaaaatcattttgggatctgaaaaacaaagatagatatgcaagatagctagctagcaagctatagtcaagttttgcttgatttctactcgatcgattcgatctctagctaggtgaaggatca

SEQ ID NO: 45300 - DNA, 179 bp, Oryza sativa
aaatattgttaattaacaacaaattaattaaagatgttatctaaccatgctcgtgtgttgtttacgtctttgtgcatctagggagaaaacgaaatcgtctctccgtggacatgtataagtaatgatcattggtaatatgtctgaaagaaacatttctacgcatcagattttcttatttt

SEQ ID NO: 45301 - DNA, 1501 bp, Oryza sativa
acccaccatccctctccctggacaacgacttgaggatgttcttcaccgttgccagagttagcctagatatgcccctatgcatctaccagatctacatgtgaaggggcatgaggaagcagataactaaggtgacgttgcatcctttcgccatagctcgaggtctagcatgatgataaagtcactattctagggatcagagttggcggcatgttctttaatttgggggggagaatggtgtccactaggttgatcatgaggactgctcttgacatgtggtcatcgtcgtgcccatcagttactctctagcgagaagttgagcagcttctttgatgttgtgtgcattatgtcttcgccgcacggttcaggcaaatggctggtcacccaagcatcatgatgctcatgcagcagcgcgtgcaccatgcctgttagtatttgatacagttacagataaaatccgcaagcgcatggatataccgatgtagcacttcccctacggagtattccaagggtatcgaatccaagggaacgtgtgtgatgagaggttcctctggttcatccaaggacaccaagcaaatgatagtccaggatagagaggattcactagtgagaaacagtgtctagggaatgcttaattttaatcctaacgcaatacttcaggcactggcaacccgctgttcccagatgtcgctctactacgtacccggacagggaggacttcattgatctcgagggctgtcaccacctctacacccacctcaacgtactgtgggatacgcaacaattactggataacaattacctaaacaccacgtcaaagcaattactatctactttggtgtttataactcaccaaagcaatcactatattttagttgattatagtgaacaataatcccgtatgctaattaggaactaaccaagaggtaattctcgcaagataaatctaattactcaagaagaatattatattgaattcagagtaataaatagattaaaagaaataggagaagattaccgacaactccggaattcttccgactccttctactctactctcttcctattctattatacaatatagtacaatagagcctcttataattcagctcaaccttggaagtgtgtgtgtgaagtgagggagtgaagcctttatatagaggtaggtatgacggttggcgaagaggaaatgtccgaagtgccctccaaccgccatcagggatgcatctggaacgtccacgccaaaccccacatccaatggtggagatagtggttccgccgaacctggtggtttggccgaacttgggctaggtccattgtcacgcccagaaattctcgaaccagaatttctaagctgaatgtgcattaaatccctgtccaggaccagccagggtacacaaacgacaattgttgacatacagatccacgtcttacagaaatagaaaagattacaaatgcagcggaaaagataaaagcgagctaaaccgggaagcttgacttcagc

SEQ ID NO: 45302 - DNA, 645 bp, Oryza sativa
aaaacacaggaaaaacacagtaatagttgtttgattggagcacaggaaaaacacaggaatcggatgagagagatagactcaaagggaattttccaagaggttagagctcttgctatatttcctccaaaatccacatacaatgtgccattctataggaatttcataggatttggaaaacttcaatcctttgaatcaaagggctaagtaggaaaatttcgtgtaggatttgaatcctatgaaattcctagataaatcctttgattcaaaggggcccttacacttacattcttatcaaaatcctacgtttttcctattcctacgttttcttaatcctgcgattcaaaggggcccttagataggattcaatcatttgcttcaaagggtttcataggaaattttcctataggattgaaatcctctaaaattcctatgtttttcctccaaatcaaaggggccctacattctatcaaaatcttaagtttttcctattcctacgttttctcaatcccgcgattcaaaggggcccttagtacattacctcatatgcccgatacaacattagtggaaaatttcttgaattatatacccataactaaaggagaaatttaggattacaccatcatcaaaagtggcttcgtggccaaa

SEQ ID NO: 45303 - DNA, 1385 bp, Oryza sativa
  unsure (1)..(1385): unsure at all n locations
cgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactaccgtttttaaatgctagctttatgcaaaagaacctctagcctcctttggttacatcctgcatcatacctcctcttccggtatgacttgctgagtacagtgggtagtactcagtcttgctctcttttcccccacaccagagctgaagatcttcctagttggagctgttttgtcaagttggtttcgtcgctgccgtcaaggattgcctgtggagtggagccgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagaaccgaccttgaccgtaggacaagccaactggaaacctaagagccctctgaacccctttttcatctgcatatgcctttttgcacctggaattgtttcgggaaaatttggagttttgcctctttggtttgcgggaaaaatcttggtcgttctttcggatcggatttttttttaaaaaaaaaaatattagctcagtctaggcctttaaanaatttttagtggagtttattcgacagtcagtcggaatttattgggggttatgcattaggtcgtgtctatattcgatgggggcaatgttatgcgcatcgttttccatgcaactagtctatgcattaatttattgtttagttgcattagtgtctttatttgagttcatgaaaaatgttctatgcataaaaatcatcatgctcggttatttatgtgagttttgttttgctttgtttaatttgggtttgagcatggattggttcctatcccttgtctactttagatgtcagtcttatccctcgtttgcaagcgccgcctcgagcttcagagtcgccgcccttagctttatcgtcttcttagtctggttgcttgctagttttcgtgtttaggtttgttgcttgtgggctagtcggcggccgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 45304 - DNA, 293 bp, Oryza sativa
gacatgggattgattaggctaaatcctatagatttttcatgaattatggaccacatctgaatagaaatgtgtaaaattccgactaaaatccgccaaattctttcattgtaattgggagctttcttttaaaaggatatgaggcggagtgattgctaaatgggcatacccagtacaatttttctgggtccgccactggaagggacatcatggcatcgccttcaaagaaggtttgtagtggtcacagatggcatgtttggaagaatcacttgtttttgctaacctgaaaaaccaga

SEQ ID NO: 45305 - DNA, 919 bp, Oryza sativa
aagacgggatctgtatgtcaacaattgtcgtttgtgtaccctggctggtcctggacagggatttaatgcacattcagcttagaaattttggttcgagaatttctgggcgtgacaagttggtatcagagccgaccttgaccgtaggacaagccaactggaaacctaagagcctctgaacccctttttcatctgcatatgcctttttgcacctggaattgtttcgggaaaatttggagttttgcctctttggtttgcgggaaaaatcttggtcgttctttcggatcggattttttttttttaaaaaaaaaaaatattagctcagtctagggctttagaaaaattttagttggagtttattcgacagtcagtcgggaatttattgggggttatgcattaggtcgtgtctatattcgatgggggcaatgttatgcgcatcgttttccatgcaactagtctatgcattaatttattgtttagttgcattagtgtctttatttgagttcatgaaaaatgttctatgcataaaaatcatcatgctcggttatttatttgagttttcttttgctttgtttaatttgggtttgagcatgaattggttcctatcccttgtctactttagatgtcagtcctatccctcgtttgcaaagcgccgcctcgagcttcagagtcgccgcccttagctttatcgtcttcttagtctggttgcttgctagttttcgtgtttaggtttgttgcttgtgggctagtcggcggccgatatcatgtgtcagtggtatgactgcctcaattaggagttgcgtgcctctttttcagtgttttaatcaagattaagataattgcacttaaattcataagcaagattagtttctgagcccctgtttttcttccttttctcatatttctacctatccccttcaga

SEQ ID NO: 45306 - DNA, 1501 bp, Oryza sativa
atgagtgaatctgcgagttaaattttaactcatggtgacgtggacgaatctcggacgtctatttttcgattcaacggtagtttccactgtatatatggtttgcactacatattttcccccgtttcaatgagtagaaatggataggcaacttttctttttcaaaaaaaaaagattttctagagaaaatgagctaagcaatcgacattgcggttcattccaaggtttcttcgagaaaatgggtcgaacccttaacattttgattcgttgtatgtagggttgactatgcttcatcttttgtcttctatagttttagcaatacctaaattctgatacttttggctatatcactgggaatggatctagcctaaagaatgggaatttttttaactaacaactatttatctggggaattttctattttttatgcgagagtatgcagtatgcactgcacacgaagtgagggagggaaggggaagatgaatgactacacttttaagtaataaaaagagaaattagtcaacatagttgacatcattagtatccttaaggaggttgggataaaggtagcctaggcatgagtgacaaaggtggcaagacaataatggtaaggctattaaaacctctatgcacgttagtgacaataagggttgtaaggtctaaatgatcatgaggcattcgagacaaaagtgacagagggaaagaggaaaaagaaacaaagtataaatgtatcaggagacgacaagcaaccgaggagcagaagcacacggtgtgcccacatggaaatatttgagaagaaaaaaataactatgactatgatagaatggttaagggcgaaaccactggagaatagagggtagaggaacacatgtgaggtggtggttagactacccgtagaaagatcttgggcggtgggccagtggctcatgtgctcaataatttcttgtctagatctcggggcgaatgtaggaagatattcattaagacggaacaaatgtgaacaatcgggataagagtaaaatttaaccaacgacttaaaaaaggctaaaatattagggaattatatgcgggaaatgaaataagcaaagtgattttattttgaaagaaagaaaatgcataagtaggaatcaggaaaaaaaataacgcctttctcattcagtgcttacgtggcaccagtataagcaagccacgtggagtaccgaacagggcaccacattccacatagatagcctgagtgccacgctaagtatacaccgtgtatacctggatgatacgcacgtgttttgttggggatgggtctaattttgctctgcgacgtggagaactggagatactcagctatctcgtgatttaagctcgccgtcgtctcgtcgaacaacatcttgaggatgttgcgcaattttgagcaaaagaaacagagttcttcttctacttcttctagtttggtgcacgtggccatttgacgattgggtgtaaatgtgtaatcggtaatcctgcccaaaga

SEQ ID NO: 45307 - DNA, 347 bp, Oryza sativa
tgaaagatactaaaagataactaaatttccgctaaaaaatatataatatatatgtgcttatatagacatgactagcaaggaagcttatatgttctgcatataaatgtaatcattttggttgaaaaaataatatcgttgtgactgcacagccaaatcattcgacgtatagcagtggcggcaacatgaggaaacctatcgaactagctagctagctagccatatatttttttttggtaacttgccaaaaagtttgcctaacaatttcaaagccactagtggatggagctgaggaaaaaaatattggctggaacaagggtgaaaaactacttcaatagcggtgccctcca

SEQ ID NO: 45308 - DNA, 179 bp, Oryza sativa
tcggacgtccatttctcgatccaacggtagtttccaagttttcactacatatgtggtttgcactacatatttttccttgaaacggcttacataaagttcttaaaacccagaaaatcacatgatgtacagtgatgatacacaatggttctcaactttttctttttctgttccaaactagg

SEQ ID NO: 45309 - DNA, 1501 bp, Oryza sativa
ggtaactttggcatgccatttgaagtaaatccgttgtagagataaaaacatgactctatctagaaattaaattaatcagcacaaattatggaattaactaaaaacaataataaaagtaatcacctcagagcattataaatgtataggaagtattttaatcaaatctaaaagtaacttatatatatatgataatttgttcaatgaaaaaatgtattaattaaagttactttttttataagttacttcatatgtaaattacttttaagctttactgaatttacttttgtatttctaagaagtaacttagtgaaatctaaaaataatttagacatatcataaaagtaatttgtgatttttcatcaaaatataatcatgtgagatcttgttgtaaagatttaattattacgaacacaacggtgtaatcggatcgtagattggatgagtagtttaagagaaaattgtatttgaagtataggtggatagtatctcttatagatgaagtggtagatgatttagacaaaccagctaccactagctgtgtagtcacgtccattaatatgggatagattactttataaatatgtaaggctaaatttgatgaggcattgatgtgtaatgttccgtaaaaaggaaaaaatcaacttctaaggatcagaagctaatctttttaggatggagggtgtatatctaaggcttagagaatgttggaaacttcgaattaaagggaaataaatgaaacgtttaatttcaggttgttaggttttaaacaagttaaatacagaaagtctatttgtctcttgagggcacatatctcgttttttcatgtttttaaaattcactaaaaaaataacaagatatatcaatgcggtgcatcactccacaaacatatataaggcgggactctataactggacttttgtatgtataactgggcgccttataaatggactgtataactggacttttgactttgagctgaaattgtaactggggtttggattggaagtgattcggccatttagtcgcccaagtatttgacttagggtttctttgcgaccacttgaataaattgacgacgatatgatgggatttttagaagcgacgcttgggcatgcaaatccatcggacgcggtagtgtttcaaaggtagggacaatatcgactatgggtttaggagcggtttatggcatacaaatccattcgtcatggtggggttcaaaggtagaaatagaattgagaatatacgggtcgacgcacgacaattagatctgccgagcaactttagtggtttcaagcgaaagaccgaactcggggatttcgagtagagggaaaataggaaagaagggaatctgagggaggctgagtcgaaaagatgaagcgggttttgattcgatcgcaaggttccaagggttcggggaaagaaatggtattgtggcaaatgaaagaattttgggacttcgatcagtttaacatcgaagtgcttgacaagacaaacgggggaa

SEQ ID NO: 45310 - DNA, 350 bp, Oryza sativa
atttccgattgttggatctagcaatgcccatcctgcacagctagatccaacgatcgaaaatgttttggtattgcgaggtaccggtacctcaaggtactttttgttgaaccggagcaaacctcaggaaagaatgggtagtagaggagatgaaaaaaagggggtaatttggtcaaaattaatggtcatagaagcataaatatcattttttacaagcagtttgctatttcacttgtgagagattttttactcctatctttcaatttttcgttagtaggattttgcataaaaatttgtattcatgtagattcagtttgtacttacacttggttatagagcaccaaaattaaatt

SEQ ID NO: 45311 - DNA, 1001 bp, Oryza sativa
ccatcaggagggggataggtagaaataagagaaaggaagaaaacagatggctcggaaactaatctttcttataaatttaagtgcatttatctgacttgaattaaaacactgaaaaggtagcaaacaactcctaattaaggcagtcataccactgacacatgatattgaccatcgactaacccacaagcacaaacctaaacacagaaactagcaagcaaacaaaactaagaaaatgataaggctaaaggtggcgactctgaagcttggagcggcgcttgcgatcgcagaataggtctgacatctaaagtagacaagggataggaaccaatacatgctcaaatccaaattaaacaaagcaacaaatgactcaagtaactcgccgagcatgatgatttttgtgcatggaacatttttcatgaacccagacaaaagatactaatgtaactgactaaacgataaattaatgcacaaaaatacatgaatagctataatgatacgcataaaatgtccccatcgaacctagacacggcttagtgcatatcacccaacaattcccgaccgactatcgaataaattccgaataaacttttactaaaaccctagactgtccctagtcgagaaatccaattaaataagtgaccaagattttcccacaaatgaaaagaacaaaccccaaaattttcccgaaacaaattcaagtgcaaagagcatatgcagatgaaaaggtttcagagggctctttgggttttccagttggcttgtcctacggacaaggtcggctctaataccaacttgtcacgcccagaaatacacgaaccagaatttctaagctgaatgtgcattaaacccctgtccaggaccagccagggtacacacacgacaattgttgacatacagattcacgtcttacaaaacaatataaaagattacaaatgcagcgggaaagataaaagcgaactaagcctgaagacttgactcctgcagcgggtgattccattcca

SEQ ID NO: 45312 - DNA, 1501 bp, Oryza sativa
cagaattcagactcgtttgggctggtcgttagctattctattatggatttatgggttttttttcgtgaacgcgcaaaaggatcacacgttaatatattagaagaaaaaaaagactgctatggttaaaatagcgaaaaagaaatgctgctccaatattgaaggagatcggtgacggaggaaccacactatattcccaacaggactcgaaaaacaattcccaacaggcctcgaaaaacagcggcaccgccaacgaccacggacgacctttctgtaggatggagtccaaagcaactgaaaccgaagagagagtaatcgaaaaccctggagttccgctccttgtacaactaccaagataccaggaggattaggatgaaaacggtaggaaaaaccctctaccattttcattttcatttttttctcgaaaacggaatcagaacggtataccataaacggtaaccatatagataatatcggtatattggaaacgggaccgtcggaaaggaatctaccgatattggtcggaagtcaaaaattcatatcggaaacaatgaagtgtagcatagtcatacattcaactacgcatgaacatgactttataagatcattcttgcatcatcgcacttcaatcgttattacttttttcctcaggcattcatggagtaatcatgtggagatgaaatgagaggaatttcttaacttttggacgaatcaaatttctgtgatcctttggctttttttatagaacaatgtgtatgtacttagtgtttgatgtcaaccctgattgtcatgatgatggatcaaaggttgtgaagttaaattgagtagtcaaatgttgtggacagcatgcactaattgctcgtttaaaagtttatcatgttttctagtagatcattagtttgtcatgttttatgatcattgtaactattttacttattaccaactgaattttacagtaattttcagtcctttattttttttcagaattttcgggatgttcctaggtagtttttagaattttactcattttcaaattttggattttatttgcactcctttttaaaaactccacaagatgaaggggatgggattcaacttcaaatggcaaatgggattgaaccctggagtggaagggcagaggggattgggtggacgagcctaaaaagacagatatcaaaaggctgactgaccaaaagaaagggtgtaatttttacgacgaatatttagataagacgaaaataatgggtaccaataagcttgcacctaacgtgtagaaaattcacaccccggatagccggccgacgctggcaaacgtcaacttacccatacccatcgatcgattcgattcctttttatattaattaatatctgtcgctcctcctcgcaaagctaatatctgtcgtagctagctagctagtggaggtttgtgtttggtggagcaatggcggctcggggtggacgacgacgacgaccgtggtggtggtcgtcctcctgccgctgctct

SEQ ID NO: 45313 - DNA, 1501 bp, Oryza sativa
tcgagaattacaagatatgtccatattggacacgactcttatctctaacaaactctaagataccataagtctttgcggcagacttttgcccatatttatctctaaggaatttacataaaatatcctaattaatagatacaattgccttcccaggactctatccttgtgtggcaattatcttgaagcacatcaactcaacccaatgtcgtacacgggtcgtattgctggaatcggctgtatcacttaaccagtccaactcaggctgagccgatctcagtcgtagccgatccggactccagccgatccttactctgtttctgcaacaatcctcatcttcgattccgcttcgatcccatctttatctccgatactgatattaccaaatttggtcgttaacaatctggtacaacatagtctgcatcacatagtcttacgatacgtattattacatgggaagcccgagtgggtcccaaatagaccaagtctagtccgatacaatatgaaaactaaaggacgtgatatggtagcgaaagcgaagctgcgacggtccaactatactccacaggtatcgactggggatcagttcataaggcatctcctcgggttctccctcctcgggaatgttctcatgtggtatctccacatcgactaagtctaaaagagtgtaaaatttgcaagggtgagtaccaaccatactcagcacgtcaccactatggtaacgcatataataattataggggcacattgttggcttggtctggttgcataaacgtatgacctagcagttttgaataaaaacaaagttgtgttgaattatcattaaacatcgagggcttaccaatgtggcccaagtctcgcttggtacgtgttaccctcgcatccaaattgtccatatttccaaaatcataatgatctctccacccatcgggcaagatctcacacacgtcctttcctaatctaagcaatattaaagatctatgagtctagtcaagaatactacaattcccggtgctcattaactgctagcacgactattcgaatagattagtttactcacactgcagtggaatatgctttcaatctcgcactccgtaacgcacccaacacatgggctttgtcacagcccggcttttcagtcactctcgcattgcgactcctgctagaaggactacgaacctccattgcacccaagcacaccaaccctacctcgagccagcagcgaggggagtcctggcgctcctgagatcagaggttacataatatatatacttatagggtggattttaggtttagacgtcattatccaaatcacaacactgcaacatcacaaccacaacatccacaattgttgaagccattcgacaacaaatccttgaagacaaagccaaacttgatgaactgcttgctggtccaagatcaacccaacagaagattcaagaacttgaacaaaaagaagatgacctcctagctcagctggaacaaactcagcaagatatgatag

SEQ ID NO: 45314 - DNA, 805 bp, Oryza sativa
gggcccctcttcccgtggacccggtccgggcgcccgcccctcggctgacgcaataatccgatttttttaattgaaaattaaatgaagaaattcgcaaatatccatttaaagagcatataaacttcaaatggccatatcttggccgtttgaactcggaattggaccgttcaagtctctaatttttccttaagaagtaaagaacccatttttgtgctttgtttatgctgttatttggagtttattagagtaaaagccttttcttttccgtcggtcgtgtagacgctgcagcttcggaagatccgctcttcgtggaagttgaagccggtgtttgggaaagcgagcaaggcaagtcacatcatccttgagcatattgaatcccagtttgtaaaattatgttgatttaaattattgcattatcgctttatttaaattcccgcgttatcactgttttatttagccatgcctatttacctttgttacgaccatattattattgttattgttattattattaccttgttcaccctagattaaacaaaaccccatctagtggacactctatttatggttccactagtttaaatttaggtagatgcttcgcaatttaattaggcaacattaggtggttttataattttagactttgggagttctcatatcttttggacaccatggaatggttggattatggtggaattggacatacacctctctttctctttcaaaacccctaaaacctgttttcggtggggtttgggtgcatgccagttatgggaagtagcaccccggccactataaggattaa

SEQ ID NO: 45315 - DNA, 1501 bp, Oryza sativa
gcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagaatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaaattgaattatgacgcaataatgaattatttttgaaaaggaaaaggggatttattgcgtcagcggctagggtttgggtggaccgggcgcatgggcggcggttcacgcgaacggacggccgagattgatccgatccaaatcggacggccgaga

SEQ ID NO: 45316 - DNA, 225 bp, Oryza sativa
cataggctggcggtggatgcataggaggatgactactggactgttgtttggttggcaagcaagcatttggtctgtcatgtgttatgttcctcaacgatgtcaatttcaaagttttaatgcacaaattcaaacttaagtgactgaactgtcgtgttcctttcggaggttttaaacttgtcatcacttttaaaccccaatgtcaagttgatcgtttccgtgtgcaga

SEQ ID NO: 45317 - DNA, 290 bp, Oryza sativa
tgatgaggcggggggacacggaggtggagtaaagtaataatacgttttttaaagggtttctttgcaaatttccgcggacattttccgggtccacgagccaaaccggatattctgatctcaataccgacccatgtttttggtgggccttaggaaagcctgtctctagcgagcccaactttagtgggcctaaatacggttagggaggatgtgcggcccatgaaggctcggcccattatactgcaactaggccaatacgtagccattcagagtttcggacctgtggctatcgc

SEQ ID NO: 45318 - DNA, 1501 bp, Oryza sativa
acattgattcgctgactgaacaactcattacctgctagactataaaacatttagttctcaatttcaagctacaagatgatttaaaacacaatcccctgaagaaaaaaatgtgatcaattgtacagggcaaataacatgatggtagcatgctcaagtgactaagtgagctagattatggtgacacaagcacaagaagaagaagaaaggcaaagtaggctatgtgacatgaatgaatccagagctaacctctatcggaatagtactaacactggaactggaatggcttaaggctgtgcagaagaattgagcacacatctgcttaaatagatgccaagatatttttccctaaggagtaaagacaacttgatctgtatactactatatccttctccatgattatccagaaacagactaactatgtcatcaggaggcactaattattttgtttcctgacgaactaacttacaaacctagtgtgtccttgatgccattaaggattgcaaaacaccagaatgtagtgggatataaaaacatgagccaattgcgactatggacctatggtcggctctaagaaattcatccatgcacacaaccagacatggacgatcatttcgggctgacgagatgccaagaccctgtgcatgcaagctgctaggtcctccatgtacttgttctttgtactactagaacgacaaatttctgacatgtcgcctctgatttttatctgaaagaaataaatctatctatcaattagtatattataaagatagctcgaaaaggacacaccatgttctcgttatagagacctagaaattatcattaagtgaagagacaaaatctaaccattagaatgtggttggatcaaattataacgatgtagattaatataaatagttgtatacaaaataaattatatttatgatatatatataatataaatataagaaagagttgtatattaaatccaaccctattttaaatattttactgtatgcaaaatataattgcacatatgagaatttagagaatttatctatggaaataggacctaagagttgtattccaaatgcaaatccaatttaactagtccgtgtaaaaattgcacgggaaaatcccctatatgaaagtatgaaacattaatgtcaatgacaaggagaacaatttgccaagattccaattacaagttgattagttcccacgtaattcagatgaagtataactcataactgatagcaactgaggaagcagtgacagttaataaggtgaagaaatgactttactgccacaagcagccaggcagctacatacatttgttaatggttaataagtctcaaccatggataacattagagacatcatgaacagagacaaggctcacaatatgcaatagcttattagagaaatcatgaagccaagaagccctggactattgcctgttgttagtcctcatccaatcccaagccattgacggccatgcatagtttttcatctgttctttttt

SEQ ID NO: 45319 - DNA, 290 bp, Oryza sativa
tttaggatctacatacgtgcatatttaagatcagatgatgtatgttgatgggatgagatgtccactttatagatgcttgcgcactactagtctataatacataggggcacctccacttttaagtgaacaacacctgatatttcttttaaaagtggaggtaccttcaaaaccttccaagcactgtaaaatgtctcttgggggataagatcatagatttattgccgtcacattgcgactgtgaaatctattattaagtgcaattggcaccttccatgcaacaatagcacata

SEQ ID NO: 45320 - DNA, 896 bp, Oryza sativa
agatttaacgtggaaaaccctcccaaaacagagagaaaaaaccacgggctccagccagcaaaatatcttcgctatatctggggtgaggttacaacgctacacggcggcttacaagaagtatatatatggtggaaccctaaaggggatgacgatccgtttcgtgggggctccgccccgcacccccgagcgtccccaggtgcacggcccttcgctctactacggtagaagctgtcctttattaagtgtaaatgaatttgaatcacaactcaacatgtttgtgtgttgaatttgtttattcgaagtgttttcttttaaggtgacacaactctcgatcgatggtaagaagaaaaataggtgtttaattgacgtcgaggtttgggttagggtagggatcttggtttcgtctcgtcttccaagcctacaagctgcgtagagtagtaattacccgcgactatacgaggttagcagaggtacgttgccacctatgagaaatgtgcaagtcctctcatccgaagaaaactaagtgagtgagagtgtgagaccaacaaaatattctaagactcgatgtgtggtcatgtcgtttgggccatttactccctctgttttatattataagtcgttttgatacgttgtgcaagtcctctcatccgaagaaaaaaaccaagcgagtttaaccaactaaatattctaagactcggtgtgtggtcatgtcgtttggaccatcaatattttgtactccctttgtttccctttgcttcgtattataattcgttttgactttttccctaatcaaactttattgagtttgaccaagtttgtataaaaaaaatataaacattaattaaaacaacagattagttttattaaatctacatttagtatattttgataataag

SEQ ID NO: 45321 - DNA, 1501 bp, Oryza sativa
cggcgctggcgctcatgcgagggggcaatcgaggcggagctgcaccatcctgctacggcgccagcataatgatgataggaagcggcgctgaggaggccatgggcggcaagcttcgtggctggtgagttgggaggaggaggaggaaggagagcctggagtagggcgcaacatcctcctcgcccgccgtttcgttccacttttgcatggtcgatggaagaggagccggaggcggcaacgttggcggaggggtcgacgccgccttggcgagcagtaggtgcgccagcctgcccgcgtcaggatgtcaccgccgttcccatcacagccggcctcgacgcctatagagctccctcgccaagctctgtcccgccgctgccctccctctctctctctcaccacccctccatttctccccacagatccccaatcctaccccaccccaatcgacaatggcgtcatcggcggctcacatctaggccaacaccacactgctgtctctgtcgccggtggctcacaggaggggatgagccaaccggaggaagatgataaggcggcaacgtacgtagcaggtgggcttgtcggtggatttggtcggcggaggcgaaggtgccggcttcgcatgcgtcaggcgggcaaacgggtaggtcccatgtcgctgccgccactccggcccccacctgccgccgtcgctggcggcccccgcttgccgaagggggagagagagggaggaggaagaagggatagattgatatgtgggccccacatgtcagtggtcccatatatttttcttttgtgtgaatgacgaacgggtctcacgtgtatgttttcaattttaatgccacctgtgcgccatgtcaacggcatactaagtcaacactgccatatggatgccacgtcagcggaacggctctccaaaaccaccgagagaatcaaattacactgatattaacgtttaagagtcaagatatctggtttgtcgttcagggctacggattagattcgggtcacttttaagggagtcaaaatgaacttatccctgcagcccgcctagggatcagatcgctgtacggttcgccaggcccaaccaagcccacggtcgcccgcaaccacccttcccgacgcacgtgcttagaataaagacgcagatgcccaccacggcggcgtcgaatgatgcgggccccactgacagcctgacccgccgtttgctccgcagtccgcacgaagcacgacgcgacgacacggatcatcccctctccctctcacctcacccgcgcccacgcccagccaaagaaaaaaaagaaagaaaaaaaagaaaaagctcatttctttatttttagagagaaaagaaaagaaaaagcgagtccaggtccagggcgaagaggaggacgccacgagatctgcagcgagagagagccagcgaagcgcgactccgttttaaccgccttcgccgccgccgccgcgatatcgatcccctccctctcgccgtcgacgccgtcggcatcca

SEQ ID NO: 45322 - DNA, 1501 bp, Oryza sativa
aatatggattgtatataaatcagattgaccatctttagagattagatgtgtttatatcatagccgatagaacaatacttagatagacactaaagtggaggagaatcaacatcaactcagacgataaatcaattagacgatgtcgagaaccagacttgtgtatgaatgggccaagaactcagaattgacacgatgaattgggccaaaattcacaagtctgcggagaagaataacggagaaggccgccaaccgaaattgggctggattgggccggccccaggttcggtggccgaacctccctcgccttcgttgaatccaggttttggctggacggttgagatgaaaccccaatgacggttggagggtacgtattaccgaccattccaaccgtcacaaccgtcatagttcagttataaaaggacttcaccttctcacttcactcacactcctcaagcaatagctctctcatttctctcaagtttagtttagtagtatctagctagtggaataggaatagagtagaaatcaggagtccggaagccttcggaagagctcgggtatggctctagtagctttcctttcctcttttgtaagctttgtacttttattagaatactcttctaaatatatttatggtattgaaatactttctgagtatatgagtacctaatttacattatgttcatgttatattgaatatacggctagcttatctgggagatgctttggtgcgggtataatgtttgcttatgcaattgctctatgtcatgacaatgatattagagtagtatatggtagtttaggcatagtgtttagattatgggatatcattatttggggttatatattgcggatgagaggtggaccactgatggtgacagctcagtacgggtattcctccgcgccgatatataatcctatgttaattccctggggagggtattcctccgtatttagccccggttgtatggtcatgatgggctgtcgtaaggaactcggcagttaggagtggcttctcgaagtaccaggagggcatcggatagggggtattagctagtatatcagttaactagaatgtatgtatactatgtatattagaagtataggaatagattttctctcttttctttccacttagcttagatgatttattatgagaatgagtagtaatgcttgtgtgtcactctactcttggattatcttaacccttgcttagaatatgattatcataaataatatataacttattagttgagttctctctacatgatcttcccacggaataaaataaatacgatacccttggaatactcttgggtgagatgctacaatggtatatccgtgcgcttgcggatgaactctgtaaccgtaatataccaggagtatttctgcgccattgctgggaattatatttttagtaatgacgttaagaaataccaacagcgcgcgcagggtggagcagcgtggcggccccgcgggtgcacgcacagggaggcgcggcg

SEQ ID NO: 45323 - DNA, 1501 bp, Oryza sativa
aatacatcacaaatgtttttgctagtattccctccgtcctaaaaaaacttatttttcgctttatgtatcccacgtttgatcgtccatcttatttgaaaaacttatgaaaaaatccaaaaaatttagtcacgtataaaatattattcatgctttatcgtataataacaataaaaacactgatcattgaaattttttaaataagacgaagagtcaaacgttataaccaaataccgacaaatggagtctctgggaaacaaaggaagtatagtagtcaaggccagagtcagcctaacagtagatactctgccgctgatagtcactcaataataaactactcccatcgtctcgtataataagtttatttttaagtcccttttgtctcaaaatatgtttatttttagaataattattgcatagaagtttgtaaaattaaagcaacaatgaaattgagagtagttaaagtgaacaatagttgcattgggatttgataaagtttgagtattttagtatttttatttttgtattgatatatgtgagatgagcgaaaaataaatttatttttgaggcggagtgagtaatcggtgtatcctcggccaaaaagagatatccctttcgcgctcatcttatccctctggtttgacatcagatcatagtgacaaccccctcaaacacttcgcatggtagtttgacatcaaatcacttcgcatggtagaaaactttgcagacgtgtacataaacactgcgatagtgcgatcaatataaatgaccgtcacacagcagagaaactaaacgcggtcaaggccggacggcgattgcaccagtcactcactactcgatctgtgagccgcggtcgccgatgcagagacctccgaatcgatggcgacccagctggtgcgtccccgtccccgtttggttcgggcccggattggagctgatatggccgaagatttttgactacgctgccactgccatgctgccgtgcgctcgcttgtgtgctgcgccttccaacccccttgtattttgtcccattagtactagtccaactttgacagttgaaaccgaggtgcctattgccctatccggtcaatggatacctcatatgttgtgtgtcaatgtgtttgttattctaaccagctcgtcaattaattattgtgattacgtttcatctgttcagagttcacacccgatgctagtctttgccaattggagcaagacttaatcaggaggttacttggtctggtgtacatcattggcactaatactccctttgctttgcttttttgttttgtcactaaagcgtggcagcgatgtcacttcttcgcagtcaaactctgctcttctcttcttgcatgcccataaacacactccgaaagtacataatctaagctagctttgcaagatcaggaacaaggggaccaaattaagatgggcggggtgacgtcgtcgacgtcgtcgtcgtctccggcgacggcggcggggggcagcagctactcggcggagg

SEQ ID NO: 45324 - DNA, 497 bp, Oryza sativa
ctcacaactctatgccactctccttcagctccatcggcagcagtgtcctgcgcggcggctcttccagcgctgcagcctgcggcatgagctgctgaactcatacgagttcgtcggctggaagagaggagagaggggaaggaagaaggaagaagagggggtaatttggtcttaaaaaacaaaaaatgttatgaaaaggtctgtagtgataatacttatgaaattgcaatggcaatggtaccaaatagtaatggtatttttctaaaccgtgaaatttataatagcggatccaattaacccaaattttgattgtaggcaaggccctgcactcctgctcccaaagacaagaagtgcttcgcgatcaagtctaaggctcgatattgttgcgaaatctgattaataagcccttatttagggcgactaaaagcaacatttcaaaatttatcggagtcagcaagaaccgatagcgactgccgactgagaagatctgaggccctcgt

SEQ ID NO: 45325 - DNA, 1501 bp, Oryza sativa
tctgctgtgtgacggtcatttatattgatcgcactatcgcagtgtttatgtacacgtctgcaaagttttctaccatgcgaagtgatttgatgtcaaactaccatgcgaagtgtttgagggggttgtcactatgatctgatgtcaaaccagagggataagatgagcgcgaaagggatatctctttttggccgaggatacaccgattactcactccgcctcaaaaataaatttatttttcgctcatctcacatatatcaatacaaaaataaaaatactaaaatactcaaactttatcaaatcccaatgcaactattgttcactttaactactctcaatttcattgttgctttaattttacaaacttctatgcaataattattctaaaaataaacatattttgagacaaaagggacttaaaaataaacttattatacgagacgatgggagtagtttattattgagtgactatcagcggcagagtatctactgttaggctgactctggccttgactactatacttcctttgtttcccagagactccatttgtcggtatttggttataacgtttgactcttcgtcttatttaaaaaatttcaatgatcagtgtttttattgttattatacgataaagcatgaataatattttatacgtgactaaattttttggattttttcataagtttttcaaataagatggacgatcaaacgtgggatacataaagcgaaaaataagtttttttaggacggagggaatactagcaaaaacatttgtgatgtattgccggagatcgggaaacacttcttcctcacccaggctcaatggcactgctggctccgtcactgaatatcgacccgaaaacttgcatgtacaaagggaaaaaaaaagcaaagttttcggattgcgatggtgattcagggttgctgctctatggattttggtagacccaatgggctgcattttccatgacagtgcttgggttttcagtccaggcttcaggcggtccgatgacatttttctttgtttcttccttctctcccctacctattgaaaaccgcagcgtctcatcactgagctgcatttgcggtccaagatttgtggtagctggttaccgctctggcgaactccagattgtcgtatcaactgatctttagtgccatgccacgaacaaaaaccttccaccacaaaatcggacagcgtgcaaatgatcctagaacggatcgctgtactataccgtaccactaccatatgcatgtccccctcggccaaaaaaattaccctacaaatctaaacgcatgtgttcaggttcatatttgctacatattaggacggagggagtagttaggaattttttttttggacaaagtagtactacctccataaaaaaaaactcaacctcgtactacgaatctaaggttaggttgtgtttagttcagcgcaaaatttggattttggttgaaattggagatgatgtgactgaaaagttgtgggtgtacgacaga

SEQ ID NO: 45326 - DNA, 1501 bp, Oryza sativa
agcggctcttgcggttggtggagtcgtagccagtcttttgctcgtctcccagctcctctaagcgactcctggagtccatcaggttggtgttgccattggctgcctctgaactagagttgttgttgccactgggtgtagaaggtaaccatctactgctgccactagctacgcctcggaaagctgaggctagagcgaaggtgagaactggcgctggagtggaggctgaagctggtgcaagagcgggtgcgggtgcaggagctgcaactggcgaagatgaaggagctggagctggagctggagctggtgctggtgctgggactactggaggtggtggaggtgggtgcaccagtagaatgcaaactggagctgtgtgttaactgcagaatttagagataaactcaaagtcaaagaacaaatcgaggaagatttggagggagatggaattattcccaaatttcgggtgcgcatcgactggaaccatatcgggtagaaacggagtcgaactaggttgagcccatatagggtgacatgagccgatacgggtatggctgagcttgcaccaggcctagattggattacaagacattgccgtgcgaggaaagagtccattataagcaattatttctattaattaggtatattaatgtgggtttcttaaagatttggcaagagtctgccataaggacttgtttgtattttttttgtaatttaggaaagctttgagtcatgtccataatggacaagtttttactatgggtataaatatgtgcccataaccatgtaaaagacaacaatcgttcaatacaatcttggcgctttgccagcttttcttttagttcttttcgacgagttctttgctttgggttagggcatcgatttcgatctactgacaagaggtaatgcttgtctcagagatttgtattattaaggttattatgtcgctttagatattttaatcttactaatataatcattgtttatcatatatatcttagttaatctatgtcaatagttcattttatatgtatcggctagttcttttctagggttttgccggtatcggttaagttgtttttgttaaatagattaactaaggtatcctgaaaatcagccaatgacttgattgtctagatatattgcttcttttcatacttaatgctgcatcagttaagtttgatctattaatatgtgatttgaatatctagctcagcatgctttttgattgccaataagggtagaatcggggtctcagccgatcttacctaatatagatgttttaatatgtttagttaatctaatcatgctttacatgttatatctatcctttatatatatgtatcacttaagataaatatactggggcaactgtgttcttacccctactttgtattctaattgtgattttaccctttttttagggtttgcatttttgccattacttttttcaaacgaagcttcagtttacccatattctgttaacatcaggtaactgtgtcaattc

SEQ ID NO: 45327 - DNA, 1501 bp, Oryza sativa
agcatctcacccaagagtattccaagggtatcgtatttattttattccgtgggaagatcatgtagagagaactcaactaataagttatatattatttatgataatcatattctaagcaagggttaagataatccaagagtagagtgacacacaagcattactactcattctcataataaatcatctaagctaagtggaaagaaaagagagaaaatctattcctatacttctaatatacatagtatacatacattctagttaactgatatactagctaataccccctatccgatgccctcctggtacttcgagaagccactcctaactgccgagttccttacgacagcccatcatgaccatacaaccggggctaaatacggaggaataccctccccagggaattaacataggattatatatcggcgcggaggaatacccgtactgagctgtcaccatcagtggtccacctctcatccgcaatatataaccccaaataatgatatcccataatctaaacactatgcctaaactaccatatactactctaatatcattgtcatgacatagagcaattgcataagcaaacattatacccgcaccaaagcatctcccagataagctagccgtatattcaatataacatgaacataatgtaaattaggtactcatatactcagaaagtatttcaataccataaatatatttagaagagtattctaataaaagtacaaagcttacaaaagaggaaaggaaagctactagagccatacccgagctcttccgaaggcttccggactcctgatttctactctattcctattccactagctagatactactaaactaaacttgagagaaatgagagagctattgcttgaggagtgtgagtgaagtgagaaggtgaagtccttttataactgaactatgacggttgtgacggttggaatggtcggtaatacgtaccctccaaccgtcattggggtttcatctcaaccgtccagccaaaacctggattcaacgaaggcgagggaggttcggccaccgaacctggggccggcccaatccagcccaatttcggttggcggccttctccgttattcttctccgcagacttgtgaattttggcccaattcatcgtgtcaattctgagttcttggcccattcatacacaagtctggttctcgacatcgtctaattgatttatcgtctgagttgatgttgattctcctccactttagtgtctatctaagtattgttctatcggctatgatataaacacatctaatctctaaagatggtcaatctgatttatatacaatccatattgtctctataagtttgatctataccttttgtctatgattcaaaaaagattgacttcgagattagatgattgtttgcctctacagccgatacatcatacttagggtttacttgtattattttaacatcacacctaacagtcgatcctgtttaattgcatcggctagtttaaagacaa

SEQ ID NO: 45328 - DNA, 1501 bp, Oryza sativa
tatgtccaaacattcgatgtaacaacgtgaaaaattttgtttgggaactaaacaaacccttaattaagccattttagttagacgctgatatgatgtagtacgttttaattaattatcgcctgaaagtagtgcgctcagtatacgtactttgtaattgtcacgtataaagatattgattgtggatttcagtagttgagagatgaaagaactattcatagagaggcattaattgatttcactgttttaattgaacatatactgattttgttactcctgcttgaatgtcctaaagaaggagagtatactcctggatccttttcaaggcttcagctatgtaaaatggcaaacaagccgcagtaccttttttttggcagaaatttatcataaataagcaaagaattaaaaaaaaaggtctatataaagtttgggactattaccgtggcgcatttcttcccaagcgacacaaattttcaacctttgattagaacgggtgtggcaactagaaaacttatatgacagcatgttttctccactactataaaaacactcacgtcttctacctttcccagtccccaccatcgtacttacttcctcctccaagtaaaaaatccaccattccttgaaaaaactatcccttctaaaaacgagaaaaacaaaatccaccaacaattaataaaaaaaaatcagatacggggtatataagactagcataaaaccattcatatgtattcccccaatacaatttgtaagcacgggcgtagcactacatagaaaaagggtcaaaaatttaaaaatatgtgttctggcagtgtaaattatatgtcgtccatattgtaactttttaatcatagtacatctcaaattacaaaacttaaattgcaattttacaagctcacacgaaaaaggcaaaatcacaatacaagccgtgcatgcctctacttttttttttcgtttttgtgaacaacgtgttcttgtggataaatgaaggatcaaaatctaatcgatccattcaggataaaacgtatcaaaagcaaccgataaaaaaataaatatttggaaaaaaacaataaataaaaccgtaaaatctacggctcaacaacaaacctccgatatgtgccgtttatgtggtgacagttgtaggagccttccagtctgtcaagcggtgtgcatatcaatggaggccaaaggattcagtcgtcgtggttttgccgcaaaactctatcgatctgattccctactgttgttttatctcatcagaaagtttgcttccttagagtggttactctctaccttgttagagatggtttattggcttaagttgtatccttgtacgatgtactagggtatatccctaaattctgtctcgttgaataaagttgttcatgttatcttaaaaaaaaaatcagtctggtcgttcggtcggagtcggactcgagtcctcggcccggtccaaatacaaaaagagcgcacgccccactcgacacgttgccccacctcaacg

SEQ ID NO: 45329 - DNA, 1501 bp, Oryza sativa
ctcaccgacgatgacagcgaccgacgcggagcggacgacaacgaaggcggcaaggggtgaacgggctccggagcaaccttgggaaggagatgagaggggttagagggagagaaagagagagagagagaggccacggcggcaagcattgccagccgtagacggcaggcatgcagagctcaccggcgaaccgagggaggacggttccggcggtggaagacgacaggggaacgacggctgaggtagctctcgacctcgcgaacccgatggaggcgacagcgcggcttggcgcagtagctagcgacggctggagacgacagcggcgggagtgatggtgtgggcgcgatttagggcacgggagcaagcggcgaaagagggaaactgaggaggggagcacatgtatcatttatatagcggtggggagctcggatgtggcaagtagggggcagattttgtgacggacgtgggagagagagagagacgacggctggattcgaaaatcgaatcccgccgattttgaggagaaccacgtgcggcgagagtggtggaggtggttccgggtagtggggtgcatcaggtgcgcggagagagcggagtggggcgcctccctgacttgttattttgagatgtaaaccttagatataaattttgtacgtttcaacccttggaaagtggggtgtgtgatatagaggggcacgggggccttcgggactctaagcagagtagctcctgaccgcgaacccctgccctgccacgcggttattttaaataatagctaaacaatgttttctttatgtgacgagaatataacctcgggtccccaaggaaatgggtacctagttctcatttcaccaacagtggttaatgtgcaaaatgggcctagcgttagcaggaatcatattgtatctgatggctgatatttgagatgaggaacgatcaaacggctatagcatttttgagtaaattccctgtatatcattggaaactcactcaatcctgctcatatccctaatatttatctgatcccttctataccattaaaattttaacttgatccttctatgattatactgttatattttctttcatttcactgttaagtttgtttgcaaatatcatttatcccttgacgatgtaggtttgaatataaacttaaaaaacgattgaaaattaaatttaaaattttgtttgaatgcttagtatgtgcattttataaaactaatgagactaaataattagtgcaggaaatgttaacataaaatttgaaaataaaaatgtaataaattgaaatttttatttaatattttaataggataatgactttttattgcgaacgtcataaaaaatgaggagcatccgtaaaaaagaattgtgagcattattagacccatcttgaatactcctcatttgtagaactttttaataaataaaataaatacatattgtttttctttcattaactaaaaaaaattgtgataaataatgtgtcgcataataaactcat

SEQ ID NO: 45330 - DNA, 921 bp, Oryza sativa
  unsure (1)..(921): unsure at all n locations
ccaacggcttgtttgatgggccggttgacgggcccccggccccgctccacngacgctttctgaggccgggtcgccgagaggtgagccggcggcgggcgagtggagatgagcagaggcggagatggggaatcggttgcgacttgcgagctggctaggccgaggcgatacggcgtcgtggtcacgagctgagctcgcgccttcgcgcatgggtgcgtcacggaacaggcaagaagggaacgtacaccttaagatagtttcatactctgtgctgatagaaaataacgaacaccttaaaggcaaggtaacccgcacacaactatactctatgctcatccaaaggtggctttcgtaaaaaaaaaaagagatcatatgtgtacccttatgtgcataccctctaaaatatgctcccctaccataccacactgcatagtaagccaaagcacctgctaatatgtttgaactcacaacaatctatttatcattaataatctacctatttaatatcgaagaaacaagaatacttaaatattgtgtgcaaagataaatcaatagattattagtacttgtttggtgattaaatattgcaacacacagcacagcagtggaaggcagccaacctctagttgctctggtaataaggagctatcgtctcgagagattataacccactcccctctactgggcattctatcgaacactttaaggtcgtcccaatcctgacacaagttctctaagagtttttacattcatgcgaaaagacagtagtaggcttacctctttatgcgccatgggtgatgctcgacagacagggaaacaccgcccaggtgatgctccgaccaacaacggcgacgacgcagacctccgagagaccaccagacgttggattgggaagaagctaaagccaatgggcgtgtctgggcc

SEQ ID NO: 45331 - DNA, 216 bp, Oryza sativa
ctatgtcttttgcaactacagtatgccttgtttcagcctgttggtttttaatattgatatcattttattacatatagaaacagttgacttacaagtaaatctgtttgttgttctcctatccaaaggacattagtggagtattgcctttacatagcctgctgtttactaattagaattgcatccttatcacctattaatgtatcttgctttcatagt

SEQ ID NO: 45332 - DNA, 239 bp, Oryza sativa
ccttccgagccggccaccattgatgaggtcatcgctgacgtcatcatcgttttttttttctttttcctgtttttctaatagattaaatcttcggaaattcataactaaatcatcgtaactcggttttgagtcgttcaagttgctaaattcatctaaaatcatgatctacatgtttgtttactttatatgtactgtttatttggtttttattagtctttttcttctttttgcgtgttagc

SEQ ID NO: 45333 - DNA, 644 bp, Oryza sativa
aaaacttctcaaaaaagatccatcaaatgtgatataaatcatgacaataggtgagtctaaatcgcctaagctataactctcactatatcaaaataagcatataatcatgccgagagaatgacttacaaaaaccagtcatctcaataaaacccagacagcctttgcagcctaaaaagacttacaaaattagtataacacttttccgtcgagcacctttttatttgcatcgtagtaattccaaggaattatctaactgcgtcaaaaaggattttaacagcattgggttaaactgttgtgagcaaatgttgtcgaagcaaaatgcctaagtccctaaggatcacaactaaaccacgccgatagcaaaattgggctgaagtactgatttaggcccaggcccattagtactcccgataccctaataaaactaaaacctaagcgtcagttcgtcttccccgctgaaactcttgccactttccccattctctgctacagtgcaaaaccacaccgatggagctagggttcacagattcgctccaatccagccttcaaggctccacgaaaatctcccacacaaccaccgcatcaatctcccatccattcccagccatatttctaaccaaatcacatcatccaattcgcatcca

SEQ ID NO: 45334 - DNA, 913 bp, Oryza sativa
acacgcttccgttaaccgtttacttacggtaatttactgcgatgtttgcttgttttgtttggcatttgtactgatcaatgtcttagggcctttaggcatagcttgttatctatcttttttgcttctgagaatcagggttgcgcaacatagcttaaatctctctgtggtctttgtattatatttaccatgataaaatgctctagtagtatagtgtttgccatcgatatgcggtgttaatgctgaatgaagcattgagcactccatgttcgctgttgcctgcctaagccatgtagcccctgatgtttatgtgatcagagctgaaatggttgccaagtaagtgtggacttaatcgtgcaattgaagacaaaaggttaaccatttaactgtggacttaatcatgcgattcagaactgtggaattaaaaccatttttacactgttacttggcaaccatttcagctactgtggacttaatcatgcaattcagtatttcagaagatgcttataaattttggttggcctttctggtcaaaatatgtgcttgctattcgggattgtgcactttctttctatagtagcttctgtactactctgcatcttgtgctcctctttattgctttactggagagagttggcatttacctttcttttacattgaatactgactatatcctcataatgttttatattttctcaacatatagttaaaacacaacagccttttttgccatctttctgctgtcgttaaacttttaaccatgattggtaattcattgttgtacggcaaagcgtgagcttttatctggttattctgttcttttgtaattgtagaatttcataccaatggtgtatctgggctgctagttttaatgctaatttatgctaatgtgatttcatttcttgtgtgcagaaat

SEQ ID NO: 45335 - DNA, 1501 bp, Oryza sativa
agagaagttctcgagcacaatatccttgatgttgtcatcggcggcggcggagtcaccctcggaggccccggcggatccagcgacgcgcgcgccaataacgacagagaatgcgtcgcggtcgtcgcggagcgcctcctgcttggccgcctcggcttgcgcggccgccatcgcctcgcgcttgtccttcttcttcgcgtccttctgcgagggcgcgatggcgttgaggtcgacggtggcgcgggccgccttgggcttcgtggccatggcaacgaggtcggcgtcgtcctcctcctcatcggaggggggcaggtcgatgtcgcccatgtaagacgacgcgggcgccttggagggcttgggcttggacgccgccttggatggcttggccttggacgccggcgcgtccatggaggccagaatggcggagaccgacatcggcttgtccttcttgccgccggcggcggaggacgacgaggaagtatctttgcggcccatggaggcggcggcggcggcgtggtggggagctggggaatttagggttagttttgggctcggtcgattagatcgggacggctctgctgtgtttggctccgtcttaactactgtgtttatacttataatactattactataaaaaaaatgcatgtgaatgatcttaaaaaccgacttaaatacggatatttattttcaaaaaaagcaagtaaacttaaaaaccgactcatacacagatgacatataaaaatatcgacaaaaacatctttattttttaaatagcagagacagagatataggttaaaaccaaaacataaatttaaaaccgactcaaatacgaatgacgaacagcagaaacatcttcaatttttataaccgactcaaaaacggatgacggaccgcgaaaatatcttcaatttttataatagtagagatttccccgtacaaattaaagaaattctccttgttttctcggctcgcctcttctatcttctcgcgcgcttgtccttcttcttcccgtctgctttctgttggcaacttttttggtcaagtagataagcatgatcgcaacacctaaacgtcttgcggtgatttgtagagtcgccaaccaccccaaaccagcaaaatctagatcaagttgggttttgatagattaaaccggatagcggagccgatttagataaaacggtgaataactacatgtctcgtgggcaaacagaaggtttacgggacaaacctacaaaggatttcgcactctcgcaatgaaggcgaatgatttacggcgtaaatcaataaagatggacgaattaaagtagagctaagtgaaaagcagaaagcgatattgaaaaagcgattcgattgattgatcgttgtgtgatacattgtttgaaccgaccttatccattaaataggggttggtcttgccctctacaggccctcctccatgtctaactaggggtagaaaacaaaaaaagaacccaaaacatagccccctgagcaaggaatctcgaga

SEQ ID NO: 45336 - DNA, 1501 bp, Oryza sativa
tccctctgtctcctgtattcaaacggccggatttgctcccgcaaatctcgccggcaccattgatggcagccggatcccccgcgccggtttccttccccgccggccgccctctctccctcccaaccctatttaaaccctccccgcgcctccctcgcccgtttccgccacttgccgcaccttctcctcgccggaaacgagctcgcgccgtcgccctctctctcctccgtcgccgacgacctccggtcggccctctccgctcaccgggaccgtcccccgcctcggcgtcgcctcctccggcttcgccgcaccgccgccgaccccgtccaccacctcgccgagctcgccgaccgccggagcgccgtcgtcctcgtccacccgagccgcgccgctgccttcctgcgctccggcagcctcttttgccgtcgccgtcgacccggggtgagccatggaccgccgcctcctctccctttcccttcccctctcttggccgccgctccgccgtgcctatggccgccgccggcgaccataggggcgtgggcgccgcctcccgccggccgcgccgacgtggccgcctccgggcacgccgtggggcccggccgtcagccgcccgcgcccttgggtgcggctgacgcgtggggcccacggcgccggccggtgtgagcccgggtgcgcccggtccaccgtggaccgtgaggctgccgcgtgggccccactcccgtggacccggtccgcgcgccccctcccctcggctgacgcaataaaccctttttaaattaaaatttaaatgaagaaattcgcaaatattcacttaaagagcatataaacttcaaatggccataacttggccatttgaactcggaattggaccgttcaagttctaatttttccttaagaagtcaagaacccatttttgtgctttgttcctgcttgttatatggagtttattagagtaaaagactttttcctttccgttggtcgtgtagacgctgcagcttcggaagatccgctctacgtggaggttgaagccgacgtttgggaaagcgagcaaggcaagtcacatcatctttgaacatattgaatcctagtctgtgaaattattttgatttaaattaatgcattatcgctttatttaaattcccgcgttatcactcttttatttagccatgcttatttacctttgttatgaccttattattattgttattgttattattaccttgttcaccctagattaaacaaaaccccaactagtgggtactctattcatggttccactagtatgaatttatgtagatgcttcgctgttcaattagtcaacattaggtggttttataactctagactttgggaatattcatatcacttggacattgtggaatggttggattattgtggaattggatgcacacctccccctctattcaaaaccctcaaaatggttttaggctgggctcggggtgcatggttttgatagtagcacctcggccacataaggaccggt

SEQ ID NO: 45337 - DNA, 1501 bp, Oryza sativa
gcacaagcccggagcacactcgagtatgtaacttgagtgcaaggcatctgagcagcttgcatctcacagaatacactcaatgcttcttctcccaaaccagactgactgaagccaacaacaattgtgttccagctcacctcattggcatctcgcaatgatgagaagatcttaagtgagctatccatgtcgttgcacttggcatagaaatccattagtgcatttccaacaaaaagatcagactcatggcctatttttatagcatggttatgaatttgctttccgaaatccaactgaaccatgttagtacatgcttgcagaacactagaaaggctatattcattgggcagcacagaagaacgcatcaatcggaggaacagttcaaaggcttgttcattctgattgctctgtgcataccgggatatcataaaactcagaagtatcacatcatcatagggaatcatctcaaaagccaaacgtgcatccttaatatccccacatttggcatacatatcaagcaaagcaccaccgacatgaggctccgtgtcattaagggtttttatggcgcaaccatggatgcccttgcctagcacaactgatggcaagcaaactgcagctttgagcacactggttagtgcaaaagggttaggcttacaacccgacaccctcatcttggaaaagacccgaaaggcattctctgggcaatcattttcagaatagcaagaaaccatcgcagtccagacaacagcatccttacgcacaatcccattaaacacatgttccgcatcactgacaagactgcataaggagtaggcatcaatcagccctgaaccaacaaaggcgttgtgatcatggcccagcttccacgcacatgagtgcacacccccggcaagccctgccgcatccatggcaatagctagcttcaacatggtggtgagcacgaactggttcacctcgtgcccctcccaccgcagcctcctgaacagagccgcggcagcctcaaaatcaccgcgctgagcgtgggcctggacgagcgtgacgaaggacaccatgttccgctcaggcattcggtcgaacagcctgcgcgcgctggcaaggggcccgagcttcccgtacatattgagcaggacgttggcgcagaagaggtccaggcgccccacccctccgcggcgcactacatggccgtgcacggcgcggccgccgcgggcgtcgccacgagcgatgcagccctgcaactgcctggcgcacgcgaaggagtccaccccggggacggaggggaggatcgcgagcgaggtgagctcgtcctccagccactgtagcgctgctgcataggctgcgaacccacggcggtgtggggcaactgggcatgacaaggtggggaggaggaggccgcggttcagtggccggagcatccatccgcccagtcgcatcacagccttagcttctacgagaagctgaacctctcgggcttatatctttggcaaatggcggccccaatgttcac

SEQ ID NO: 45338 - DNA, 1501 bp, Oryza sativa
tgaaggcctttctttgtttgaaagaaccgtccaacgtcatcattaactttgattgctacacttcctcccgaaatgaaggactcaatccaagaaatccatcttggcgagaaacctttcatacgaagagtttgtagtaggaaaggccattttactttgtcataagccttctcaaagtcaatcttaaggatgaccccactcaatttcgatgcaacttatgaacagtttcatgtatgacgacaaccccatctaggatgttgcgacctctcatgaaagctgtttgagttaagactcactatacggtcagccaccgagtttattctattagtgaccaccttagtgaaaattttgaagctagcatttaggaggcaaattggtctgtattgttggatacggttagcttccttgactttgggtatcaaagtgatcaccccaaagtgtatttagaatcttttaaaaaatggtaggatcaatatgttgacacactactcttgtgtatgtattatggagaacctatgttttgattagtcgtactatctttctaacgtgtgagaatcatacctatttcattatgcaatttctttctcttctaactagggaagagaagggattgttgtaacttaatcggtatggggagagtgttcttattgtttcatttactattaagtattattgttggttttctcatctcatctacttcattgtgtgaaattattgtaattgtagaataagagaatcacacaacaataaacttttctaaacattgtgcacattccacccaaattttgaaattaaaacacaagtgtatgggtttattcgaattggtgcccaaaccaaccacaaaaactttgttaacaccgataaatttggccattttcttcactaccaaaattttgattgttccaacttatacaaagctacaattttggctatggattttggttgggagtccatttggtttcaaaccgtatgatagcccttaaccccccttaacaacagcactaagaaaaattggcagaaaaacaattgttccaaccctcatcaaaattttgaaaatgtcccagatttggaatgcagatattttgcggcctcagttaggtatgtttgcccacgccccacccaaaaaaaaatggtaatgacatattttaataaaccaaatttatcgctggtgagattagtgctacttgaattttcttttcccaggttaggagtgctgggattttattcacaatggtaagtttggtaacatcttccatcaagattttagaactttttagggggttttaatgtttttctgtcttaatttggagagaaacaagtctaatgggccagaaagcccaatgccctagcaaggcccacacgtggcgcctcctcctcctcgtctccttccggcgaaagcccaaacccttctctctcctccccgcgccgccgtcgagatgtttcggagcccggccgccgccgccgcctccgccctcctccgccgcctaggcccccgcgtatccgg

SEQ ID NO: 45339 - DNA, 219 bp, Oryza sativa
gtcaaacattttgaaacggagggagtatatgttagctctaacactctcccaattcagtactagaatcaaacatcaaccaaagaccaaaaagttggattttcagaagaagaaaaataaaaggtcccacaagtgaaaacctatcacaaagtcatcaccatctcctttttctttatatataaatcacaagtcatcaccatctttgccctgcatttcctcagg

SEQ ID NO: 45340 - DNA, 1501 bp, Oryza sativa
aatacttccaatgctcaaataattccaagaaaactcttgaacatacttggacactcaaagtatttaatataataatatccagataatttaatgattaatttattatttaaataattactgaaatgttctttgtataattaaaattaggaattgagctccgaaaaatatgagaaaatttcagagaatataattattcatggagaatttaataaaaattaaatccagccatgctttatatttaggaaattttatttcccacatttaacttcacttgtaaattaataaacatttaatataaattctattaataatttattaaataatttataaattctgaaatggaaaattaggctgtgacacaaaactatcgcaccgttatgattatcttccggtttagatgcatgaccgaaagaaacaagtcaagcatcctccttctccacttgatccttgtccaccatatgcacttcgcccttgccggcgtcttcatggtttgacatggaagcccacgtcctgcctgtcgacgatgatcaagaaacacagatgttcctgagtaaacatcgtcctaccctagacgtcccactaacaaacggcttcgggcgggtagaatcctcaccggaatccccttgatcgcccacaccgatgttagacggcgacaccaacgcagaacaggttacaagaaacaaagaagcaacaatacgtagagttagggttaccacgtcacttgcacagaaatttgtcgtcaaccagaatcttccaagaatcaatcttggcagtagcagattaaaacaacccgagtcgctcccgtcaagatacgtagcagtagttgcaatccaaaacagattaagagaacttaacacctacgaatcacaaccaaagatcaaacgagaaaccacgttgatcttggctaggacttgtcagcgcttcagattagagatgagcttccaagatcgcctcctagtcaccttccgtagattgcggacacgttgttagctgatgttgtcgttctattagtttttctcgggaaatttaactatttaccactcttgtgacatggcaattaacgatttgccacatcctgtcaatgacatgtgggcccttatgtgtctatgacatgtgggtctagtggcaaatcgttaagcaacatccgtaagagtggcaaatagttaaaagccccgtttttctcctgctctattcaattaaattggcactgtcttgtgctggttcattaaaaaaaagggaacaattgagagcgccttgtggcctgatggaggcggagtgcgagcaccgggagtcgcgcaaggagcgagggactggcgagtaggggtcacagtgcgatggtgatgctacttgctgtcacgcccagaaattcacgaaccagaatttctaagctgaatgtgcattaaacctctatccaggaccagccagggtacacaaacgataattgttgacatatatatccacgacttacaaaaaaaatataaaagattacaaatgcagcgga

SEQ ID NO: 45341 - DNA, 1501 bp, Oryza sativa
gggccatgtaataaggggatcccgaagtaaaaaattctaaaattaatacacttcgtttctttccaaccactgttgagtaaccacgtctttcgacgtatgcggttgtcgtttcgacaacatttacattggatcttcagccaatggatgttttaaccatcctatttacatcacattatattattagttttgaccgattggttcaaattatattatctcatggcatcttctgagttacatcggcttatactcaaacttgtataatcatagttaaatctatatttatcaacttaaatcttatattttttcggtttgatcttatctatcaatattgcttttgacaaagaatgtgtttacactcaaatttggcacctagaggcgaaataggaaaaattgccaagatttgggaatctaccggtttcctccagaagggccgatctaaccgccatgtatggaccactcagactgtggccagagggccggtctgaccagcagagtccaagtcagactccgtttttgtcgggtctcgagattccttgctcagggggctatgttttgggttctttttttgttttctacccctagttagacatggaggagggcctgtagagggcaagaccaacccctatttaatggataaggtcggttcaaacaatgtatcacacaacgatcaatcaatcgaatcgctttttcaatatcgctttctgcttttcacttagctctactttaattcgtccatctttattgatttacgccgtaaatcattcgccttcattgcgagagtgcgaaatcctttgtaggtttgtcccgtaaaccttctgtttgcccacgagacatgtagttattcaccgttttatctaaatcggctccgctatccggtttaatctatcaaaacccaacttgatctagattttgctggtttggggtggttggcgactctacaaatcaccgcaagacgtttaggtgttgcgatcatgcttatctacttgaccaaaaaagttgccaacagaaagcagacgggaagaagaaggacaagcgcgcgagaagatagaagaggcgagccgagaaaacaaggagaatttctttaatttgtacggggaaatctctactattataaaaattgaagatattttcgcggtccgtcatccgtttttgagtcggttataaaaattgaagatgtttctgctgttcgtcattcgtatttgagtcggttttaaatttatgttttggttttaacctatatctctgtctctgctatttaaaaaataaagatgtttttgtcgatatttttatatgtcatctgtgtatgagtcggtttttaagtttacttgctttttttgaaaataaatatccgtatttaagtcggtttttaagatcattcacatgcattttttttatagtaatagtattataagtataaacacagtagttaagacggagccaaacacagcagagccgtcccgatctaatcgaccgagcccaaaactaaccctaaattccccag

SEQ ID NO: 45342 - DNA, 1501 bp, Oryza sativa
acccacggtgagatgagtgaaaggttgagccgctctagcgttgggaaagcagaacggcggcgagagaaacaggaagcccgacgaactcgagtctccccctcggttcgctctatggtcaggatggcggctattgtcccagttcctcaccttcctcctccataacaccacccatctcccatgacccataccactccttctcgctcagcggaaaccggcgccgcgacagcggagtagctcaaaggtgacatcggccggatgcgccatctttattccgatggcaacccgtcctcctcactcggctacaatcggcggcagagctcaaaggcatcatcggcttaggtaaggcgcaaaaagattagtgtatgtgccaaaacatttacaattcgtgtaaaatggagaaaatggcattccagtaagttggcatcgtctgaaagtggtattttaacgaagccacgttccggaatgacatttcagcgaaaccccattccaaagatggcataatgccaaatttctcgtgttcgggaggtgcctatccccaactccccatacacaaaacacgaaataatccattagtgcgtgattaattaaatattaactattttttaaaaatgagtcaacataatattttaaaacaactttcgtatagaaattttttttcgcaaaaaaactcatcatctagtagtttgagaaacgtgcgcgcggaaaacgaggaagtaagttggagtgtttgagagaaatattgttattttaaatttaaaaaatagattgctattattttttaaaacaacttttatatcgaaacttttcagaaaaaaatacacattttaatagtataggaagcgtgcgcatggaagggtttatggtttctttgtccattgatcaaactcatggcatgtacgataattgttaatagtgatattatctgtttcggtaaaaccccataaccaaagggctaaagtgcagaataaaaaaaaaactcctcatcttttcaattatgtttatacttattagtaaaacatttaaatttctaacgttaaatgtagagttgattttggaattttttcatcgtagtttatttttcagccttttttaaaatcgttaccatttatataaaaatttatttataaattatttttttatttgtaaataccttgtttcgccttttctttcgcataatatgattccccgtaaaaatcgggattagatgaaattccccacaccgtatggccgatcaccacaacaaagccctcgccgcgccgccgtccttttcctgacggcttgtttgataactcgagagaaggggattgggaatttacacgagggaattgatgatgagattaagatgggaatttgatttttaaacctaatatcttgtttggtagagatgatagaaattgatagggagtttagttagagattaggtcattaataaaaacggatagctgagatttgcttagaaaaagtaaaggaggaatttcctcccagttacctgcccctaccc

SEQ ID NO: 45343 - DNA, 1501 bp, Oryza sativa
caaatataaaaccttgattccatttggtcaccacccaatatcagtgcgctgctcttttggaatatcagttgatacaggataaccgatcagcctgcaaacccaaaaaggatctcctgcggttgtaccttcaaaagcatcaactggcgcacccaacgccaaggctatacctcgcatgatctttcttgaaagatctacaagtaaattttcataacaaatgctgtcactcataagtaacaaataataaatggatcaatagcatacatgcacaaataaagatttaaactaagtatagaagttaacctcttagaaggctgatatagttttccagcagtacatcaaaatttgatggatatttgggcctgcataaaaataaatgaaccggttatttgaattttgatagatctctgacctaaaatactcaaaggcagtctaccaaagttcagaacttcttcagtaatagctgaagtaattcaacaagcaataattctgtggtacctagtaccaactatttaatatgcttctagtaacaaaaatacattgaagtatgcaagtacaattgtagccataacttctattttctttactataattcataattctacccatattggaacataatacatgttggtactagataaaatattgtaaatataaattttattccctcacattcttccaaatagaggtgtgctataagctaaattatttatattgtgagtattattaaaatatgcaatagatcaaaactggggtattgttttatatcaaagtcaagtacataatatctgtctcgcatatgtcaaataatacagtgctgtaggaaaaaaacagagatggagagttggatacataccacaaattagatcctaccattggtttagcaaggtctccatatttaccaggttcaataggcgtgtagcactgtgatgttttttcttccagggattaactcaggaacaaattaatggatgataaaaaaataataaagagaaaattaaacttacatcaattgcttcatgcatgtcaggtttacccttggtaatattttcaccaactctttggtaccctctgacagtaaagacaacaaagttatgttatacaggaaggaggattagaaggatccaatgtggaacaaggaaaaatgttggaaacttaaaaacaggttgaagctgtcattttatatcacacctgtatccactctgaggtgtcattttaatcttgagtttttcctcataaggaagctgaaagaacttctgtgtcacatccctaacttgcttcattagcgagtcagcaatcccatggcctttctgttagtaacatacagacaccatttgattaggattgatattgtgtagctagtctgctgtacccattgtagtaaactgatgctaaaaagtctgaagtaggctagtaagtaaataagtaaattttaccacataaaagaatccagcctccctgcaggcatcgtccaacatttgcacaacttgcagcaaatcctcgt

SEQ ID NO: 45344 - DNA, 1501 bp, Oryza sativa
cgtggtggtattgaggcacgtggtggtattacagtggtacacctctgatcagagtaaaactattcgaatagccgtgcccgcggttatgggcgggtctaacaatgtctttcgtgattagtctcacccttctcaccatagtaaatgatgctataattggaaataatttgattagctcctggtttggaatggtacattcctggtttggagatagaactgtgcagccgggatggttgttcagaatggttgggcctatacaacagggtatgttgtatagcgttggattaatattgattaattattacttaactgttttattaaattctcaaatatttgttaaatgcggtttatgcaaatgagaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttattttatttttttccgctgcttagatctttattgattgagaggaactatctacctctataatgatattttattcgcttattaattagagtaataattgtactctattatcaatttgttattgtcaccatgtgcctcaataccaccacggtacctcggaaaggagttgtgacaatatcccttgtacaacacaatccactacagcgcaccattcctggatcataatcacccccttataaacaaggcatggactccccagcgacccccgtgggcttatctccgccacttctcagtctggtgctccgcaatgaaccatgctatacaaatgataaagccgttgcccacgctggcttgtggctggtacggttaatgtttcacaaccaaaactcgtgaaccggtccttaattgtcatgagcacgactctcaaaaccatgtgctcataacccaccattatcaagttttagttggcaagtaattaattaatcaatcacgattgaccatcgtgaactatcattaagctatcattaaataatagtgaatcttaagttatcccaatagtgtgctaatgtttctaagcagggctaagcaattatatctaatatctagttgaaccaatataaataaagctcaactagtcaaattataataacccaaggtatcaaggaataaagtaatcaagaacaaaagggctatagcaaacaataggttaattccacccaatgacattcgaaaataaatgcaatagttgaatagaaacaatagctttaaacgggatcaacatgctcaaagggttgaattatttttgaaaagaaaaagggaattattgcatcagcggctagggtttgcggtggaccgggcgcacggcggcggttcatgcgaacggacggccgagatcgatccatccaaaacggacggccgagatcgatcggtccacgaccggctcacgggagacggggacga

SEQ ID NO: 45345 - DNA, 1501 bp, Oryza sativa; identical to SEQ ID NO: 44980

SEQ ID NO: 45346 - DNA, 489 bp, Oryza sativa
agagtggtgaattcgtgtgtttggtgttcgtggtaagcttgtgttggcgcataggacgaagcagcggcatgttgagtcttctgggcattctatcgaacaccttgaggtcgtcccaatactgacacaacttctcaattaatttttagatacatggaaacagtaggcttacccctttatgcgccatgggtgacgcgattcgtcgaccagcaacggcgacgacgcagacctcccaagtcccgaacccctacgaagagagaccaccaggcgttggattgagccgtcgaagaagacgagaagatctgcaggattggggagaagctaactagctaagccagtgggcttgcctgggccgtgggtcaatggaattgatgggagcaggtcggtgtctactcgtgccatgcgcgcgcagatcccttgatcggctttcctagcctgataagcatgggctagcccattgcagctaaagcccaataaacattttagctaaaa

SEQ ID NO: 45347 - DNA, 391 bp, Oryza sativa
accgggactaaagatcccggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtaaagtttagttttagactatccttttacaactcttttcattttgaaaatgtgttgtagtttgaacatttctaactctcttatctatattaatatatgtctagcctcacctctgacaaaaaaaaatgtaatctaattagtacgtgtgcatgttttctttctaagg

SEQ ID NO: 45348 - DNA, 1501 bp, Oryza sativa
ttgacggtattttgtacacacaagagtatctgggtaactgtgttggcttgaaaagcaaagcaagccagttattcagaaatttatatatgggcgaaccaagcacgtgcacttggtggcatgtatatatgcactcgttcaagctcagcgaatggctatagatgtttggcaaaccaacaagaagcagacctgtgttcaattaactctggcctgcatgcgcgtatttacgtccgtatatttcagtaatatggacaaggacaagcatatgcacgattaagcctcaatcaatcagcagcaaaacaatgaaatagaagcaaaacaattatgtgtgcatatatagttcatgcatgcatgggcaaaccatgcaaaccaagatgctatacaggctacgggctcatcgtgcatgcatgcgctcgctagtggcggccgtatattggtggcgtacgtatacgaatacgtggactactgggcctccatccatgctaggcccaaccgtgcagcaatccaatggatagaaatcacgtgaaatatatccatccaccagatgagtcaaagaggctttatctattgcagtgaagatcgcaacaactcaacgtggatcgagtcagggcagcgccatggattccgcgctgttcgttagggcttccccttacgcctatataaggccatcgacaccagcagccggaggaggcgggggccggggggcacagatgcagaacacagcggcaacgaagagtagatccatctacccatgaagagaatacacagaggcatcggaagagcacaccaacgtgtgcgccggcggcggctgccggccggtggcagccaacattcgaagaaggttcgggcagccacccaagagacggcgccaatccagccggcacaccggtgagaaggcgctgcacactggcttcatatgtagtttaggggatatctggtatggcggttgagatacacgaattagagtagtagtaaaagtgaacttattccttcatggcgtgtttacggcccagttcctggttcagttgctgaaaacgagcacaggcctgcagcccgttacaccgccagccaagccaacaacaattttcgagctgggcctccactgctgccatggtcacaggacgtgcggttgctagcgggcacacctaatgagcgggtgatcgctcgcgtccgtccccctactccccctctctctcccctctttctcctccccttcttctcttattactatagtaaaccatttttttttaaaaaaaaataaaaaattagaaaaatttatatatagaaatactatatataaaaaatttgaattcaaattcaaatttgaatcgggtatgtaaacttttgacttataaactttgggtctataaactttaggtgtataaactttagatgtatagaaatactatatatatagaaaatatttgaattcaaattcaaatttgaattgggtatgtaaacttttgacttataaactttgggtctataaactttagatgtatag

SEQ ID NO: 45349 - DNA, 1410 bp, Oryza sativa
gtccgtcttatatgaaatttttttatagttagtattttcattgttgttagatgataaaacatgattaatattttatgcgtgacttatctttttaatttttttcataattctttcaaataagacggatggtcaaacgttgaacacagaaaccagggtttgtctttttttgggacggagggagtaggtgtgactgcgcgagtgatttgactaagccgagcatacgatagtgaattgagatgtctagtggctagtactactctaatctccatgtatatattccttgaaaactcaaagtactttttttaataggaaaaattacgaattaccccccgaactatcgtgatagttcggggatagttggggggtaattcgtacttttctttttttaatattaatatataacattgttaattttttttacatatgttcaatcatttatcttatttaaattctttttacaaacatacaaaagttcaaattctttttacaaacgtacaaaagtaaaaaaaaaccttactgatcaaatcaagtcataacaaaataaatgatgtttaaattttttaaatacgatgaatgatgaaatatatcaaaaatgtgtcatgtactaaaaataaagtatattttaaataggatattatttttaagatccattcaaaccaacattttcttaaaaacatgttcaatattaaatatatttaaaagtaactttatacaacgtagaagtgttgaccaaaaattcgctcttggctgatagtatcggatctgtgttggtgcgaactaagtcaacgaacacaacggtctgagagatctgcttagctccagtgtaggttgaaaatattgatgagatgcagatatgccagtcagtttgatcctgcaactgacaagatatgtaaataacagttcaaagagccgatcggctgacaagctgatgcagtaatcctagtcgatgccgataccagccgatgtttatcggctatatatccaatgtatattgtaataatgatattgtttgacggtattttgtacacacaagagtatctgggtaactgtgttggcttgaaaagcaaagcaagccagttattcagaaatttatatatgggcgaaccaagcacgtgcacttggtggcatgtatatatgcactcgttcaagctcagcgaatggctatagatgtttggcaaaccaacaagaagcagacctgtgttcaattaactctggcctgcatgcgcgtatttacgtccgtatatttcagtaatatggacaaggacaagcatatgcacgattaagcctcaatcaatcagcagcaaaacaatgaaatagaagcaaaacaattatgtgtgcatatatagttcatgcatgcatgggcaaaccatgcaaaccaagatgctatacaggctacgggctcatcgtgca

SEQ ID NO: 45350 - DNA, 1501 bp, Oryza sativa
agtttacatacccaattcaaatttgaatttgaattcaaatattttctatatatatagtatttctatacatctaaagtttatacacctaaagtttatagacccaaagtttataagtcaaaagtttacatacccgattcaaatttgaatttgaattcaaattttttatatatagtatttctatatataaatttttctaattttttatttttttttaaaaaaaaatggtttactatagtaataagagaagaaggggaggagaaagaggggagagagagggggagtagggggacggacgcgagcgatcacccgctcattaggtgtgcccgctagcaaccgcacgtcctgtgaccatggcagcagtggaggcccagctcgaaaattgttgttggcttggctggcggtgtaacgggctgcaggcctgtgctcgttttcagcaactgaaccaggaactgggccgtaaacacgccatgaaggaataagttcacttttactactactctaattcgtgtatctcaaccgccataccagatatcccctaaactacatatgaagccagtgtgcagcgccttctcaccggtgtgccggctggattggcgccgtctcttgggtggctgcccgaaccttcttcgaatgttggctgccaccggccggcagccgccgccggcgcacacgttggtgtgctcttccgatgcctctgtgtattctcttcatgggtagatggatctactcttcgttgccgctgtgttctgcatctgtgccccccggcccccgcctcctccggctgctggtgtcgatggccttatataggcgtaaggggaagccctaacgaacagcgcggaatccatggcgctgccctgactcgatccacgttgagttgttgcgatcttcactgcaatagataaagcctctttgactcatctggtggatggatatatttcacgtgatttctatccattggattgctgcacggttgggcctagcatggatggaggcccagtagtccacgtattcgtatacgtacgccaccaatatacggccgccactagcgagcgcatgcatgcacgatgagcccgtagcctgtatagcatcttggtttgcatggtttgcccatgcatgcatgaactatatatgcacacataattgttttgcttctatttcattgttttgctgctgattgattgaggcttaatcgtgcatatgcttgtccttgtccatattactgaaatatacggacgtaaatacgcgcatgcaggccagagttaattgaacacaggtctgcttcttgttggtttgccaaacatctatagccattcgctgagcttgaacgagtgcatatatacatgccaccaagtgcacgtgcttggttcgcccatatataaatttctgaataactggcttgctttgcttttcaagccaacacagttacccagatactcttgtgtgtacaaaataccgtcaaacaatatcattattacaatatacattggatatatagccgata

SEQ ID NO: 45351 - DNA, 1501 bp, Oryza sativa
cccttgtcaccatgctcatcaactccgacatgtcaaggatgacactcgcaagcctcttggggaagatcaacaccaatgacatgtacaagttgaagaagaaggagatggaggaagcctcaccttctaagaagtgcattgttctccaagccgaagttgaagacaagggcaagggcaaggtgaatgaagccaatgaggacttggaggaagagattgtccttcttgctagaaggttcaatgatctcttaggaaggagaaaggagagaagaaggggctccaactccaataggagaagaaatagaagacccaacaagactctctccaacttgaggtgctttgagtgtggtgagaagggacactttgcttccaagtgcccttccaaggatgatgatgctgacaagtcatccaagaagaagagtggaggctacaagctcatgaagaagctcaagaagaaaggcaagaagattgaggccttaatcggggaataggactcaaatgaggagagctccgcctcatccgggtccgaggaagaaggtggtgatgatgcaagctccaaaaagaagaagatggccgttgttgccatcaaggaggctccatcactcttcgctccactttgtctcatggcaaagggctcctctaaggtaacatctcttagtgatagtgagagtgatgatgattgtgatgatgttttctatgatgagcttgtgagtatgtttgaggagctccatgcttatagtgagaaggagattgtcaagttcaaggccctaaagaaggatcatgcttctttggaggtcttgtatgaggagctaaagacctctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctacctcttgtgatgatcttgtggatatgcctagctctagctctagcccttgtgtttctatttgtgatgcctcacttgttgagaacaatgagcttaaggagcaagtggctaagctcaacaagaatttggagaggtgcttcaagggtaagaacactcttgacaagattttgagtgagcaacggtgcatccttaacaaggagggacttggattcattccaaagaagggtaagaaaccttctcaccgtgccagtcgttttgtcaagaacaatggtaagtattgctccaagtgtcgtgaggttgggaatttggtgagtgattgccccggtggtaagccttccaagacttgcatgtttgattctcattatatgcttaggaaggcttatgatggtagcattgttgctagatatgtgggttcgcctatactcggtggtaaaaagaatgccatttaggtgcccaaagctttggtctctaacctccaaggacccaaacaagtttgggtacctaaaagagcttgatcttcttttgt

SEQ ID NO: 45352 - DNA, 1501 bp, Oryza sativa
tggtcgtggcaatggacgagcatgaatattatttgacccaagcacaggtaaagatgtttgtggatgctgtgttgcttgccctggggctgattgtatattgtgtggatggctgagcatatgcccccctttcacatctgacatgttactagattcattaaccttttgcaaattgctttctgaagatggatagcccatgttactttgcatttggcctgacaaagaaggtcggaaaaaaggtggtcttgggctgtcactagcttggtttgcaggaatggaatgagctgacggatatgatttgtgctcaactcctgacgtagaaccactgggaacattctgctgattggaaacttgacttaacaaagaatagttgcttggatttgtctgtggattccgttgcccatgagcagcttgcagctaacaagaccagaataactcccaagaaaaacagattgtgatggtaagaacaacaatagcagtacagaaagtggtgatagatagattgacctaacttaaagaatagatagattgacctaacttacgcactaactgcacaatgtaaagtggcagtcagttacctgcaatgggggagaggtctcaaatgaaccctaataaattgaaactttagttacctgagcttgatattgtgcagcagcttgtttgagcaacttatcgccaacaatagtccttacaactttgagaaagtgttccttgctaacttcatttttctatcgaaaataaaggatatctttatgcgataagtatagttgagtaatcagttatgcaataatattctatttgttttttttttaattcagcatagttcaggaaccaacccgcaactttgtaaaaatggactgaacttgcatatccttgtctttgtcaaggtgccgtctcaaaattggtattaacatatgaaatgtaacaacaggaggtttccccaccgtaggagcactattagtttgatttgtgcttggtgtttgttgactcctcatctgttgcaaaggctgcttctgaccagaatactttgttgagaactgtttcctggctcttgcttaacctttggctggtcttgtttattatcagcacccccagataccagttcaggcctagatggctgctcatttgaatgatgcaaatgtttctgttcctgttgttggttctcctggtttccaatttcattctttactgaaccctgccactgttcatgattgtgggtgaacattgaattgctctcctgaggcacaagacctacatttgagataaattactataaagtgaatacttgataaatacaatcgtagcataactaggtttttttttacagaaatagcataactaggttaccaagaatatgctaaaattcttttacttcaagagaaatatactgaattgcttagatgttttttaaagacaatatgctgaggtatttgatatggcaaaattgtgggcttccagtaacagttcattatgcaccacaggactttggtcacatttcccccag

SEQ ID NO: 45353 - DNA, 884 bp, Oryza sativa
tgtacgcgatttttcatggatgactttggatatgtttggattgtcatataaatgattgtgattgcatggatgacttagtatatgatgagtcaaagtcaaccttttggattacattatttctttatcgttaattttttggtgtatgatggccaattgcttctgagtagaagtaccaactcctggcggtttgtcttgcatgatagttttaacaatagttaaagtgctgtcatctgatagtaagatattggctctatagaacacatggatcattcattacttctaatatttcctttatgcctagttggctagttgagttatttgtatgaagtcctgacctgctaaccatccttgtgaccttgtgagctgatgcacacaggaaactttcctactgacataagctagtgctgtttacccgaaaatgctctagtgtttgtctgaatgttgttcatggtcatccaccttgctagcaaaatgcatatgcagagcatttcttagtcagaaatttgcaacatgtgtcagatgcaggcttagattatgtgtcgattactacaagagtacatgtgcagattacagagtataatgtggaattagttaggtagggtcttcaggtcttggcaaatgactcatgagtggtaatcgatttttatctgatctgctttacacctagtaggctagtgccaggtttataagacaaggtaggccaatctttagggtgaacagagataattttagcaataaaaggcagttatatagaccatgttttgtcaaaagatgtgtggtcatgagcgccacctgtcagtgaaagtgaggatgtgctctccttctgttgtggttaggaattaggtgtcttttagtactgaccttgctatttacctgtccctagg

SEQ ID NO: 45354 - DNA, 426 bp, Oryza sativa
tacctgcatgtttggttctgcttgagtgccatgagatcgatgaggctgacttgagtttgttgtgttgaaagatttagaagtacctgatgttgatggttggttttcaggaacaccaacacccttacatccaaaggctgtgttaacttgatttacatgcatggaggcgcaaaaaaaaaaaaacacttacgtagattcagagcattagatttcagttaccttatttgtgtgttctgttggagggaaagatttagttttctgctctttgtttacttgttgccatggagatatattagtttgcaacgttggtcgtgctgccatgctcccagtcactgaggtaacagctccctggactaattgtcctctttgactggaatctgccatttgtggtctaagtggtacaattggacctccaactggtcgtggcaa

SEQ ID NO: 45355 - DNA, 201 bp, Oryza sativa
caattctgagttatacaaaaaagaatgtgaaattgattgggtgatttgagaaggacattaagatgcgcatagaaataactatgttaatagttaacaaatttcataaccataatttaaaataccactggtgaaaggtagtttcatcttttgggaactgatatctagcattcagaaccaccttcacagcaaaatttcataaga

SEQ ID NO: 45356 - DNA, 1025 bp, Oryza sativa
agattatagttctaagcacgacttatgaggtcaaacttaactgatgcagccataagtatgaaaagaaagacaatatctagaaaatcaagccattggaagcttcatagagtgataaatatcctatataatcaaagtcaatatcggtatttaacctattcggctgtcttctaggagtatatgctagccgatagaaggttaaataatgatattgccagagattatataagatatatgataactcaacaacttacataaacgagattagagtgtcataaagatggaagcactaatctcgagaacgcaagccgccataacaagttttacctatagttgaagatcgaacccgatgcagctcaacccaaaagcaagaactcattgaaaacaaaacgaaagtaaaaggtggtgatgcgccgagattgtattgaacgtgtgttaattgattacatggggctcggggtctatttatacccgagattacaaaatatgtctatgttggacacgactcttatctctaacaaactctaagataccataagtctttgcggcaaacttttgcccaaacttatctctaaggaaattacatagaatatcctaattaatagatacaattgtcgtttcaggaccgaatccgtgtgtggcaatccatatgaagcacattaactcagcccgatgacgtatactgagtcacattgtctgattcagctgaatcgactaccttgtccgactcgaactctgccgactttggtcgtagccgatttggacttcagccgaatcttgctctttttctggaacgatctacctctttgattccgcttcggttttattttcatctccgatactgaaattaccaaatttggtcgctaacatcatctgcaccagcggcatagaaaaccgtagagtagacttgcagaaattcttctgggtgtgtacttccatcgtatttctctattgctcccagtcggaatttctcgggccaccgtacatcctggagttcgggcatgaatgccctgcatccaccctctaga

SEQ ID NO: 45357 - DNA, 292 bp, Oryza sativa
tacggaagttgaacctagatgcacagagcgcaggacatgtgcaagctgaagaagaaaatttgctgtacaactttgaagctctagatgaagcagatgcacaattcaatgacgataatttgcatctcgaagctcaagatgcagggaatgtacaacccacagaagatagtgagcaagacctttcagagaatgatgacataatcacggagttgcctcttgcagccaaaagaccaattaatataatctgttcttcctatatatgtctatatatatgatttttcctatcacccatagc

SEQ ID NO: 45358 - DNA, 1501 bp, Oryza sativa
aaattatcagtgaaaattgcaaaatattttgcttcatcctgtctcaaagtacaatgcaaatatcacgaaaacttccaataacatttggtcatatgaatatgagggtaagacgcacatgatacactctatgttaaaatgctaaactgggggaaatgtgaccaaagtcctgtggtgcataatgaactgttactggaagcccacaattttgccatatcaaatacctcagcatattgtctttaaaaaacatctaagcaattcagtatatttctcttgaagtaaaagaattttagcatattcttggtaacctagttatgctatttctgtaaaaaaaaacctagttatgctacgattgtatttatcaagtattcactttatagtaatttatctcaaatgtaggtcttgtgcctcaggagagcaattcaatgttcacccacaatcatgaacagtggcagggttcagtaaagaatgaaattggaaaccaggagaaccaacaacaggaacagaaacatttgcatcattcaaatgagcagccatctaggcctgaactggtatctgggggtgctgataataaacaagaccagccaaaggttaagcaagagccaggaaacagttctcaacaaagtattctggtcagaagcagcctttgcaacagatgaggagtcaacaaacaccaagcacaaatcaaactaatagtgctcctacggtggggaaacctcctgttgttacatttcatatgttaataccaattttgagacggcaccttgacaaagacaaggatatgcaagttcagtccatttttacaaagttgcgggttggttcctgaactatgctgaattaaaaaaaaaacaaatagaatattattgcataactgattactcaactatacttatcgcataaagatatcctttattttcgatagaaaaatgaagttagcaaggaacactttctcaaagttgtaaggactattgttggcgataagttgctcaaacaagctgctgcacaatatcaagctcaggtaactaaagtttcaatttattagggttcatttgagacctctcccccattgcaggtaactgactgccactttacattgtgcagttagtgcgtaagttaggtcaatctatctattctttaagttaggtcaatctatctatcaccactttctgtactgctattgttgttcttaccatcacaatctgtttttcttgggagttattctggtcttgttagctgcaagctgctcatgggcaacggaatccacagacaaatccaagcaactattctttgttaagtcaagtttccaatcagcagaatgttcccagtggttctacgtcaggagttgagcacaaatcatatccgtcagctcattccattcctgcaaaccaagctagtgacagcccaagaccaccttttttccgaccttctttgtcaggccaaatgcaaagtaacatgggctatccatcttcagaaagcaatttgcaaaaggttaatgaatctagta

SEQ ID NO: 45359 - DNA, 541 bp, Oryza sativa
agcttcctgttgaaatatttacttgctttatatcttaaaaagagtgtatcggagtataagccgtacacgctagatctatctgatcggctatgctgtaaacgtctataatctcattgttaatatatattccgatctaagtgatttatattgtctcggcatggcgaccgatctatcccaatcacttgatttaagtatatatcgacataaagattatatactgttaatatctatagccaatcgagtagatttagttttaatttacttattaacaactgccgatcgattaacatatgacatcggctcaaatataaatgatatgtcatcggcgactggccgatcggctatcatttatggatttaaccgcggtttctttgtctattatttcttgttgattgcaggatcaaatcaactggcacgctgacaaacctaaaaggcaagattttggatctgcactggagttaagcagatctcccaggcctcgtatttttattatcaacacgcttttggcacgcccggtgggaccgagtttcgacaacatctt

SEQ ID NO: 45360 - DNA, 1501 bp, Oryza sativa
atcttatatagcatatgaaagatgatttacattaaaaactataacacaaaaatgtattttacatagcatataacatataggttatatatatacatatttaaaaaaagtacaaatgaaaaaacttgaaacttatatacaaacttccataatgtataaggatgtcacctaaaaaatttcatattttttaaaacttctaataagataaatcaatcttaaccttttatgtccataagtgtattttgggtattttctaaaaagataagttgaatgacgtattgaagaataattaataaagttgtcggtgtattataaaaaaaacaatgttaatggtaaattgttgaaccagaataaactcagtagcataaaatagatttcctaagtataaggatttaggttccattctaatcttcaactcaaaattacaattttcttgtttctcagtaacacgctttataaattgctaaacatttttttttgcaaaactattatagaagcttcttaaaataaatcaaataaatttaaatgtacaataactaatacttaattaattatacaataatgatctatctcattttttatgctgaaaaactaagtgactaggggtgaaaacggaccggattcagacggatagtggtcataccatatcctaaaccatattttcaagtggattcggagcgggtgcagatagtgtccagatgcggatgtggagcggattatttcggatgccggaaattgtgcagaatcggttcggaaagtttccatattcgttgtactatgaaatgtcccatccagttctaggttgctatattatgggacggagggagtacatacttaagtgctaaacaacattaaacaacatgaatacatttcatgttgtccataatttaaaaatacaactgcgcaagtgtgagtgtgtgacatgacacggtgaaagacttagactaagaaaatctaggttaattgatgaattaggccattggatggaccaacttatgttacatgcaatagatagagtggttacatgtgttgataattacgaattatctggaaaacggcctattcggattttatagataccgtatccgcatcatactatctacatccacatccatatcaaccggatttttaaaagtccataccatatcagacggattcagagtggattggatcatactatctgtaacgttcgaacgcagttccccaagggcgacaaatcctcctctgggtgagccttgcaaaatgcatcctctttgttcctggtccaagtttgaccgtggaccttgcagttgaagtgttgaccgcaatcccctacttttccaaaatttccaccgcccaccagccaccaccaccaccaccaccagcgggccttcaccctcttctactagtcttcttcctcctctcgccctttcacaccggagccatagccggcgggagaggccagcccgactgccagagcctctacctacgactatccgcggccggatggcgccccgcgtgtccc

SEQ ID NO: 45361 - DNA, 1501 bp, Oryza sativa
tcatcggggaagctggtctgacgaggatgatgacgaggacaaggggtcgcttggttgaggagcctagcttctcgaacgatgatctcgtcctcgacctcgaccgggagaatgagactgggaattccgatctcgtcggttgccgccgttccgctcctgatctcgacgattagctgcttggtctcgctggaagtcgttattggcgtcgccgcggcgaccgctgtgggcccgtcggtcccgatcttcattaggtgcacctccccgaccatcgtcccttctctgtcgtggaggagtgcggtgacgatgtcgtcgggcagcagcgttatccccgcggtgtgaaggagagcgatgtcgatggcgatcattgttgtcacgatctcttctgtccctccaccggttgtctaagtgatcgcgaagatcacagttctcgggacgcggtggagtagggtctcgtctctctcgaggtgactggtcaccggagggacgcgttccgttgggattttctccgtccgcatctcctgcagttggcccttcatcctcatgttgttccgggttgaccgctgcttcggcaaatgcggcgttgaggttagtcacggtctcccacagtcgcgtcgcccattggttgacgtcggggtttgtgaccggatcaaaaggactttcactcaatatcgcatccaggtttcgcaactgttgagcgggcattctcactgctgcggacgcacttgtttcagtgttgtcgaccacgtttacatctcatggcaactccgaggaggattcgtagtcttctaggaggtgtagcacagatggctcatttggattagtaccaacatatcctacgaaccgatttgatgtcatcactgcatctcgctccttggcaacacacggagtttgaactcgcgattgttggacgcgatgatgcggtggtttcagagttctgaggaaaatcctgcagcttgtgatgtcgtgagacctagatttgtgaattgggcagtaggtgattcttgtcggtgaagtgcgctgaatctcacgctcccagcaggcgtagagttcagctttcacgtggagtatcaccgggcagtcctcgagaatatgtttggatgtcttatgcacaggaaaccaaggtctcagctttagggtggtagtcattgtcggctctgattttttgtacaaaggacaaaattcggccgcttgaggattcctcccaggtgttgggaccgtcgatgttccgttctccacttgggtgggaggaattgtcggcggggcatcgtttctcggagtcttaaccgtgcctttctcgttcccgatagtgattggtccagtcgagatcggtgtaacggtatagaccggaaagacgatagatccgacttgagtcaataccagcgatgtcgaggtagaggctccttgatcgacgccggtgttggtactgttgtcggaaagtcttgaagtcataccggtatatccttgagcaccaagtctccctacctagcgcgccactgtcgacgag

SEQ ID NO: 45362 - DNA, 1234 bp, Oryza sativa
gcccatatttttctataaacttggtcaaggtttgagaagtttgacttataacaaaactaaaatgtcttatagtagtatggaatggagggagtacatgactctaggttaaactattcgttgatgattgcagttttgagaattataacacatttctccatttgtagttttgtaccataaattccctctgccttttgcagctatgactattatgtgaaatattgcaggttcttttgttgtgcgcataaaaacatgagctgcagattttatgcctgcttgttcgatcaagcggtttgaacattaaagagtgcaagcacgcaataccctgggaaatacgccttgtagctgctcctttttctttctctttgttcttagaggcacctctttacttactgacttcatcataccttcctttgtgcacatcttaagattgggtgtaattttgtgattcgtgtgaacaagagaagacaaaatgtaatatttctcctgagatactggctagagccatgtaattttgttgtctagcagtggagaatgttttatcttgtatgtgatgcccgcgcacagtcacgatttacctgtttttatggtttcatttttatggtttcatcgatttaccctgtttaggggtgtttggtttgtaacttggacgttgtggaaacaatagatcatagctgatagttttgttgtttgtagagctatccgtttcgtaaagataatgtaccgcatgggcttaccaatcctgcgagccaattttttttttaagtgtaaccattagctagtacacaagctccttttaacggggcttttaactatttgccactcttacgaatggtgcttaatgattttccactagacccatatgtcatagacacatgaggacctacgtgtcattgatagggtgtggcaaatcgttaattgccatgtcataagagtggcaaatagttaaatttcctcctttgaacatgagtacaatggccagaccacgttgacgagggtatctttagtttatgcctccttgaacgcatgaattttatagcaaggattttcatttgaattagttcaattttcttaaaattcctctaatcccactgtagaatcaagatgttgatttaatatacaattgttaaaggtgggtgtttatttgaaaatacgatgagtagtgatttcagactacgatgcgtgatcggactgggaggccagtcagactgtaggggtgtgatcggtctgacctagc

SEQ ID NO: 45363 - DNA, 829 bp, Oryza sativa
ggtccaccgtggaccgagcggctgacgcgtgggccccacttcccgtggacccggtccgcgcgcccggctccctcggctgacgcaataaatagttttttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgcttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgttattgctattattaccttgttcaccctagatcaaacaaaaccccaactagtggacactctactcgtggtatcactagtatgattttaggtagatgctttgctttaattaggtaacattaggtggttttacaactatagaccttgggaaatattcatatcacctggacactatggaattgttggtttattgtggaattggcttcacaccgccccctctattcaaaatcccctaaaatggttttaggctgggctcggggtgcatggttttgatagtagcacctcggccgtttaaggaccggt

SEQ ID NO: 45364 - DNA, 1501 bp, Oryza sativa
tacatcggatagcctgatttcaaatcggatagtctgatgttgctcaagtaaaaatgctataactttttactccaaactccgatttcaaagatcttggactctatagaaagctagttttgtgggctatcaaacccaacataaaacatggtccaaaatcttcaagagattttaaaaaaattgcaaagaaacccggtgtaagtgttgtgacaagtgaaacaactcaggatttaaattttggcttaggtttttcaactcacacaaagatgaagcattttgagcactagtattcaaccaattatatgcatgtggtatccccttaatagtacggcatcctaaactcaaatgtaaaaggaaagttataccaataggaataccttcacaccaatttatttcttcacttggaggattaccaatgtcaaggtcatttgatcatcgggaagatctcatcttcttgatctttggcatttcatctttcatttctcaaatgattgatgcagataattcatatcttcaaatggcctcgcacggttcatcacgacacagtcttcactcgcccttcaccaccggtttcggttcgtcggcgccaagccccttgcttgcccttcaccaccgcatggtccatcgcagctgagcagcgcttgcgcttcaccgtgttgccataggtagtcacttcatacccacatcttcaatatcttctctttaattctcatccatcgataagtccatttcctagcttcttcatcggactaatcacttgcttatacacttaataagtgcattagtcccttaatcgtttgtcatcaataaacaaaaacccactaggagcatagatgctctttcagttacatatatattttataaaaactaagaattgctaatctaattgtataattcaaatatgtttcataaaacaataattgcaaaaaagaagtacatgtaattcttgtgatgctcgtgactttcattgagttcgggtagaatcatcgagagtttccacagtattcggtgcatcgtactaccgtactctcagggttatttgctcagtgaattatagtcgaaaatacccattgttgctcatagttcttgttctatgagtgatagcgtgcaccataataatcaaaaactgcttccttgtgccaccaaaagagtgttaattcgtgcatccacttagcatactctttcattagagtagcttggaggtaccaacgagagatagaaatgcttgctcaatcacatcgagttagtgattagaacactgatttgacggtgtcatggagcttctaggtccattataatttctacattgaatgtatatgtcagatatactctagatttagcaaacttctagttcacgatgtcagtcatctttaattaaaattcccgcaaataattccaatatattttatgcaattctatatattttaccgcaaagatattaattaaaaataataaaagcattacaaataataaataatcataaatgtgataaataaatttcata

SEQ ID NO: 45365 - DNA, 411 bp, Oryza sativa
  unsure (1)..(411): unsure at all n locations
cggctgcntatgtatgctggtgcaccgcccggcggncgatcttaactagtggatcccccatcaagcatatagccactagctcaaaaccctatacaggtctggtggtatcggattccgtaggaattactctcatctgctatggggcccatcagctcatccgattctttatatgaatatctcgacacttgcaagatcaaacccaagcccgcatctcatcaaccttaagacctacatcggagctaataaaatcgcccaggacgtcgagttcgtcgacttagttcgcgccaccacagttcctgtaccatgggccaaacgcggatacctcgtcatactgtgtcttactccacaaacagggacctgcatgtgctgactactacagaactgtcatgacaagggtgagcctagtaaaca

SEQ ID NO: 45366 - DNA, 1501 bp, Oryza sativa
tctcccccccacacctaatctctctttttttcgtcaccgcccctccttttctctttttcttcgcctctctcttcctcttgccgccgctaccgccgctcgcttctctctcccgtcatcggcggccgcgaggacgacggggagggccgctgttaacagtgaaaattgccagtgtgtgtttttcgcgtcaacagccgcctccctccctctctctcgtccccgctcccacccaccgccgtccgtctccgcactgacgacactctctccctttctcccgtcgccgcccgtcgcatcatgtcgtcgccgtcctccccagcctcctccacctcgcggtcgccggtcggaggtggcagaaccgatgctatcgtgggcagatctgcccccctcccccgcagccggatcgggatggagcggcgatgaccgcgctgcatcgaggagacaggggggcactcgcctttgacagtgatggcgccattgccttcttctctccctctcgccgccgtcgttcgcctctccctctccctctctctctctctccctctccctttccctctctctcccatcgctaatggtgattaggatttgcgccggtagtggcggcgcggcggatgaggacgaggagccgacgtctgctggctgtcggggtttcgaagcactagggcgagggtacaaggggaaattccggggtagctttgggcgccttggccacgagctccccacgcgctcaacacggcgcttagcttcaactccccacgaaaaagtaggctaggcgtggagagagccgcgtccacctgcgatgtgccgcgctcccctgctgggcgacgatgccgggtcaaaaagcaacggagctgaacggcgtgaatcggaggaacgacccagggacaccgattgtacatgctcttagaaccgcataatatttctggtagatcttttcatccttgggcgggccttggccattttgtattctcattcgtcacacgatgaacggctttatgcttaatttcctcatagacgtaagattattctattctaccgcaactgagttgcaagtcattcatatcatcatatgtatccatatcgcaagcaaattcaatgaactgggacaacgagaaaaaaaaagttaagtatgcgaatattacagctgctagctaaatgaacatacgatatggataaaaaatactctctccgtttcacaatataagtcattctagcatttcccatattcatattgatattaatgaatctagacatatatatctatctagattcattaatatcaatataaacgtagaaaatgctagaatgacttaaattgtgaaacgaaggaaatatattataatataacatagataaaatattgttattaaaaaatattaatatttgactatttcctaatactaaaaatatattgggctaatttatatagattttctagtgtcttacatagattttcctagtgtcttacatagattttcctctcggacgaagaacagtgtcacgtatg

SEQ ID NO: 45367 - DNA, 574 bp, Oryza sativa
ctatattctaacctcgagttaataaccaacctggggatggaaaagaaaaacaattaaactgtgttgggttaaaaaagccaacgagacagtagttgaggataggagtttggatacgccttttacagatcaagataaggattgttggaggaaacccctaagggtacccgccatgcctctacattgataagaccgggtatacctgccaacagttaaggagatccaggagatatcaatatttgagaacataatagtcgatggttggtaattagtttatttggtatcagaaaaatgtcaaaggtgatgtggcagaagaacaatttggatgctccccatctcgaggaagcactaaagatgatcatcggcaatcaaaccctagtggcatggatacagatagcaagcaatgtatttccctgaaggcagtcagtacagcttttgacgaaccacatcaaggttccactgaaaggcagcaagccaaaggacctcatcatccccagaagcgtccgcaatccacattaaagaataccacctgttagagataagccgaaagatgattgataaaagaaattggcaaaga

SEQ ID NO: 45368 - DNA, 234 bp, Oryza sativa
cggggggaaacaaattgcccgagacaacgtgcgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaagg

SEQ ID NO: 45369 - DNA, 1501 bp, Oryza sativa
tcatcccgcaccttttggcctgtccattccaactgcaacccacatatttctcttgcacacgtagtaaataaattactctctgttaatatctttttattagtaaataaattactcggaatccaattcattacttctttctgtaaatggattactctcgagttgttttcagccgttctcaattggttccttctctcagtaaatgaattactgtcgggttgttctcattcattctcttagtaaataaattactattacaccaatctcaacataacatattgatattgccaaaaaaatctcttagaaaccaagttactattacaccgatgattctcaatgtctcttagtaactaaattactattacatgcacgaatccaacaaacaagacggcgctagtgccacatatcgatgttgagccgacaaagcactatagatccttaggtctcccatcgacagatatccatcacccacgaacatctagagaggcatcccacagccacctggatatagacaaaaacgattacatcatctaagagaagtctttaatttacactcataaatgactctaaatgaaatatgattcgccgaagaagaaataaaatgcttcataaaaaattgagctaccagtttaggttccttcatgcctacttttagccaacagatcattttttattcagactagcatggaggtcacattatgttttcttaacggtagttcctgggcttgcctagtcccgatctgtaatcgatgacattgtgcaaaaaacaaaattaagaatgcagttggctgaaaaatgtagaataggtaattgggatgcttcaggctaaaatatccagatatctctgattaataacatacaagttaaaagctacacaaaacctgccatcttttcagatgaaaaacgatttcaagaataaaaatggaccgaatgttcttaatgaaaagaataatcataaattcagaatgatctagcattcactacaaattgatctacaatggatcgatggaacatgcatgtatgttatacagcgcatcaacgaacacaagcaatcaccacatatctggagcccgcaaataagctgcaattaactgatcaaacatggcagctatgcttcctcaaagaaaaacaagtagctattgcctatagagattgattgagtagatagaacatggagagaaaataaaacaaattaagcatcctgactttcattggaacacatacgaattgaacatccatccatccatcgatcctgaccgccatccccatgcctgctttgcgtggccagggtctccagcgcctgctgccgaccggcacgagtgcagactgcagaatgtgaaggaatcagaatacaggagcaaattagcagaactgcagcagcaaatcggtaaaacaacaaagatgcaaagtaaaaagttcaaaattgcatggactcagctgcttaccctcattatcatcgtgcatcacagatcatgacgccaccgctgtgggagggaggcagcga

SEQ ID NO: 45370 - DNA, 577 bp, Oryza sativa
tttcaccggatatgtgttttttcttcttgccaagaaacggatttggcttttgtctttatcaaatgccatgcacattctcgaacgatgattatgaaggttaacttgtcattcttgcatgtaatcgattgagtgcgatgacaagttaatatatatacttagattccaaattttcatgtacttaattatattccgaaatttcgatgtatattactcgtataacccaatcgtatcattatataccttattaatgtgtaccaatcacattccatgcatagctaaacaccagtgcaaaatgctaaaatgtattggtcaaattttttaaatatataaattctgtaatttgaaagtgcaacgcgctaatttagatacgtgtacataagcctaccgtactactacacattactcctacttggtactgaaaatttcaaataatcggtttccacgtaatatactttgcatgtgtgtatccacgtaaaactacaattttcacaacccgaactgattatatacctactttacacataacccagcggatttgctataattatgtcgatagatttttttcgttgattacagt

SEQ ID NO: 45371 - DNA, 1501 bp, Oryza sativa
agacatcaatataaatatgaaaaatgctagaatgaattacattgtgaaacagagagagtacctgattgtgatgttaggtaccaatatctgactgtgtggagtgctgaagatgtgccgatgaggtgccgacgccagaatcgctacgagaaacgtgtggtgtcgagcgtcgaggtgccactgagatatgccgaaatcgtctggtccggtgtcacgtaccgaggtgtatatatatatatatatacacgtaactaacttgacatgcatgcataaaagattatctgggaatcggaaccggtgttgaacttgggcattggctgcttacctacgggactgtaggggcggagaagaggtgtaataatctaacggttcagaatattgtacccatcaatttaagtaaaaattaatagatagatatcttgattttttttctcagaatttttaagatttcatctaatttattagagcgtcatgtggtagctcaagagtgttttatggaagtttaatgtacttttagtgtataactaggaaggaagcccgacagttttatgaaaacaatgctaaaaaaaagtcatatctcaccatttataaaccgtgaaatagattgtagactttaatatatttaagtaataaggttttctcctagaataaataaaatcactttgcctccggttacatataaatttacttgttgtcatttcaacctattataacggtttaaaagccaagtatctattcataaatgaactacataatataccaataaaataagcttaatacatcattaatacattaaaatatccactacacgtaatctaatgatcaaaataatgggtccatcaattcaagtgaaaatcaacggtacacatatagatttaatctaatggtcttaaataatgggtccaccaatttgaatgaaaatcgacagtgagattaaatagtgccacatggcggtttagaagcgtttataagaacatcacgcggcaccttgggagtgtttgtaggaagtttaataaacttttagtatataatagatttgaatgaaaatcaacggtagattaaatagtgccacatagcagtttagaagcgtttataggaatgtcacgtgacgtattgggagtgtttgtaggaagtttaatgtacttttagtatatataatagatagatagatagatagattggcagtgatcgaccttgtgtaagcttgcaatagaaatttctacatttattttagcgttgaattataccattaaactatcttagtgttccattgaattgttctatcactcgttatgctagctgacatcacttaatttgtattcccattgaccaaatcctggatccgttcctggcatatatgctatctgttgattttccgccgcactaactaccgtttgaaccccttaggtgtgactgcacgagtgatttgactgagccatgactaagccaagcatacgatagtgaattgagacgttctagtggctagtactagtgtaatctccat

SEQ ID NO: 45372 - DNA, 492 bp, Oryza sativa
ttattgtaacaaccccaatagtattttagttttttaattgatctacctacttcgtggatcagcgtggaagaaattttctactagtatattattttaggagggagggaatagaaagtttcttgtataatggaagtcaccaatattaagcgaaccggcgtgacgaaatcccattattgacactgattaagtgtcgtgtcatggaattaacagtcgcattgacgaagtccctaatctagaatcagaagctaattccggcccccggttctcatgtattagctattcgctgataaaaagtttatcgcgcgctatgaattttgaatattcctcgatcaactgattattctcatgtttgaatgagtgatttctagagccaagaatagtacgattccgtgtgtaatcggaaaaaaaagaaagaggaaattatatttgagctatcgtttattgctaacactggtggagaaactctttgtagtcccggtttgtaaccccctt

SEQ ID NO: 45373 - DNA, 890 bp, Oryza sativa
gctttagcaccttagtggtgtgataggaaatgtttcaaaaggtatagatggctacagaatttagtggaacatatagcgtgtcaagaactcaagacaatgttagttacttatctgcgctcctacatttggaagggctatggggaacttgagacataatttcaccagaaaaagtgctttccatggttttagataatatgccaggctagcaaaatgctccatcgattctatgcgatatctcttcaagaaagaagttatgattgaaaattcatcacattgatatatatctgcacttttgtagtttgaagagggagtgacccccagtgcatatgcctttgccttagtggaacagcggggtggcagagaaacgatttctctaaggacatttgtggcaggtgaaataaaaaatcttaatgtagcaaagcctgtgagctgttctaggctgcagcgtattgcttccattttttcaactacagagagcttcctctggattttaaaggtgagtttcaactgctaataaagaatgcctgagttttcatgcttgcataattcattgacaacacatatgaatatgctattttcttttatggttaaaattgtcagatttgcagcttgtctaccataatgcgagaattctcgggcatgcactctgtagcatcacttccttttaaggatctgattctttcagctagtgagaagaacagtggtgggaatgatcaaaaccgtgcttggaatgtccctgagccacttatggattatcttaaaacaaaccttaatgattcacaactagatgcagtcaacgtgagcattattcttaatatccttttttgttgctcaatttagttctaagaaaaatcagatgtctgattgatcaatgcattatctcttgcagg

SEQ ID NO: 45374 - DNA, 1305 bp, Oryza sativa
tgttgtttcaagagtgctatgtctatgaggattttttttcgtaaatcaaacaaaattggcaattaatagtatgaggatactaaatttggttgttagtgtcatgatgttttatgttaggatcctccagatgcggtagtgcaacttttgtgttaggagaagggataacatgatggtcatataaagggtcaataatatgaaagggaacacatctggaggataaacacatgggttacaatctaggaggagaagaaccgttgttggtaggttgttcatgtgtcatgagttacaaagagaagattagcattgcagttttgcagcctgaaaattttatggaagagaatgttttttccatgatatatttttggaatcaaccagcaattgaatttgtacctatggtatttttttcttaacagaagcatccatgtaaataagtgtttaaacgctggaagatatggttacctttgtgttaggaatagtgtcttcaattctgaatccatttgtagtatgcaaaaattacatatgaaagttggacaatgcctcagacggtcagacctggtcacatagatatagtgatgaatcagaaggcatcatcctgctattggcgtgctccttcagctctgaataatcggctctgaataatcggcaagttgagcaattttgcccagtgccagcgacctccttctgttctgtatttgggctgcaaaattgacgatgatggtgcttaccttcatggattagaaaggcggtggtggtgcttacctccatggcgctgggcacagcaagggccacccttgataaaaaaaagtgcgttctttagcccgaagaggagtaggcgatgtgcagctggactcaacctggtgccccgacatacatacatgtgagggagatgaaagtggaggggaagtttgagaagatgggcgacgatttgatagtcggaggaaacggattcgatggcttttatgcttattgccaatgatatacagatgtgagaggaaggagatcgaagtgtaaacgaagggatctgggtgaatggggagggaacgacaggatgtcgtgatccctcaactactacgcacaacagcgctgggaggaggagagtcgccataaaatcagcaaagcaagcggcgcggtgaatggaagaggcacgacgtttgcgcggtggtcgcgcttcctggctgcccgccacgatcgaggaggagagcgatgcgggagaggggagtcgatgcgcgtggggccagcgaagcagcgagatgcgagagaggagaggtggggagcgatgcgcgtggggctggcgccgtagcaaga

SEQ ID NO: 45375 - DNA, 1501 bp, Oryza sativa
tcataaagtaagtacttgaatcttgttggtctaagtttgatctctgttcaagaagcagcagtgccagcaattttcagttttcagcatcaaaaagcagtaccaagcagcaaatttaaatttgtagcagtaattccagcaagaggagcaataagttcaggcaaactgcaattgtgacacagtcaattcagcagcatatatgtgtatttcatctcagcaacaccaacttaagttccgcagacagcatccaccagtaacaaataatcagcaagcatgcaccagtaataaatctcgcaagaagcatccatacaaaatgcacacaaacaggggcatcaattatgcaaaccataccactagaattgactgatagacatattacatcggaacttcagtgaacagaaacacacaaacatcagcttgctcgaaaagattggctccaaccaaagcattccatccagttgtgagggttgctcgcttatccttgaatttcatcagtttcatcggcatccaaccatcgccggcctcccgccgatgcagcgccgccgtcgcatcgaggccgttgccctccgaccctgacgaatcgccaccgccaccgatgcagcacagccgtcgcatccagacagccatacccgccgtcgccgacgaatcgccgccgccgccaatgcagcgcagccgtcgcatccagactgccgcgcccgccgccgttgacgattcgccggggctacccgatctaggccaccatcgggtcgccagtccaacctgctcccgccgccatctatcgctgccatgcattctagggtttctttctctcgctgctctagcccgtcgaatacgcggcttctgttctctcgccaaacagagaaggaaacagagaaggaagggatgctgcgtgcgtgatgcggaatagacgcgaaagtacataactaccctcccacccacggtaccgcttcaaggcagaggtgcggtaccatgaggtacagatgatttttgaccgtccgatgaggcctgatcaacggtcacgatttggtactgcacagcctcaaggacagtaaaaatgctctattttttaacttcatttatcacgggagtcaatccaatccgccactacctacaccactttatgagtcaaaattttactccgtacacatcaattttagcctacaggcgtgtcacgtgtcatccgagatcatcaacacgtcgtttcgagtcaaattttaactatgtaacatccctccgtgcccacccatgcttcatctaccacatggattgagttaattaatcgtgcacacctctcaaattagttaaaatattgagcaattttacggtccttgaggaggtaccatgaggtaccaaaaatttagtgtaaaatttggtacctcatggtaccaaagtatcaagagatactaaatttacaatagaaaaagtggtacctcatggtacgtcctcaaggaccatagaattgctctaaaatattacttacggttccacttgagatggtgggaat

SEQ ID NO: 45376 - DNA, 289 bp, Oryza sativa
ccgacccggcccaagaggaaagggggggaaaaagaccttcttttaagattttctttttataaacctttttaactttgtttatttcttctcaattattatttgtgctctgaaaattccactaaaatttgagggctccttttagaccaaggagaatttaacaaaaattctccgggccacatttgaatttttcttgtacgtattttagggtttgccaattcttttcgaattttaattaattctattattccttttagaagatgatttttattttgggatgaatttatcagga

SEQ ID NO: 45377 - DNA, 1501 bp, Oryza sativa
agaaaacatccctgataagctcacagacgcgataatgaagaaggtcaagagattcacttacttatcggcggccctcttcactaacctcctcttcagaggaggggggaggccaccagtatcctgagtaaaacagcagatcacggctttacttcatcatccaacgaaagagaaaaagacaacggaccgagaacgatgggccttaccttagatccgcggacttctgtcgagatccggcggaggcgcttgaccgagcccacggcttcctcttggtcccactcccccatgcggtgacagggacagagggagcagcggcgacctcctccacaaccttctccttgagggaagcggaggcctagtgatcgacaaggggaccgatgacgtccatcaatggcaggacctgcaggagttgaggtcaactcgatccttcgttgaacaaagaagcaagaggcgttcgttctcactcacattgatggcggcgaccttctccacttccggccggtcgcagataggagtcgggatctcctcggccttggaggcggaggtaatcaccacattccccactcgctgcaccacggcgtcgtcggagagcgctgcggaaagggcaagtgattcaagttaggtcagaataccaagataatatttatgcgagggtgagcaacgatgacacaagaacgagtaccccgtgacgagatccgcgtcacgtcttccgtccccgtgtagccgaaaatgggatgagcgcgagcttgcagcagctggatccgacggctgacaaagtcttgagtgacctcatagccggtcagcccatgctctcaaaggtcgctcacgatgacaacaaaggctaggagggaaggagttagaaggggtttggaggtctagctatcagaacggtcaggttgattctcgggcacaacaagaactggatcaagttccttacgcttgatgtaaaaccacttggaccgccattggccccgagatgagtggttctggaaaggaatatatctcgccttcatgccgtcacgaaggcggaacccacaacatccagacactcgggtgccctccatccaacggagttcgtaaaagaagcgaaaaaggtagatgaaaggcactaccccaatgtaggcctcacaaaggtgagcgaagatgcttaggaaggcgatggagttggggttgagatgcaagagagaaagaccatagaagttcaatatcaacaaaagaaattccgaagggggaggtaaaaaaccacaacggacgaaatcctctaccactaccatgcggcctagaccaggagagggttcagtacctccttgttctctcgccatggtttgcttgggagggatagccccgtctatatagagcttcttcagggaagccgtatcggaggaagacttgctgaggtccgccatcggatgaggatcaccaggggaggacgaaggaacctagggaattttggggaagacgaaaggtttgagactattggagaattggaagattttttggcaaa

SEQ ID NO: 45378 - DNA, 1501 bp, Oryza sativa
caaattcctagcccaaggaatatctaatctaacgtggctacgtagaaattgacatcgtcaagctccaaaaatggtaaacttggtgattctggtcggctaataattgagacagagagcaacaacatcaacaaggcattcttttgtttttcttaaaaagaaaaatcatattcagggacccaaaactatagacaagatcattgcatttgggattaacaaaagcaatagaaaaataaaatcagggaaggtgatgaggaggccaacctttaatacagtcgagccaccagtttcctgccctcctcctcgcatccatttttgcagcacattgctgaaccccaccacgaacagctcaagtacacagtcacgagaactcgtggaaaaaccgggctaaatccaacgcctctcctgagtagaaaaccgctaccgctcggcatcttccttcttgtttgattcgtgagcagttgggttcagccttccgggctcagttcagtctggtgagatttctcttctcctgcctttttctcttcttttggtgcccaattcggttcttcagagaatcctttgctttggccctgtagatctgccttgggttgatcgtagtaaaccttttcctctctgtttttatctttcttgcaaagaatgtaagatttcagtctgctgcattttgcagagagacgagaaaagggctttcctttgggcgtgttcttgattcttgctttcctcacctttctgcgctcacaaatgacatgttgacattttactggaacgaggtaggccgattgatatgtgctaccactttgtttatgcaacctctcggaaggaatacatcaacaggcacagcttttgctcaactagagtgatgctgtttaatttagaagaaagaaaaggctccatttgccatttctctcttttttttggtggcccctttcatgtgctctcatctgatcaaacacttgtttattgtgaaagggaacgctagatctgtagtgtgttgcatgattattggccttagtggagggttaggcaggattgatggttttaatgccataggaaggagctctccatggctttagctttcgtagttaagcagacaaattcctgtgtgtggcacacaatagtgttaagtgtccatttgaggggaggttgatggagaagggtgtggactgtggaggccatttcttgatgtttagttttcttgactgaaaccaaaccattgattgacttgcctacttttaaatatcttaatcaggtaattagtttgttgttggccactacatctcttttgtttgtttggtgaatctttacctcctagtccaatcatggaatgatagttggtttcatgaatgcacctttgaatttatcagatttttttttctcctttgcagatgtgaatggaagtttcatcactattccaaggttgctattttgattaactatagcttgtggcagtatttggccatcttgcctgataaataaccagtcatggcgacaacggcttcaaaga

SEQ ID NO: 45379 - DNA, 887 bp, Oryza sativa
tgtgtcgtatcttggtagccatgttgcaaagccataggtgcatcgctaaattcctactggcctatcgtttgccgtaccgagtctttgccataaaccatgtttagttttcggttgttgttctgagccgccgctttgttcgccggttcggttgaccgtttggatagtcccgtgtcacgaaggattggctcgttgagtcgttaattcgtgaggcttgcttaccggaggtttattttcattgatctttttatctatgggcaataatatgtaataaatgactaaggtttttcgattattagtaataacacagctcatcttgtaaaattcataactaataatttgagctccgttttaacccattcaaattgcagtgaatccgttaaaatgaacagaatccattaaaatttgtttctttttctgttttagtagccttattgcttgtatttcttgtgtgctttgtttgtcgtttagattccatcagttccagtgatccagtttacttcgaagtgattgccgaggttcagtcagctcaagagcaaggcaagtcacgcatacatcattgatcatattgagccaattttacaaaatcccttgctttctatcaaatggcattgttttagaatgtcatgtgggatggatgcctatcgtactcagtctattgaatatcttatgccattgataacttgagttagatgattggtttaggaatgcttagccatgcttagatcaattagctcacaatgggactcattataatttagtccttaattatattatgatgtagcaccatggttatggtttaataaaactaaaatatgctttaatggtgggttgtgggtacatgcatgattttggaagtcatgcccttgacaatttcatgtgaccatagc

SEQ ID NO: 45380 - DNA, 1501 bp, Oryza sativa
gtacaaggtcgagcggctatggacgttgtggttaaatagaccattagcatatgcatgtgtgccactgtgcagctagttaattatccaaaacggcacccaacgggtgtacgatgtgcacgattggccaagctattagcatagcatggagtacaggataacaggaacccgtcgatcaaggtcaaggcgagattattgacgccatataaattttaatcaccgtagggcgataggccaattgtcagctacagtattaacgtagttaattacctcctctctccaccagccgttgcacaattgcatgacctgacgacggagcaccttaattattccttggctaatttacaagctcacaagcagagtttgattccgatttctgacctcttaatagtctttttggaatttctgctatgacgttcggggttaataccggagacaatattattacttatttgggaaaatccagaaaaataccatcgacaagctttccaatccaaagaaatacattttttttgcgaacgccaatccaaagaaatatcatcgacaaatttaacttcttagaaattaatgtcattgtacaaatgtctttatcccataaataccatcgctgttaggtttccgttagcaatcatttgttgagtgctataaaaagatcattttacccctacgaattgctaaaagatgattaaaaattttgctcttttcataagcttagactaatttctaggtcgttatttgcactaaactgttgttagttgactcgaagagcaaatgttttgatgagttttcaacaattcgtacgggtaaaatggtctttttacagtacttaacgaggatctactaatagagacctaacggcgatagtacttttgggacaaatgcgtttgtatgatagcatttccatgaagttggatttgtcaatgatattttttgaaccgtgaggcttgttgatgatatttcttgaattataacaaaatttcattataccgattacgaaccccaagacgaggctaactagacctgaagttcatataattaagtatataacacctgacaagttatgatcaaactactaagtccagagttttatctagggagcacacgcagtacgtgtgcgttggcacatggatgcaggcatgcagccgcttaattagctaggtacagtactgttcttgatggcatcttaagaatccataacctcacaacgcaacatttcaacccctgcaattactcaatcaacagttgctcccccattgaataagctgctcctgccttgccccgttgagaggaggcatgtgcagggcacatggttgatcagtatagtgcactgtcaaggaagcatcctttggaacggagacctgtcactgtcttcttgtcaagtccaaagtttctgcagcgccagtgagagagatttgctatacatccatcatccatgtgagggaatacatgaaagtgtaacgctgaagagaaaaaaaaaacttaattaacacgttacattcaaaca

SEQ ID NO: 45381 - DNA, 1501 bp, Oryza sativa
cctccagcctccatcttcaagggcgtcttgggggctgccccaacaccgccgcctgcggcgcctgcagcgcctgctgccgcggcggccgtgccaccgccagtggctgctcggcagcctgcgcaggatggggactggaagccgggccgtcgtcggcgccgccgctggcctcggcagcgccgtcctggggcctccgtcaagccttcctccacggagacgcgcaccggtattccgccggagctgtaggaccggtgcctcaactgcttgtcgtcggcgcaccagattgcgacctgccgtctcccggtgcgttgccgtcgttgcttgggtctcaaccacctcgctcgcgactgcaagcgtcctcgcagcccgagctcgccatcggagcggcagggcggccgccgcgtccttccgcgccgtgcggcgtcgccctctgacgccacgccctcggcctcgcaggcctccacgcctgtgggttcgccggtggcggctcttgccccttctccgcctcctctctgcttcagtgcgtcgccgattcgctcagaggacgagtcgctttgtgtggtcgagcgctcgccgcagctcatagaggaggagggccggctccggcgtgctctcttcgcccgggtgagcggcctggacatggcgctgtcggccggcgatgccgccgcggcgctgtcggctgctcttcacctccccgcaggccgcttctccgtccactgcgcgcagcccgatcacttcctcatcgtcttcgctaactccggtgacatggacctcgcgctctcgcgttccccgatcccggctcccccctaccagctgattctacgaccatggacccggcttgtgatggctacctccttctccatgccgttcagggtgtcgctggacctcgagggtgtaccggcacacgcctggaacgcgtccacggcggcggccctcgtcgctcccggtcgtctcatctctgtggacaccccggcgcgccccgacgagtaccggtttcttcgagtcaccatctcgtcgcacaacccggccgccattcccaaggctcgtcttcttctcattcccgagccgacgttgggctcccagtgccttctccggtatcgggtccttctccacgtgctctcggtggtctgcctctcggccccctcggcgtctggcgatgtcgacccggccggtggcggtggtgctagcggtgagggtggtggcgctgcgaacgatggtggtggcgctgcgaacgatggtggtggcgacctcggcgctcgttcttcgcgaggtttggacgggggtagtcggcgcgatggcagccggcgcgacggtgctccgcagcggcgctcgtcaggcgttctcagtgatgtgcgccttgcggaggtcgctggcgcggaggcgcgctccccggcgttggcggcgtgcccggcggggtctgccgacgcggcggtgcggttcccagtgctgccagcgtgtccagctgtggggcccaccattcaaacggcttcacctgacttggtgc

SEQ ID NO: 45382 - DNA, 1501 bp, Oryza sativa
aagcaaaaagagagtggtcaaaaggagaaacggcctcaaaaggagagatggccacagccgcagacgccaggggggcaccaagtcaggtgaagccgtttgaatggtgggccccacagctggacacgctggcagcactgggaaccgcaccgccgcgtcggcagaccccgccgggcacgccgccaacgccggggagcgcgcctccgcgccagcgacctccgcaaggcgcacatcactgagaacgcctgacgagcgccgctgcggagcaccgtcgcgccggctgccatcgcgccgactacccccgtccaaacctcgcgaagaacgagcgccgaggtcgccaccaccatcgttcgcagcgccaccaccatcgttcgcagcgccaccaccctcaccgctagcaccaccgccaccggccgggtcgacatcgccagacgccgagggggccgagaggcagaccaccgagagcacgtggagaaggacccgataccggagaaggcactgggagcccaacgtcggctcgggaatgagaagaagacgagccttgggaatggcggccgggttgtgcgacgagatggtgactcgaagaaaccggtactcgtcggggcgcgccggggtgtccacagagatgagacgaccgggagcgacgagggccgccgccgtggacgcgttccaggcgtgtgccggtacaccctcgaggtccagcgacaccctgaacggcatggagaaggaggtagccatcacaagccgggtccatggtcgtagaatcagctggtaggggggagccgggatcggggaacgcgagagcgcgaggtccatgtcaccggagttagcgaagacgatgaggaagtgatcgggctgcgcgcagtggacggagaagcggcctgcggggaggtgaagagcagccgacagcgccgcggcggcatcgccggccgacagcgccatgtccaggccgctcacccgggcgaagagagcacgccggagccggccctcctcctctatgagctgcggcgagcgctcgaccacacaaagcgactcgtcctctgagcgaatcggcgacgcactgaagcagagaggaggcggagaaggggcaagagccgccaccggcgaacccacaggcgtggaggcctgcgaggccgagggcgtggcgtcagagggcgacgccgcacggcgcggaaggacgcggcggccgccctgccgctccgatggcgagctcgggctgcgaggacgcttgcagtcgcgagcgaggtggttgagacccaagcaacgacggcaacgcaccgggagacggcaggtcgcaatctggtgcgccgacgacaagcagttgaggcaccggtcctacagctccggcggaataccggtgcgcgtctccgtggaggaaggcttgacggaggccccaggacggcgctgccgaggccagcggcggcgccgacgacggcccggcttccagtccccatcctgcgcaggctgccgagcagccactggcggtggcacggccgccgcggca

SEQ ID NO: 45383 - DNA, 1501 bp, Oryza sativa
agaggcgccgtgtgccgtaggcagcgaggcaggcatacatgtgactgatggatcatttcatatagatgatgccattagccattaggattaggaactccttttgattccaccatgatcaatctgtcaagaaacaacacaagtaatccgtgcttaagaaccctgaaatatcttttctttctggcaaaattgcatagaccactccaattgttaatctagtttcgatattttaccttataacctattttgttacaaaagcacatccatctaaggctgctaggctgaaattgttacctccgtacacataaatagttgattcggtccatttctttaaatgtggattcactaccgatcaccacagatgatcgcctccatgcttacccctctcatcgttcacagttaccttgccacttcaaactaacctgggaacaagctcgagtcagactcacctcatagccacgttggataaaccatgataatgaccctctgtgaatccacgttgaaagaaatgagccgaatctagtactcacatgtgtttggtagatgggattttccaacaaatcgggacataggatgaaatcttaaaattagggtggtttgcaattttgcatgaagattaaggaatagtataccgttggacaatagaggacgggatcacctatacatttgtcgacaaattttctcctaaaaatttaacagatataattatagtacaattgttatgtaattatactgtaacttacatgtaacttgtatttaactttcaaaaatctctccgtaacatgctatttcggtgaaacggcagtcgtgggaacaaatcctctcatatatgtgcactcggtgacgtttttccttctttacttacacaaatcttaaaacatatctaacagttcaaaattatgtgaaagttacattgtagttgcatgcaagttatagtatagttacactacgatcgtacagtaattacatctgtcaaatttttaggagaaaatttttcgacagatatatagcaaaattgtttcaatggtatatatcgccctctagtatttcagtttctttcaacaaggcctcctaaagtgtaaaattttaacaaggcccaatacaatggtcgaacacgtcaggcccattaagcaagaggacttgtagtagactagtagtacatgatttccttctagcaataaatcagaaaagcatagaatccaagatactcctataccaggaatgtacaaataatctcagatcaagaatgcaatctaaaatatcacagtacgagatcatgtaaataacaatcgattgatcgagtaccatatactgtatacgttgatcgtacgtaatcacggcaaaatcgaatcaaccaaaaaaaaagatacaaaaattcagtaccaaaatctaacgctcgcaagtacgtacggcacacaccacatgttggagaatatgaacgtacacccacagatcacaaccctgcacgtactactattaatcatcgatccataataactagcag

SEQ ID NO: 45384 - DNA, 1501 bp, Oryza sativa
aattttgaagttgattttgtattttttttaattgtggtttattttacaacatttacttttgtatcactaaggataagtatataaaagttttacttataccttcttttttctaataagcggtatgaataagcagaggataaacgaaacgatgggggtccttagtccaagagaagcaaatatagttgagtgcacatttaggcttatgtttctttcatgccacaaaagtaaagttttatatcctaacatgacatccatacaccatcatcagaatttagaaaggaacccaaaacaacaaaaggaatgccaatctccattctctgatagttgcatttgcgcatgcactgctttgctattctttggatgataatctgaaaaaaaaaatctccttttgttgtttctcttttttttttttgttctagtggccaccccaacaattgcaagctttggttgggcaaaagatgaagatcatcatcaataatctacaccgaatctgaaagaggagccactcgtttgctccaagtgtcaatctctaagcaggccccccaaaactggcctaatgtgcttttccttggcacttaaagtgccaagattagtggatcataagagctcttggaactttcttatttatatatatatggtgaaaaagttcaggcttcagaattcagagtggggtgtgagtgtgtcagtgtaatcatccattggcccatcaaagagcctaatttagagagttggatgtgatgatccagtgacttagtattggagcatcacacacattgagtaaactttctgtagtaaacttaaatgcaaaaagaagattgaaaattgacacagctaactctgaaaatttcagtttcagactttcagtgtgggtgcgagtgactgaaatatttttcaggcaatgaatgagatcaggtctagctaatgaagcacgactgtttctcaagccaacacaaatagaaacacaacttaatctcgtgttatccttcaaattaaataaaaaaatttaacttgattatgctttccttcctttcctctgagatggatccaactgtgtaacctggtgatgtcaatgccaatcaaaccatgtcgcagtgcatgcacgtatgtatcagattagcaacagacaaaactaaagttggcatattggtacattcttttttgcaaaataaataataaaaaataacttggcttgtacacactggtgactgcgaccctgaaagagaaagagatgtgatggccaaatcgaattccactaattaacggtgcacacgcactcacgcctgaaaattcattccattccaagaaattggaatagagaattgttcttgtctgacaaagctgcaactgcaattgggcgtctcaggattctgactgttacgtctgaaccttcatgtcctgttagtttccgcatcaattcctgaacgaatgaatgacagtgctatccacaactctgtaaattgcagttactaccaagtaaatgtctgaactctgaatttacagt

SEQ ID NO: 45385 - DNA, 1501 bp, Oryza sativa
ttacggtctgccttttatcatactctacatccttcttaattgatcagtatagctcttgcccttaccttaaacataaggtttccctttgaatatgcaaatttcatcatgaatccctgatcatggcgacgatagcttggttgacaccacacgatagtaatatctacggatcatattgcttgcacaagcacactataacttttgcttaaacttgaatttcaaacttgtactaaaattactacggaatattcatatctagatcggtaataatgaatgtggaaatcgttgcaaatttcaaaatgtaatttctatgcgagtactatcggccacaaaattcatctggccttgttgtttctaaggaggacgaggaaaaacagctcctggctccatttttttcaaagaaagaatccaatcagttgtacccaattgggcagacaatgagataagaacaacataatctacaatagctcgaagattttggtttcagaatatatagggcttggatgatgtgtcagcccaccacctaaaagcagtctacagggaataaaaaacacgaaaatgctatacgtccgaccgacgcgtacaaacagcgtacgactacgtcattggccatccgccgtccgtaacttctgcaacgatcgctaattcaattgggtttacgccgtgtatttcgccgttgagtcgtacgctggtcgtacacgtccgtcggatgtatagcagcgttgaataaaaaattaaacccccttgatgatggccaaaaggcacaatttcgtgcatggttgctgtctatggcatagactggaaaacctttcgattattatccaaaaggaagttgatctgcgtagccaatatatgctaccctgaaacaacagacggcttagatttgttagtaacagagcaactgcaataattgaacaaccctataggctatagctagtagttaattcatgccgtggccttacgaacgtctatacgtacctggacaacaactcatcggggcatggacagcgaccgaacaacatggattaattaaaattccaaataaaaagttaataaaataagcaatttgattacaatacaaatcccaaaagtaacataaagttttcactaaaattcgaaattgaaaaaaatacagtaattgtccatgtaaaatatcagagtacaagcaattaaatatctgaaatttggaatagtaaaattatatgtatattggaagctttcctaaactaattaaactaataataaagatgaagatgagtatttgtaatcttaaaagttagtgttgatagcgagagatgtttcttaattatttggaacgagaactatcatgaatatacaatcccatctttggtggtgaaagaatgtcccaagagatggtgaaaaaaaattccaatattagtctgaaagtgttggaatgagagaaacaaaataccttagatttttatatctttgagctattgtttgtgtttgctttatggacacagaaattaccatgctaattaac

SEQ ID NO: 45386 - DNA, 1501 bp, Oryza sativa
tcccatctaccaaacacatgtgagtactagattcggctcatttctttcaacgtggattcacagagggtcattatcatggtttatccaacgtggctatgaggtgagtctgactcgagcttgttcccaggttagtttgaagtggcaaggtaactgtgaacgatgagaggggtaagcatggaggcgatcatctgtggtgatcggtagtgaatccacatttaaagaaatggaccgaatcaactatttatgtgtacggaggtaacaatttcagcctagcagccttagatggatgtgcttttgtaacaaaataggttataaggtaaaatatcgaaactagattaacaattggagtggtctatgcaattttgccagaaagaaaagatatttcagggttcttaagcacggattacttgtgttgtttcttgacagattgatcatggtggaatcaaaaggagttcctaatcctaatggctaatggcatcatctatatgaaatgatccatcagtcacatgtatgcctgcctcgctgcctacggcacacggcgcctctccgtgacacacgcatcaaacttgtagctgaaaccatcagttcagaattgcttctccatgcttctcctaatctcttaatgttaacctcaattaatccaggaaatatcatccattcagtctggttttcatgccgtctttttcatgctagtatgtgcttatattcgttcccgttgacattaatgcattgtagtatttaacacagatgatcacatcaaagatagcatcacactctttttgtttctctgttttgctgtctgtctgttactctgttatatgcaggctgatattcctttaatttttctgtttgcttaatatgttcgtttgtgtcggcaagcaatttggtcgtatttgatctttggcagatgtgctgttctctagtgcaaaataatcatagtatataaactgcaaaattaacaccttaaacaatctgggtgtactagtatttctgtgtgtgtttgtcagagctgcaggttatcagtgatcacacgtcaaattgatcaactctgataatcagaatcagatcactgtacaggactaaaaatcatgagaatattacaaacacaaaccaagtatacacagattatcgtgtgtctctatcttgccttcttccctgttgaattctgtatggtcggcattcaactaccagtatatttgaatgtgtgatgtgacgttgatgaattttctacaaattaagaaaaaccaaaatgaatgtgctctagagtattccatgaatatcaaataacggtggttgttagcaagcctgccagtttgcacatctctcttatcctgcgttatcagagatataaataataaaattcgtccaaatcagacgtcgaattaatatattattttcccaattttctattcttcaaaaaagaagtaatttgcttgtaatcatcccatgtaatttggagaaacacaaagagaacaatacacgacaaaattaggataggaac

SEQ ID NO: 45387 - DNA, 1501 bp, Oryza sativa
agctggtcccaacgagaacgagtgggtttgcgatctcgattgaccagtgaaatttgagcccaacgagacgtcgactaattttgccacgcttcatcctctcatcttttcgcttatgcttatcagctaaaatttaaattttcaaccttaaatatttgattttaagatttctttttcatcatagtttgtttttcggcctttgcttttaaatcgttaagaacacgtatataaaagttttattcacaaattattttttatttgcaaatgtaacgttacgcttttgcttattatcaaccaaatgatgggtctgtcaatgaattttgacaaatcctaaacgaaatccacactcgagacgatgagaaatccgatcgaaatttatcgacattctgaaccctactactcacaagccgtatggccacacacagaggtattcctatttccgcatgctacgtttgcccagggttataattcaatgaaatccaaaaatgtggacttttcggatttggttaaaaacaaaaacctcttcattttttggatcaagttttatcggtttatcaatggatttcacgaaatccgatgttaccgttcttgagtggatttagatccgctatctgaggctgataagctaattggtgaaaatattttgacttttagtttattttttagttttacaattacagtttcttgtgaagatctacagagcttgtgagagctgaagggtgaaggctccagctccccaaacagccctctctctctctctctctctctctctctctctgactcttgactctctttcgctgtgcctgtgagcaacgctgttctcctccctccggcctccggcctccgctctccgcctcgcctcgccgcccgatccgcgcgtgccttctcctcctcccccttcgttgcgtgctcggcctccgcacccaccctccgcttcgatcagccgcagcccgactcccccctgcttccccgcctactccgcgccgcccgcctttggcgctcgccgccgcggtcgcccccttccgcggctcgtcgctgggttctcgtccagcacgcgggtgccggttgcttcttcttcttcctcctcatccggtcgccgcgtcaccaggttggtgtccccgcattgcctgctgcgccgcgcgcggtagatagattgggcactgtcgaatgggttgatttttttttcgaggatgagctgctgctattgcagtttctagatcgggaagctcttagaactcgattgctttttgctaattatgtcactagagcaggaattactttgacctaattcacccccctaaaccctaaacctttggtgtactttctaagttctaaggaactagggaagcgtagtgttagcggttgcatgtgctattattatctgagttagtaaagccagatttgtttgattttgcgatttattttttagtatgtgctcaacaccaccattgcagtatctgtagaaatattttttcatcattggctcatgtcctactatctgtaa

SEQ ID NO: 45388 - DNA, 1501 bp, Oryza sativa
atacaattcaggcgttgatcgattgtccccttctcgaatttttgacaatctaatcattttatacaacttatttcaaaaataaatatcaaaaactgattattttttttaaaaaaaatgacatcaaagtgggcactgagatacaacgtccgcaatgaaattgtcacatcacgagagctcgtccaaaatattttatgcaggctcctaaagtaaacaaagtggtgctagcagcctagcacgatggttcaatgctttttctattttttttttatttttaggtgttttctatttatcctccctcgactctactcgttctattattctttttccaaaatatcacatggtctgtttaaatttattttagtttgatcaaactgggaacttaaattataaataataataataataataataataataataataataataataataataataataataataataataaactatttagcccagtaactataaatttgtatttggttttcaacatggaaggaacaaatttgactacttaaattatatagtaattgtcttaataaaatatgtagctatgatatttgtattaataaaatatttagcttaatctgtcgacggggatatacatagatcatattctgagagtattggggtacatcgatataagtatataaatgatacgatattaaatacaccagaagacaaacattaaattcagacgactcgaaacttcactgccttcgctcgcacctttttgcgtcgccactagcagggcatgagctccaacgccgccgtcgccgggtgatggagctgtatgcctgttatagtaggtccaaacaaagccaaccaaacatccaagtcactagctatttccaacagtcgaatcgagtttagtttatcaatggaggtgccgatccttttcatctacaaggaaatcaagtagaggtggagccatacagagacatatccctagagcagctccgacatgctggtgtgcaggttcgggagggacatggatgtggagacgaaggacttctgagcagcagaagctttaggaaaaccggaaggagggagcgttgtacggcgctcgaattattattccgcacgcagcgcgtggattagcgctaccgggtatttgaacttttttttcctttttcatatgtgttggaattggaatctctggaccgaatttttttttatcatgccagcgacacatcaagactagttttgtatttgggccagccagtccatctctccttcactcttattaaaaattgtagtaagtccactttgattctcttaactagtggccaaatctaattcgaatcctgaattataataacggatatcttgacccccccaactattacaatcaatgcaatttgattcctcgacggttttggaggacagtttcgctaacgtggcctttgacttggtcaacctttttttactgatgtggcaagctagtcataaaatacaagtgaggcccatatgtaagccaactccaaggagg

SEQ ID NO: 45389 - DNA, 347 bp, Oryza sativa
ttgagcatgttcctcactctcgaaacataactgtctttcaatatagattaacagtgaagattagcaaagctcataagtaaacaccatattacagcaacagagaacagacaacttgcctgcaaatgctgcatacaacaaactatatctgcttggatgcccttttcttgcatttgagcttcaaagtcatcctgttgtataaaccactaaaagtgtcagctataaactactcatgctagaatgttagtgtatttagttgcaagtatgaaaggagggatggaggttgtacagcagaaggatctaactcgatgaactcagacgtgaaaagtttctttctgctctcccacagc

SEQ ID NO: 45390 - DNA, 1501 bp, Oryza sativa
caaccgggactaaagatctcagagggcctgacaaggtctgacagatttagaaccgcatctttagtcccggtaggtaacaccaaccgggactaaagatcaaatatgcccgctgtagtcaccaaccgggactaaagatgatctttagtcccggtttgtagtggaactgcgactattgtggatttcggccgaccgaccaaagatggtttctccaccagtgtcatcagccataatatcccccgttaaacttatgaaaaacaaggagaaaattaattaaagggctatcaacaaactgatgtaagtattttaggtggaaaactttgaaatataattctagtagagtagagttatagtgtaattacactgtcagctatacaatagttaaatttaacttttataattttctatataaattaaaaagagtaaataatttacataactttctataactcttacaaaggaaattttacatagaagtaacaatgctataatgtaattatattataattatactaatatggttacaacatagttacactataatatattaattgtactataattacatttgaaacattttcctcttttctgggggaaagatccactactagaaaaaacgattttctctgcaacatatatatgccctagctagatatagaaggggtgtacgtatatgctgcgtcgatctcaccttagagaccggatcccacgacgaagagaaggcgcggtggccggcggggaagtgctgccggagggcaaggggatgagtcgccgacgctgacgcggtgcgacgacgaattagggcgcaggcgagagatcgccgcaggcaattagccatcagatcgatcagatgaattagatttagggcacaaaaagcttaattagctagctaaaagaatattgaagctaattatatactgtatcatctctctcgtacgtctcttctcgatctgccctccacacgcggatcgacggctcggattaactatctgcatatatttttgctatataattaaatttgtctagggtgtagtttggatattgatttattgatagtaaatcccccctgtcacgcctgcaagtgggggcccagtcgtacatatgatcaactcgtactcgtgtgcttttttttttaactagttattatgtacccatgagttgcaatggtataccaactgcaaattatatcgtacgggatgatgttaaataatttaaatgatggtaaaaaagagaatttttaaatgtctattggcagaaaattaggtcaaaatattgcaaatttctaacattaggatttgcttcgtgattcatgctctgacgatccctggtctttctcctccagcttcaccaaccggtgatgatccggcgagttacgattcagggtcccgggttggagtgatgatgggaaggggggttggggagagaggggagatcgctaagcttagagggatgatcgtgtgaggcggctgcaggcgtcagactgggcgctgccgcgtggtcgaga

SEQ ID NO: 45391 - DNA, 1501 bp, Oryza sativa
ttcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctgaaaatccaaaatgctctaaaatgcattatttatgcacagtgattaggtactggtctaaaatgaattttaggtgaaagaatttttattttatcttattccattagggagttatgaattttagaagttttatcggtttatagtagtatagtcttaggtagtgttatgaaatacttttgtaaagtgatttttactagattagacttcacaggggtgtagagatgtgttttataagactaactcatttggtttcacaatttttggagttacaatgattttcttatagattttacaagttacaacgtgttttaggcatatagtgttttatatgtgcacgactcttaagttgtaggttcagaacattctacttcctgtttaagttgaataaaaggaataatttggttaactaaaacatttttagttcaaatgtttatggtctttactactatggttcatattttataaactagagatgctctaaactaaactagcaatatattatattaacctagaaattgttatatgagccaagttcttctatgttttagtggatggggatggaactatggcctctctggtctaacaagttttattttggtttattcatagctagaatgcatttttttaactaccttacacatatattttgcttaaccattactaggtgattaactccaaggttatctatttaaagattagagctataatatgttcaaaaggtgcaatattttattttattatgttgaagctcactatttgctggttctatggaaatttggttcatttcatttgaactaaagatgaattttctacaaattttacaaagtaaaggttgctctatcttggttattacttatataaatatttaaaggcttttattacatagtaggtgtataattttattttataacatggaagtatacgttttgttgattctacagaacttgggtttactcaaaaaggatctaagatgaattttatgtgaatttctaaaattcagcttacctaaaactagtcattttaaagataatagtttcagaggcatttgatctaaagtatgtatactatttcattttactttataggaaaacataaattggtggatctatagaaactgagttttctataaaatgatttgagatgaattttatatgcattttataaatttgtgtatgctttatgtatgatttatcttagaccaattttagagacaaagtttgtacagtgaatgtctagttttatgcaataactctaaagttcttgatttggtgagttcacagaaatttgatttactctaaaatgagttgttttcaatttgttatggattttataagtttacatgctttcctgttg

SEQ ID NO: 45392 - DNA, 1501 bp, Oryza sativa
gagtggaattggattatttgctactcatcagcgtcatcggtgtttgcggccttggacaaggacaatgacggcaaggtttccgcgttcgagctgcgtggctgcatggtggtggagcttggcgaggacgtgttcgaggaggcggcggcgatcctcggaaaggctaaggggtgatcgatcgcccctagcgcggttcccccaccctccacgtaattttctttttcggcaccatattacttttctattttagtaaatttatgcacctaaagtttgtacatctcaagtttacacatataaagtttagagatccaaagtttataagttaaaagtttatatatctgattcaaatttgaatttgaattcaaatatttttatatatagtatttctatacatctaaagtttatacacctaaagtttatagatccaaagtttataagtcaaaagtttatatacccgatttcaaatttaaatttgaattatatccgatttcaaatttgaattgaattcaaatattttttatatatagtatttctatgcatctaaagtttatacacctaaagtttatagacccaaagtttataagtcaaaagtttacatacccgattcaaatttgaatttgaattcaaatattagtttatagacccaaagtttataagtcaaaaagtttacatacccgtttcaaatttgaatttgaattcaaatattttttatatatagtatctctatacataaattttttcaactttgtttttttattttttaaaaatgtatggtgtagtaagaagagaagagggggtaggaagggagagacagtagcttatagggggatggggggtgatcgcctggagcggtcacccgaccattagccgaacccggtgatcctcgctacggccgactacgacgacgacaggttgcggaaaagaatatattctttcactgatttgcgggttccacatggattttatttttttgtttcttctagtgccacgtcaatgccacttcatccaaaaccactctcaaaactgccttgcgacctaaagtgatccagttttacaagattatggatgcgctatatctggtatttcggtgtagggatgattttcaaactctgctacaagatgagagaccacaaatgaactttttccgaataagatagagcggggaacttaatgggctaataccaagtcaatgggccagatggtaacgggtcgacccgtcccggcccatgtgcaggccgtaccgttgcacggcacaccgttccgtaatctccctcaaatcgaaatcctatttgccccacttctcccctgtctcttcctcccacaactcccctcccgaaccctaaccctagctctccccccgcgccggcggcggccatggcgctcatcaccccagctagcggcgggggcggcggcggaggagacaaagccccaccgtccgcctccgacccgagcctcgggttcctcactaagcgcgacacggaggtgaagctgccccgggcgacgc

SEQ ID NO: 45393 - DNA, 585 bp, Oryza sativa
ttaacccatggcaatgatttgtattagtactgcaagcactcatgtataaataggtaaagctgatcctttttaagtaccaatgagagaataaagaagcataccttgtctttcccatatgagctaagtaaaaaagaatctgaacacaacctacctgttatatgttgctcaaatcacattcatgaacagctcttgcttcgtctgtgtatcttggacatgcaaattgggatttcagagatccataaaattagacaaattcacaatgaattaagaatcacatattgcatagagagagaatggaattactctgggctccttgatgtgactccaatacaagcatcaccaggtgatccaggcaggatgacattattttcgcggtaattgcctgtcaatatcaggtttcctctcccaaagaaaaataaattgaaaagcaaagactgagccattgccgacttgctattccctaccatcgtcctaaccaagccgctagccgccgccatccctagccatcgacctgaccgagcaacaaccgtcgtcatcacagtaatggccaagccgcgaccctcctccttccttctccccaacagc

SEQ ID NO: 45394 - DNA, 1501 bp, Oryza sativa
caatttcattttccttcctgttattcaattaaggttctccttaaaaataagtctttcatgaataatttagtattttgaaggtactattgaaagaattatttggagatgtctaatgcttgaatgataagtaatttggaaggcatctactcctacaaagttgaatcttctaaatactccttcgcttttaaatatacggcattgttaacttttgaatatgacaatatttaacaatttatcttgtacaaagatttagtgcaaatatgcacaatgcgtaaagtacctttaatgtaaaacaagccacaacaaaacaaatgatacttagagcattttttaataagccgattggtcgcatcatgtttaaaagtcaaccatgtcatatataaaaaaagggagatagtttcatacatagctctaatatattttgaaggtactaaattttaaaaattgttgttgcagattgtaagtcttgcatataatttattgtttcttttacttagcttattagctctaattaatcacaccctatctctcctatatttatataataaaaacatcccgacacaccaacgtacattttctcatctatttctaaggtatggatggtattgtcatgtcaacttatcttctttctagttatgcaccctccttaattattgtaccaacttaaaataagccatatattttgaaattatcataccaactcacaatatgccatatattttaaaattattatgtcaactcacaatatgctatatattttgatattatcgtgccaactcacaatataccatatattttgaaatgaaggtcatatttaagatgtagagtaaatgtatgaaatcctcccatccatatcctcattattaattgcttccacctaccccaagcatttatagttaaagtaaaacagttgtgctcttgcaccaaaggatgacatgtaggagccatgcctacgtcccctggccacccaagccccgttgataaacatggtccctcaacagaaacatccatttttgatggggtgcttccttcttggcgaccttactggtaggggacatgcttaccaaaactggacaatcattccagggaggggcccggcaaaaatgaagtcccttctaccttgattggaacccttatctattggttaaccgctttggcggaatttggcaaccacttcttcttcttttggggccacaactgcacctttgacgtggcttgctgcttgcatttgtccaagccggggcagccctgatgtaagtcctttggtataaatactgcccaagcatagagcgagagagagccatcacaatccaatacaagttcacaacataagcatagtacaggtcattgagacttgagagagcatggcagggaacaaaaagcgtggtatagtagtatagtcagtactaggattagtacttgataactagcacaacaaaaagctactatcatttttgcattcaaagtggtaattaagaatcggatgatcattttgattgtt

SEQ ID NO: 45395 - DNA, 1501 bp, Oryza sativa
aaatcactcctatacttctagtatatatgcatctttagtttacaattgctagtatatagctatgcaaccaataccccctaacagtgccttcctggtgttttgagagaccaaccctgattgccgagtttctcacgacaacccgtcatgaccatccaatcgggatcaaatacggagtttattacgacaacctgtcatgaccatcctaccagaatcaaatacggaggagtacccacccaaggaaagtgtcttaggaatatatactaacgtagaggaatacccgtactgagctatcaccatatatgcccaaataatgataaatctaagcaccatgtttacattattaaatactactccatatcctctagaatgacatagagcaatcatttgcatgaacattaaacccacaccattgcacctctatggtaagctagtcacacaactatatcgagacaaatataaaataaagccggtactaagataaagtaaaataccgaagatatataaagaagaatattctattaatttgacaagtcctacaaaaggagagaaaaactgctagagccatacccgaaatctcctagagactagaggactaaaaaaaaaactattctattctactctactagcactagagtactaaactaaacttgagagaaagatcaagtgcttcttgcttgagtgtgtgttggagtggagaaggtgaggtacttttatagctgaactatgagatggttggaaaggtcggaaacgtccacaccaaaccctgcatccaacagagcaggtgcttgggctggcccaactagcctagttttttgcaggccatctccctgttggctcctcacttcagtgatgtggagtttgggccttttgaggttatttctctggttttttaggcccatttactcataagcctacttctcaacagcgtctgattgatcattcattagttttcctgtcgattctccttcatttgtgtagcaatctctgcaatcgaataaaatccaagtacaattagaaatagattattctaaaacaaatatgcattgcaagtatagctagttctcctttattttagttatattgacggtcgaaattggtctataatgaccgtcaacaataatatacaaagaatttttcggtgccattgctaggaattatatttctagtagtgtcgttaagaaatatcaacaagcatttctggcgccgttgctagggaagattaatgattaagagattattatatggtaataactttatatttacctatgtataatcattgtcctttgcaggctaaccttggttgttttcacttttgtcgtgaaaacagggtagtgtatgaccggtttcaatttgccgaaaaacttccaagacaacctagaagttttctttaggattgtcaaaccgcgagttgtcccttcgcagaaaacattatcggcaaagaaaccaaccatcccagtgtcatcgagcttcaagaacatggctgagaagaccctccgtgagt

SEQ ID NO: 45396 - DNA, 992 bp, Oryza sativa
tgaacaattttgttgatatctactacaattaatgttttgaccatttttgtttgttttgtccagtccgttacatgttcaaattgcctacggatagtatattcttggttagaatcaacagacactggtggagaaacaatctttcgttggtcggccgaattccacaatagtcccggttgcaataaaaatcggggctaaagatgatctttagttccggttaaaaagggtaacgggcatatttgatctttagtccggctcaaatgctattagggcctgtcaaccctcccccccccccccccccggaactaaagatcgtaactttagtcctggttggtgttaccaaccgggactaaagatcacggggatctttagccccggttcataacaccaaccgggactaaagtcccacccctatatatatgtcttcttcctcctccagctgcccgagcaagcttcaaaatttcttcaaaaaagaggggaggtcatgccaaaatttctagtgaatttattttggtgattatatacaaatcggaggtgtctaaaaaggttagcaacttcatcctccaatgttttttttgtcatattacatttgcagctatgttttgcatactattttgtctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatactaaataagaactatttggtgtaatattttataatttttgtatgaataatgatatgtcattattgtatgactgttgaaagagtttgtaattattttataattattgtatgactgtcattattgtaagaataattatttgtgtacgagtttttttcatctcatgtaga

SEQ ID NO: 45397 - DNA, 1501 bp, Oryza sativa
agcttaactacccaaacacaagcacaccgactaggggtttaccccattaagttgaaatcctagaaaaagcagtcgaaacccgcatcactcaaattatgccaagtctattccctgtaaaacataagttagacaaatcatggcaagactcagtatattaatttgattaatgtactggcaagagcactatcaaacctgtatacatgaaagctctaagtcaaaggaaggctatttgtggttttaattttcagcataaagcaaattttagttcacaaaccatttgcaacgtaatttaagcaaaacatttaagaaatatgtaaagcataataatcatggcatggtcaacatatgtagataagcatcattcccttaccaatccgaaagtaaggcaatcatacttgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgcccggccccgagggccgaggcgccccgaccccttgtggagttagcgccacatgaatgggttgggtgaacacggtaagcctcacctaaccatatttattgcagtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttggagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcatcatcaacagacagccataatcccacgtcgcacctgtttccggcggaagtgggggtagatatgggccgtcccatcagaagggcacccggagaggaaccgtaccgatctccgtccatttatgaagagaagaacagtccagtttggagaggggcatgtggtatccccttgagatataaaaggaggaccttgcccacttagaaaaagagaggacttttggacacgaggccttggccagatccgatcccagagcaattgggggctggttgacactttgttacttgttcacacacaaatccaccaaaacacaggagtagggtattacgcttcccagcggcccgaacctgtatacatcgcccgtgtctcgtgtttcttcctagctggcgatctttccacataccgagagagcttgagatttcaccctaagcccccggccgaaccggcaaagggggcctgtgcggtctcccggtgaggagccacgagctccgtcatctggcgcgccaggtagg

SEQ ID NO: 45398 - DNA, 1501 bp, Oryza sativa
tgtggatcaaactcttgatgcggaggccgggatggcaacggccacctaaagtgagtagccttttcacctcttagtgacctcctgattaggttatttatgttgtaaaggaggtatccagcttgtcttagtggtcgtcatgtttagcagatctcgagggtgcccttgcaaatcaagatcgtcgtatccaatactggaagacgaaatttgaagtggcggaacatgagagaaccatgctggccatgaagaaagagcaggctgtggagacgctccgaggtcgcgaggtgtggtttaattcttacttgaagagttgctgtgcctccatggccagagtatgcagggaacttcgagtagtccgcagtgatcccgaggagtcgacggccgggtacatctcttggctaaacggggcctatgcccaactcgatggcatcggcaagcatatcgacgaggccttgaagtaagagtgtcgtcgagtgagtcaatacgccggagggcacgtgctggcttgcctacgagatcaccgcccgcgcctggacctcgagtttctccgcgaaggttttgctcgttctcggagaactccggcggagatagaccatctggcaaggtcaatgtcgccgctggccgagaaaatcttccagtctatggactggcattggccttcttgatagtactcgtgccctgtcacagatatcttagtgaatgtcacgaccggaaataacccaacgggcgttccttacgtgcgtgcattattccttgtcccaggaggcaaggtacaccaaaagttgatacaattcagagtttaacaagcggaagcgtaattaattaatttattacatgggtggcgaaggcccagcacacaagaagacaaacgaaaaacagcggaagactagggcgacgaccacaggtgcttgacggcaggcacgagctagacaccaaagccttcatcttccaggaactcctcttctaggtttgggaaaaaattgagcaagactgagtacaaccaccgtactcaacaagacacacccacaagtgcagaataaatgcaagggagtacaagggagccataatatagggagttagggtttgcagtaaacatcattaaaagacacttagttgctcaaagctattttgtaaacatggtcctagagctatacaatattattaatcaaggtcgtgaacccacacgaacctgccttaacccaaggcctacgatgattcagaccgaactggcaacccgaccctgggtcccagctcgtcccaagctaacccaggccaaccattccacattttagttgttgagcaggttttaagaattaaaacactaacttgggtacattgctcggcttgcccataaccgagggcgcggctattcgaataggttatactctgattagaggtgtacatctttacccacaagacacatcttcctcacgtgtaatcacgtgccacatacccccacggtatacggacggaagacgtgacatagtttccaacccatcctagc

SEQ ID NO: 45399 - DNA, 1501 bp, Oryza sativa
agaaaattccaatatatatattgtcgacgggtgatacccgtagaccggatatagagggtattggggtacgttggtacaaggatctacgtagtacgacattgaacaatcaaaagacaagaattatactggttcaggccccttggtaggtaatagacctaatccagttgatatgggattatatggtggaaaacacagattataaagggaaagatggaacttgtcggatccggcgagatcgtagtcgagtggattcgactagctctcgatgacttggctcctcgcagacttcgacttcgtaggctgtgtgggttgtgttggctctgagattcgatcccctatgccctccccgtggggtcccttttatatcacagatctggaggtctccaagtaggactcggagatatcggacccaatacgatacgtcgacgacccagttctgtccgagaaggactcttcccatctgtagatttcgtgaaagttttccttaggatacgtaggaaatatccgcgtgcgcgtgggtatgccatgtcgatatgtaacgtatatcgaagggtagagggtatgcctgacctgtaaccctgacagtagcccccgacttctgcttaaatgaactcgtgcaaccatttacgacttcgggtgtcgagaacgttgtcattcctggtgcgaggaccgcggagatagaacgtagtcgagcatgccgtttgaagcccaacggtcacgagtgaattttgaactgaagtccagaaaattgccgcgtgtaacgggcccagagatttccggcggggatctctctccgttccttggaattcgcaccgtcggtagtgcgcttatttaaaggaattttgggagcccattttgaagtctgccaatcttgttgaaacataccgcctgccagcgctccttgccttctccgccgccgcaagaaaacctagtttgccaactcaggctcgttttccggcgatcttggaacagcaatggatctcggcaagtcgtcttccaccggcgcgacgttgaagaaccttcaggaggacggcgcccttcccggccatgaagacatggagagagaagtaggaggtactgatcctcagcccctcttgggtcgcatggttgcgatcgaagattacgttgtctgcggttttcttcctccaccttcggagtttcttctcctggtgttgaaaatttctatggtctttctcttctccatttgaatcctaattccatcgcctttcttagtatctttgttcatctctgtgaggcctacattggggtagagccttttctcgatctcttccgtttctactatgaactgcgttggatggaatccaatagggtgtctggttgcgtcgggttctgacttagtgatggcatgaagtcacgttatatccccttccagtgtccttcttcccgcagtaagtggcagaataggtggttctattttgagatcaaggactcgaaccctgtcttcgttgttcccgaggatcaaccggacaagattccggcc

SEQ ID NO: 45400 - DNA, 1501 bp, Oryza sativa
gacgttgcttcactgagagccgttgatctcttactggcttccgtatggacagccgtgattggcgattgacttggtaagagatgccacaccatgcagatcgttggggggagtctaaccgctctgaagctaccgaacggatcaaccggtcaatggctcgaaggaacagcagtacagcacacacatttcgcttatgggctccaagatgggcttcatctacatggctatttgggccgtggcaaataagattcgcgtagcccataggtttgcatcctggattgaggcggaattttgatgtacgctaacttcactaggaggcgtacttttgtaatacgtttgaggttatttcggtaattcggtcacgtggtgccgagaaaccaaaaacccctctccaaaccgagccactgctccggcggcggcggcggcggcggcgagttgagatggctgacgacgcggcgagtgagcaagccacggacgtggccgcggccggggccgcggatgaagggcagcctccggcgatgtcgaaaagcgcgaggaagaagctgctgaagcaggagaggcaggcggcgcagaaggcggcacggaaggcggcggagaaggagcgccggcgcgccgacatagagaggcgaaggcgcgagtgggaggaggcgctggccgcggcgccctcggaggaggcccgcgccgagatggtggaggcgcggcggcagacgcggcgcgagcgggtggggcggcgcgcggaggagcgcggcgcacgcgccgagcggctccgccgcgcggccgagggcgccgggcagaaggtggtgctggacctcgagttcggagatctcatgcggcccaacgagattcacagcctcacgcagcaggtggatttgctttgcccttctcgcttttgtacattttgggctgaaactaaacttcatgcttgaaataatgctaatatgcgaatcatgtgtgtattgatatatatgatatccgaaggacattccagtaacttgattacttgtgaaatgtatatggcagatcacatatttgtattggcatggcttgttaaaggtgccaaaaaaatatcctgattctttttttccaaaaaaataaataaatctttatacttttattacttgtccataatttctactggatgttagcagtttcacgtatgaatcttttattcatgtgtcaactggatgttaagtgtagacctgtaagagaaaccagttatatgaatcttgcatatatgatttttctatttcgacaacctggtggcttgtgctatctggttttaatcatatatatcaatatgtgctaatgctatagcattgatctcttattctatctgaagtatgttctgatattgacaaaagttaatatcaaaatgtctttatgtaccaaaatgccttctacctagaaatttctaaaaaaaaaaagcattctaccttcattaatgtctagttcgagcaaaattgttacccttgtactaatgcaagttacagatcatgtactgtta

SEQ ID NO: 45401 - DNA, 1501 bp, Oryza sativa
actctttccatttcagattataagtcattttaaatttggtcaatgtcaaactcttaacttagtttataaaaatacatagtacattttcaacgcaaaacaaacatattataaaaatatattcaattctgaatttaatgaaaactaatttggtgtcgtaaaaaatgatatattttttccgaaacagaggaagcaattaatttctcttaacatgcatataggggctatttacttatacttgatcttagatgtgcttttgtgaataaattatcttttaggagataaataaatgttcctaagatgatcatagcatataaattatacataagatatatggtgtcactaatagattagagaaaaagcttttgattatatattttttagtcgtaacgtgtaccctgtgtagggtctatttgtcatatatatagataacagattgaaaataaccaacatcgtgcgttgaacatcatacaagatcgtagcaaacacatgggttgtgccaattatagcagtgaaacagccatatatatcaaatcaattatatatagaaattaaagaccatgtatatttgcatatttatttatttggtaaaacttgctacactgcattgtaaatctagaaacactccagtttagtggtagtttagttaaaaaacattatgactgttattttaatatttcatacttaattggagagagaaatgttgaaaggatgccattaccccatgccaagttgtatgaccttaacccacttatattttcattccaaattgcagagatcaaaacatttaaagaatgcttgacggaatgaaaatctagaaaagaaatttaaaaaaacatgaaataaaattgaaaactgaacatttattttttctaaatctaacttttttttgggaatttgaaacacattctaaatagcaaagttcaaacattttagaagtactaatataatgaaaataacaaaaaaaatcctaatgaaatctaacagaaaaattgacttttgggggcattaatttggaaataaaatctaacatactttcaattcgaattatgcaaccctaaactataacttgggagcgataaaagtatccttttctaatatattctctgtttgagaaaaaacatttacttctaaactttagttttctactgcaatactatattactacaatcaataaatcaacagttcaacatatccacgtcatttaattagatgatgtggtcgtattagccatatttttaatagaaaatattttcaattaatatatcctaaaatccagaaagacatatatagtatacaagacaaatgttactcacagtttagaactaaatattaaaaaagaaatgcattgtgtacaactccatcgtgacacaatattttcttataaatttaaaactaaaacagttttaagtaatttagtttagaattcatacgccacattggtaattaaaaaaaatactagcactcaaagaaacccaaaaaattattggaaaaacatgtttac

SEQ ID NO: 45402 - DNA, 1501 bp, Oryza sativa
ctaattaagggtgagcttatgaaattaattaattcctcgtgcgtgacaaaattaaatcttgtgcttgacctgaactacaaaactgcaaacggacacaggcctcttcatttcttcttattcatatatcggtccaaatttaagaaccgaccgtatattttactcaattgattatatatcgcgcacgtgcacctccgtacattttttgcaatgttgtatttcttatatgcaatacaattaatccctacattgttatagatctagagaacttttacggtacaattagtataaacgatttaatttgatatttcatttatatagatcatagtataaaattgaagggttaatttgtctttcttgcagttattccgcggggtcatttttgttaaaaagaaagtagctaatctagataaaaaaaaatttggtttcacgtcaggttgtatgaatgtgttaacctagctagctagcacgatttaaaatgtgtaaggccttccacacacatatgctatatatgatataacttacattatttgactggtaattagtcacttgtaaactttttagattttcaattaagattagaatcggccaggaatcatgtcgtcgcaacatgtgccatcatctctcataggtgcacaaatgagaccaagcggtggcggtggcatgcatgaacgagtcccaattaaaccggattaactcatcaactttctaattttctataaaattcctaatttacccatatatatactaccaatatatagtggcaacatattgtactgcaaaagtttgctagatctaaaccacctttccaagatcaataggcagattgatctttctcacttttctagcttgagaagaatgaatatgcatttttcttaagaaaatggaaatggtttaaatgttgagaatggacatttttcttaagagtattaattaattaattacttatttaggagataaggatgcacataatacatgcatgcactattagctatacttaatttgcaagtaaagcattactggcaattaattattgaaatgtaagcatacaatcctatgtcaactatatttatatatatacgaacggatatatatacctgaaggataagttgcggccttctgatatctctcctaactagctctatgcttgaatcttgtctctccgggaatcgacataattgagataagtctttctctccaaattgaattagatcttgttcggttaatctctatagagaggaattgaaggggattttttttcacacctattgcggtttgtgggattattcaggggaaatcacattgacaagatgcaggcacggtagctagcttcaaattaaattgagaacagtgatagcatggacagtgcgtgtacatatatcgtgcgctcatattctgtgctgcagaagaagggcataaagagagttttgctcaagcgagggttttcgaatacaacaaagcataagcaaagtaatgacatgcacggctgaggatgctctccaaa

SEQ ID NO: 45403 - DNA, 1501 bp, Oryza sativa; identical to SEQ ID NO: 19642

SEQ ID NO: 45404 - DNA, 207 bp, Oryza sativa
ccatgcctgatataattaatcattcatgagctaaaatattaatcccaagggaagaactgggcctacatgtcgtggatcatatatatgattactacgttagcttaattagaagggataggcaaacacatcttattagcttaattatgtgaattacgctagctgcgctaaatattgatatgatggctaattaatcattggtactgatca

SEQ ID NO: 45405 - DNA, 403 bp, Oryza sativa
ttagagctacacatttctagttttgtggttaagagacttcaaacaatctcgctgttaagttgagggacctccggcgaacttattccaaacagaaaacacgcatggcctgcttggcaaatgataacgaacaaatggcccagaaactttcacagttgcttggttgctgcttccgcttgtagcttccatcatatagatagtgagatgttatgatctcaacttaatgaaatgaatggattggccaattatattgtattgtatactgcatggttaccgtcacaaaagatgcgtgatccgctgatccgcatcatccagagttatataatgggagaccaaatggaccctgaacaggtaaaaggaagcatgtcgggagctgcacaatatttcttctctttcgttctcaagc

SEQ ID NO: 45406 - DNA, 1501 bp, Oryza sativa
gctatcccattttgcttgccttgctagtttgcttataaatctaagattttcaaaaatatctgaaaaatatttggaaatatccgaaaagttcagcttccatacttacttaaaagttttaaacgcctattcaccctcctctaaacaacatcaagatcctttcattgatcctcctccctttcacttccatgtgttcaactttgtgtggaaggtccttcaactactggaaagggcttgtgcatgctcctcgtctcacgaggatgattaagaaagtcacccagttgactcacaagttgcatctcaagactgatgtttcatcaggggctggtccttcctcttcctctgcttatccgagtatagtatagtacagtaggtatgattcgatcgccagcgagtaattaactgtttggaaaattgatgatccactagtgtagtttagttagtatagtacagtagttggagtcgctcttgaccgacagaagaaagtctgaccctttgaccgattaacaacatccacattgccattaattatatattacaatccattggagcttaattactctcaaaataacgtgttcaactaccggaattaggcagcattcatcgcgtatgtaaccatccgaaaatttcacaatttggcccttttttaaaacttatttcaaatttggtccctaccgaaaactatcaccagatttagaccccgagctcagcgccagacccgatggcgctgaggtagaacgcctcagcgccaaccgcatcggcgttgaggtcctaacggccatctaaaagcggtggggcgaaacggcccatgtggcaaaggtcagcgccaaccgcatcggcgctgaccttcgcgacctcagcgccaagccgccaacaggcctggcgctgaggtccccacatatccctcggggccgagccggccccaggccattccttcttcctcctcgcacctcttggttgagaaggcgtggcgccctcctctctctctcctcctctccaaaatcgagcaaatatccacaaaatcttcgtattttggagggaaaatcattgggggacatagtgccaaggtattctcctccgaatcttctcgttatttgtccattttttgcttggatttgctcattgagggatgaaccctagaaacacgatttggggtttattttctctaattagtttgttctctacattgtggttgtagtagttgttggcaatgcaatgattagatgcgcatagaaccgttaaatgtaggactatggtgagggtttaggcatttagggaagaaccctaatttttttctccaaattatagaagaaccgtatttattttattttaatcataatgtgagagttcaaattaggaatggatcctttgaaatggaagtttgtgtatgcttagatattaatggacaatttcattgggggacttagttgtaggttagaaaaggccattgtttttactattgcaaatttagcttttaaataagggcaatatgctgatatgttgg

SEQ ID NO: 45407 - DNA, 933 bp, Oryza sativa
tctctcaattcctgtgtttttcccgtggttcaatcagatggtcattcctgtgtttatcatgcgttttgcaatcctctgttttacacttacatttctatcaaaatcctacgttttttctattcctacgttttctcaatcttatgatttaaaggggcaatccaattcaggtggggccttccccccggtgttccctcaaaaaaacaaaaaaacaaacaaaaatagctccagaacaactctaaactactgtcttaaagacaaaggaaaacaaacaactagctaatcagatattttaatgtgttagactaattttcacagtgtatataggcactcgagatattggtttcgctccactgcacattcctacgcaaaatactgcatgtttgataaaatgttcaagccaaagatgtattccatcacaaaccgaaatttgaattgaaggcatatgtgcaccgatgagagttggtttgatcgatcatttcaccaattgccataaaatacgtaccggtaacattaacaatctaacaatgcatttttgccataaaccacttcaccatagatcgtactcctctaccttcaaagtacgcgcttttatcaagagaagtgctatacgtacggcccatgcgcacgtctcaagactaatcacattgctcagcttacttctatgtagatccagttttttcacagctagtcatggtagtataggagtcggatgtacactaaccatcggacacacatatctgtgacaaagacatagtcactttgaaagtagaggatcccaatcccttcatgatgtgcccgcccgcgccgagacgcggcgcgcgcatatcggcgtatactcgcgccctcgctgctgtcgcaggcaattcggccgccgccttgtgacttcccttgaagaattacgcaactagctagcactctgcggcgcggccacga

SEQ ID NO: 45408 - DNA, 269 bp, Oryza sativa
agcataccatttgttcacattgattggttcacactagttttgcgcacgagtgagagtgggtggggagtgggtgatgggtggggggctttgaggaactgttcagcaacgaaaaagaaaatgcctcttttcggctcttcggtcctgtccatctgttgaatggtttgtgctcagcacatagagtatgggaagtaatgacactcaactacacttacaagggttcctttttttacccctgtttgtatctgccaaggtcggccattatgttaaga

SEQ ID NO: 45409 - DNA, 1501 bp, Oryza sativa
gcttgttagtgcaaaaatgacaaattaagaaagtgcattaccacgctgatcatcaccatcatcatcatatagtgaaagaagaattgatgttaacccacccttggttttttaccttgtgaatcacccctagcctttggtcggacgggccaattaatttggatcgctactattgatatcaattaaattcttgatgagccgtactagctgtaggcctaatcttttgcattctggagacatcgttgtttaacttttttttctttttaaaactttggagagcatcctcagccgtgcatgtcattactttgcttatgctttgttgtattcgaaaaccctcgcttgagcaaaactctctttatgcccttcttctgcagcacagaatatgagcgcacgatatatgtacacgcactgtccatgctatcactgttctcaatttaatttgaagctagctaccgtgcctgcatcttgtcaatgtgatttcccctgaataatcccacaaaccgcaataggtgtgaaaaaaaatccccttcaattcctctctatagagattaaccgaacaagatctaattcaatttggagagaaagacttatctcaattatgtcgattcccggagagacaagattcaagcatagagctagttaggagagatatcagaaggccgcaacttatccttcaggtatatatatccgttcgtatatatataaatatagttgacataggattgtatgcttacatttcaataattaattgccagtaatgctttacttgcaaattaagtatagctaatagtgcatgcatgtattatgtgcatccttatctcctaaataagtaattaattaattaatactcttaagaaaaatgtccattctcaacatttaaaccatttccattttcttaagaaaaatgcatattcattcttctcaagctagaaaagtgagaaagatcaatctgcctattgatcttggaaaggtggtttagatctagcaaacttttgcagtacaatatgttgccactatatattggtagtatatatatgggtaaattaggaattttatagaaaattagaaagttgatgagttaatccggtttaattgggactcgttcatgcatgccaccgccaccgcttggtctcatttgtgcacctatgagagatgatggcacatgttgcgacgacatgattcctggccgattctaatcttaattgaaaatctaaaaagtttacaagtgactaattaccagtcaaataatgtaagttatatcatatatagcatatgtgtgtggaaggccttacacattttaaatcgtgctagctagctaggttaacacattcatacaacctgacgtgaaaccaaatttttttttatctagattagctactttctttttaacaaaaatgaccccgcggaataactgcaagaaagacaaattaacccttcaattttatactatgatctatataaatgaaatatcaaattaaatcgtttatactaattgtaccgtaaa

SEQ ID NO: 45410 - DNA, 349 bp, Oryza sativa
acttttttttttgcgggtactatagtatacagttgtttatgagttgtatgcaagtttaggtacctacatcttatttaatttgctcttgatcgtcaactgtgtactcctacattctagaagtaaggcatgcatgattattttcctcactcagctaaataaagtgtacccctccgtatttgtaaaggaagtcgtttaggacaatgtttaagtcaaacattgggaatataaatcatgaataactctcaagttgttgagtttgaaaatgtaaaaattatatgaatagatttgtcttgaaaaatactttcataaaagtatacatatatcacttttcaataaatatttttataga

SEQ ID NO: 45411 - DNA, 1005 bp, Oryza sativa
aatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaatgatcatcatggttaatgcatgtttagggatatttccacaggtatttcaaatggttttcctgctgagcaggctacagagaccatattgtttaatttgcacattgcagcactcaactggcttggtgttggtaagtttatttggtaggcaaaagaattggaccggggtgctccagcctaacacagtgcagcctagagatattaagaccagctcatagaaaagcattaaccgttgatgtgcatggagtatttttcctgtatggtttagaaaatgatcagatggagtgctcgtttttttggtcaaaatggtaattacatataattaatgaataaaaagaaataataggaaggattaaccttttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaggtaaaactaaatatttaccatttaaacttaaaaagctacttgcacagaggctgtgaaactacaattctcttttattgtaccat

SEQ ID NO: 45412 - DNA, 347 bp, Oryza sativa
gggccgtccgccctcttcacagcgtggcgatgaagatcacagagcttgcgagcaaatgtcgtcagcgaggtagctcagtggtgtttggtggatagctcttcgaccgtgagcctaccagcgtagccaagaaaaatcaaaatatggaataccgtcgccggttatatatgtatatagaaaatggaaagtaaccatgaaaatggaaggtaataattgaaattagcggacatgattagatgtcatcatttttcaagaatcatgtttcatgtttcaataggtagtatctgcatgcaaacattgtatggaaaatgtgatagaaaatagaaagtgctcattataattggtgggca

SEQ ID NO: 45413 - DNA, 1501 bp, Oryza sativa
tgttgtagaacacataggatattactgcacttttggcagtaacgtcgtagtaaaattgtagtagatcaggaatcgaaacaaaaatatatgggttataaccatatacttgttactgcacaaaagttgaagtgttactacataataggtgcatgttaccactttcaagtagttatgttactgcacggtagttttactatgtcagttttacgagatgaagatcgaataggtgggctataggtaaagtctataggtggctttgagtgaggtctgattgatgtaggagtgttttgaacaattttatacatttggtaaaactatgttactgcgtatatatacccatgttactgtaaattacatattctgttactgcatatggagtgttaaagttcaaaaatgccaatatttgaaaagcaatatctcacaagatatgtattattttttaaaaccgttttcacaatgatgctatagtattactgcatgtggaggatagaacttgaaaatgcatctacatatttccctcctcaagaaaccgttcttcctccctcttcttaagaaaaccggtcttctccctctaatatagttttactgcatgcatgtatatgacgttactgcacttttgacagtaaatcaggaattgaaacaaaaaatatatgggttcaaagtctcatatactaactatatacttgttactgcacaaaagtaaaagtgttactgcacggcatatacacgttaccacctgacagttacacattaccgcatgtttatgcagtaacactatccaagaactacagtaaagcactttgttactgtagaacatacagaacgttactgcatatttggcagtaacatcgtggtgaaattgtagtaaactagaaataaaaaaaaatatggattaaaacacacgagtaaaccgagccaattccccatattcttgtagtaatgttatcaagtaattgcagtaacacactatgttaatatgaaacttataatcattactacattttgtagtaacgacatgatgtgattgcagtaacgcaaaacatgcactagtaacacttttgatatactattattgtttgtggagagttaaaattttaaaaacaaatctttgaagggcaatatctctcatatcatgtactacttttaaaaaccgtttgcatcatgatgttcgaaaaaaagtgattatcaaaagtagatccatcatgactatattatgactgaatttcaattctgttactgcaagtaaaaacacggtgttactgcacgatgaacaagatgttactacgtcgttcccggacgagagctaagaagagagggggtggtggggaaagtcactgccggtttgaccgagatttgaccgacgtgggggacctttgactagcctttgactgaagtgggaggtgggttttgggcccttagaaggagatgaggtggtttagagggagggggggtatagaatagctattctatatccgggtgtagaatagtttatatatatata

SEQ ID NO: 45414 - DNA, 695 bp, Oryza sativa
attcctgcagccctaatcttctggccaagcagtatgccaaagttgcatgtgagccattattatcccagttcagtccaatgcagggggttcatgatgccatgtgattgctaaccaggccagtggccattctactgtaactatttgatgccttgatggccacatgccagaattacaacggcttgcactatatgtaaccaaaacatttaagctgaggatcacacttcaacacaaatggaaagttaaatcgtgggcacaccatatctctgaatgtttgccaccatcatttaagaatggctggcagttcagcacatgtatctgcgactgcaatatctgcagcagcaattgcttgccgcctccatttctgcttacacacatcctagcttggacggaccacagataccaatcgatcacgtatccatttcactatttcagcaaacgatgtactgcattgggcatgtgctctctcatctctacctgtgcagacgtgcagtctagttttctgttgtccacagctatttgctgtacagaggagatttctgagatcggaacggtgatgctttatagtatgagcctgtgataaataatgtactgtatttttttcttcactgcttcttcaccagcttagatttgtcctaatatttttttcttacttttatggacctaatatttctccgatcccaatccccttatttagc

SEQ ID NO: 45415 - DNA, 1501 bp, Oryza sativa
tcaacgtcgcgccggtggaagacgacttgccgagatccattgctgttccaagatcgccggaaaacgagcctgagttggcaaactaggttttcttgcggcggcggagaaggcaaggagcgctggcaggcggtatgtttcaacaagattggcagacttcaaaatgggctcccaaaattcctttaaataagcgcactaccgacggtgcgaattccaaggaacggagagagatccccgccggaaatctctgggcccgttacacgcggcaattttctggacttcagttcaaaattcactcgtgaccgttgggcttcaaacggcatgctcgactacgttctatctccgcggtcctcgcaccaggaatgacaacgttctcgacacccgaagtcgtaaatggttgcacgagttcatttaagcagaagtcgggggctactgtcagggttacaggtcaggcataccctctacccttcgatatacgttacatatcgacatggcatacccacgcgcacgcggatatttcctacgtatcctaaggaaaactttcacgaaatctacagatgggaagagtccttctcggacagaactgggtcgtcgacgtatcgtattgggtccgatatctccgagtcctacttggagacctccagatctgtgatataaaagggaccccacggggagggcataggggatcgaatctcagagccaacacaacccacacagcctacgaagtcgaagtctgcgaggagccaagtcatcgagagctagtcgaatccactcgactacgatctcgccggatccgacaagttccatctttccctttataatctgtgttttccaccatataatcccatatcaactggattaggtctattacctaccaaggggcctgaaccagtataattcttgtcttttgattgttcaatgtcgtactacgtagatccttgtaccaacgtaccccaataccctctatatccggtctacgggtatcacccgtcgacaatatatatattggaattttctaggctttcaactatttccacatgagatagttgttttagcaatgttactgtagcaacagcaacaaaaaaatatactatgaaaaatattttgtattgaaaatcaaatgaaatatcctgtcgatatacaattcgatcttatacatatatgttttacactgatgaacaaatcccaaaagagaaatttacacatgtagatccaagatgttatttgatttagtttactgcctaggatctctctctctccgtgtgtgtgtaatatctcactggagtaatatccagtgttggcaaaaggtgtgttacaccccaaactagcaataatgacatgtccatatatatacgtgaagaataaaaacaattgttccaacaatgaatgcatttatttttttagtgaagtgcatgagcggtttctaaacttgtatgtgtgtgttatctagatccttgaactatcaaaatgttgtatttttgaatctccaaacttgtcttagatg

SEQ ID NO: 45416 - DNA, 1501 bp, Oryza sativa
tttttttagaaatttctaggtagaaggcattttggtacataaagacattttgatattaacttttgtcaatatcagaacatacttcagatagaataagagatcaatgctatagcattagcacatattgatatatatgattaaaaccagatagcacaagccaccaggttgtcgaaatagaaaaatcatatatgcaagattcatataactggtttctcttacaggtctacacttaacatccagttgacacatgaataaaagattcatacgtgaaactgctaacatccagtagaaattatggacaagtaataaaagtataaagatttatttatttttttggaaaaaaagaatcaggatatttttttggcacctttaacaagccatgccaatacaaatatgtgatctgccatatacatttcacaagtaatcaagttactggaatgtccttcggatatcatatatatcaatacacacatgattcgcatattagcattatttcaagcatgaagtttagtttcagcccaaaatgtacaaaagcgagaagggcaaagcaaatccacctgctgcgtgaggctgtgaatctcgttgggccgcatgagatctccgaactcgaggtccagcaccaccttctgcccggcgccctcggccgcgcggcggagccgctcggcgcgtgcgccgcgctcctccgcgcgccgccccacccgctcgcgccgcgtctgccgccgcgcctccaccatctcggcgcgggcctcctccgagggcgccgcggccagcgcctcctcccactcgcgccttcgcctctctatgtcggcgcgccggcgctccttctccgccgccttccgtgccgccttctgcgccgcctgcctctcctgcttcagcagcttcttcctcgcgcttttcgacatcgccggaggctgcccttcatccgcggccccggccgcggccacgtccgtggcttgctcactcgccgcgtcgtcagccatctcaactcgccgccgccgccgccgccgccggagcagtggctcggtttggagaggggtttttggtttctcggcaccacgtgaccgaattaccgaaataacctcaaacgtattacaaaagtacgcctcctagtgaagttagcgtacatcaaaattccgcctcaatccaggatgcaaacctatgggctacgcgaatcttatttgccacggcccaaatagccatgtagatgaagcccatcttggagcccataagcgaaatgtgtgtgctgtactgctgttccttcgagccattgaccggttgatccgttcggtagcttcagagcggttagactccccccaacgatctgcatggtgtggcatctcttaccaagtcaatcgccaatcacggctgtccatacggaagccagtaagagatcaacggctctcagtgaagcaacgtctcttctccaaacccaaccgcccggcgcgtacgcagtccactaccaccacttccgccggcgccactcgctttcgtgaagaaaacc

SEQ ID NO: 45417 - DNA, 377 bp, Oryza sativa
tttgtataaaatataatgaacttagattggaacaatacgctagaaagatttccgggttgctagtactttttggattgacatagggtttgccaagtacatgtgaagaacgaatgagtacgacggcaattctcgagtgggtatagacctagccgattaagttatctagcaaaggaattagccacagttttgtaaatacccttatattctgtaataaaatctcctttggagccttgttcaaatgtatgcaatgatgatccagattattgaacctgtatcaatctaccaatccagggcttgatacagtttagacgcatcagttaagaccaaatctttaattttgggacccaacatctcgaagtgaagcgctgccaccgaga

SEQ ID NO: 45418 - DNA, 1501 bp, Oryza sativa
agcccgagtcccagccctgggccggcacaggcgccgagcggtgcatctggccgcgcgctcacgggcttctccatggcagcagcgcttctcgtcgtgtgtgtcgtctccgtgttcatcttggtttgaggttatttggagaggtttaattagctctctgtcggtcggtagtatcgtcggttttgataggaattaatgctataattctgagatccaagaagaagaagaagaagaacgtgtcatgtcatctcgcggtagatgacaggatcgagtccatttttgttaattagggtgttccaatgttttgtctagggtacttaattaaacccttatggccttatgtacgtaaacccattccctcaataaaatcccaccagttttattgtgaagatcgacttggcaatgccctcagatccactggagtgattgtttgatttgccatggaagttgaactgtgcagctccctatgtttaacggcggataataattttctacttaagtgtcatggcacctatcatttacatacaacaaaaaaattttaaaaaaaattcagtacaattgatgatacaaatttatacacaaacatatatgactatgggcctatttagttcgcgaaataaaaaaattttgggtatcaaatcagatgtttgaccggatgtcggaaggggttttcgaacacaaatgaaaaaactaatttcataactcgcttggaaaccgtgagacgaatttttaagtctaattaatccggcattagcatatgtgggttactgtagcacttattaggctcaaaagattcgtgatttccttcctaaccgtgcaattagtttttcttttaatctatatttaacgcttcatgcatgtgtccaaagattcaatgtagagaaacaaaaataataaatcttatatgtatgacgcagataaaaattgttatttattgtttcttcacatgtagattaattttagatttgcatgtttgtaatagtgtcttatattatcatagtttatcttatcaaattttataaaatttttatataactacttaaattacatgtacatgtgtagaaaatacattcatgttaaacggcccagtcgatctcactttgaacaggcgaaagaaaagtccggaacagttcagttccgcgcgcgcgattccaccggcgaaacgggagctccacgtccgcgttctgttgcgcctcgcacgcccggttccaccgctcgcgccgcgcgctcggctcccgtctcgtccacatcccccgcgaccacgtacgctgccacgcccgcgcccatgcccacgcccacgcctgcggccgccgggccaccggttggttgtccgcctctagtttccaggtcgtccagaacctgggaaaatcaaccgaaaaaaactcaaaacaggcgaagtaatcgtttgaaaacgaaacgattttaggcagcgtcgcatgcaaagcatgccacaagaaacagggcataagtaggcgcctccatgcagcgccccatgaaaagcatt

SEQ ID NO: 45419 - DNA, 1501 bp, Oryza sativa
ctgtcaaggattgcctgtggaatggagtcgcccgctgcaggagtcaagtcttcaggcttagctcgcttttactttttccgctgcatttgtaatcttttatattcttgtaagacgtggatctgtatgtcaacaattatcgtttgtgtacacttgctggtcctggacaggggtttaatgcacattcagctcagaaattctggttcgtgaatttctgggcgtgatagtctatgccggtgatccattgtcctggccaaggaccacggccaaagatcaagtaaatgcgttgatcagccaccgtcttcctcgtcaccggctgccacctccatcatcgattccgtctatgccgttgagccattgtttgattccctgtacatttgatgtctctatgacctcaccaccctcatacatgcctcgctttggcagatcgtcgacccgttcgtgctgttcgcatgtaacatcgtgaaaattaactattttctaatcctgcatcatgttgattcttattttttaataacttcctaaacctaggaaaatataattataggtaacctcctaaaactaacttacacaaaaaatttttggtatttaattttttttgtggttttcatttaaaaatatatcttagtaaattgaggtatttccagattggattttatttttgaattttaaaccttatttcgactaaaatttctttattcaatttatttgaaaacttcttttactttattgattatggtccaagaaatcatctaatattacctttcaaactagaccgacacagtgccaattatttctggaattaatcctcgatcaaactctccatctagacccatcgctgaaactccttagttcttctccatctaaaatattctatcatatattctttcgtgaagctcctattttgatctagcctccaattctaatttccagaaactaagtctccccagcacaagaatagcaatattataaatattagaataattgctcttcagctcttgtcctaagaaaataactttcaatccatcccttccaaaaactccaaatttttctaaatccatattagccacaaaatatttctctaaatccatgccacctattttttgggggaaaaatcctatttatctgcattcatatattttctaccacattcccaaaaatatatccaaattaggagctctactactcatagtgcaaaatattcctatttcttatttgagtgcttccaaataaattccctcaaattccacctctaaaatgttgcactcaaataaagttgaaaaatacccattctgaaaattatcccaaatataaattcccttaaaaaatctcctattcaaattcacttcaaatacaaatcctatgcaaatcaaaattattcaaattcacgaacaattcctttgggccgaaatccttttccctcttctctcggcccatcttcatttcctaaccctaaccggccaccctgtctcccttcggcccaagtcgacctagctagccagcc

SEQ ID NO: 45420 - DNA, 1501 bp, Oryza sativa
ttacatgtaagttactattgtttattgatctgtttttgcagaagaagtggttttgctgtgtgtcgcccagccccacccaaccttgaggaagcaaaggaataccaaatataacatgatgctgctactgccgccttgttaatgcatatagtaatgattatacacacccagttgaaaatggcccggtgttattctgtgatggttgctctgttgttgtgaggaggctggtcttgagctcctcaagcctgtctgtcagtgacaacagcgccatgtatgatttgttttccgccgggccaaccatgtacgagtgtatgactgttacatgagaaatttatgggtatatgatgattaaaaacgtcatgattttgtgtgtactcgttgacgtttgattgtaattatccattcgctcttgtcctttttcttatggttctgcagtgtgatccttcctcaacttcatcaactgtcaactagtaattctgaaactgtactgcccagtgcccaattcagacttctgatcctgctgtaacttcagtaaggttatacattggtacccacttttgttggaacctgcatgggaaaaaaatgtagggagaacctagaaactacctaaagagtaaaatgtataggtggtatcacaacttgtgaggtgggtgcagtttagtcactcaatcttacaaattgctcaaataagtcactcatcttacttcgatggtgcaaattttaccgaatatattgtcacatggattatttgtttttagattggaggtcgtattagttttaaaaaaacaattggaggttgtattgacctcacatcttacattttttttaggaaaaattggaaccatgccattataatttcgcaaaatttgagatatgccatcctgacccacgtgtcattcttttttttaagccatgtgggtagggcaagcattacaattacaaattagcactcatatttttcatgtatatactaatactcccgctttcaatgaacatggccatattatgcttgacaatcaataaaaaattcatctttaattggattttaatactggtagtattgtacgttggcttatttatggatcgtgtgaccatgtttacaaaacaaattaacatagcacataacttcattgcgaacatcccacacaacacatgttttgtatgatttgcatcctaaaacaagatgagtaacttgtttgagtattttacaagatgggtgactaaattgcacccatttcacaagttgaggtactagcggtgcattttactcctacctaaaatacacaaatacacgtctaagatttatccatgtcatcccggcaataaaaaatttactcgtggtgaattactcgggtgatgtgaataaatcttagatttctatttgtgtatcctaggtaattttcaggttttcattacacatggatacatattttcccggtctgcacagttttcagaatgtaacctcagaagagaacatctatgtgccacccctccacagtattga

SEQ ID NO: 45421 - DNA, 538 bp, Oryza sativa
aatttaacttcaagcttttcatctggtagcaacacatgagtatattttcacaattacatcgcatagagtacaagataatacaattctgtgtcatgattcggatgtgttgtctgctcaattccactttttttaggtttatctactttaagaaaataaaaatttttccgttcatcacacaaatttcgatccgtcgtctcctgctcaaaagcaatcacgttgttcgctcatttgttcctcccatattctaaaactatcaggcctcgtgtcacaagcatcgtccacatcccgcaaaatataaggcagattaattgtccaagaacaaaaatgactttttggtcattatacacattgctgatgcctatgattatgcttgggtgtttcgataaataattgagatcaacttcagccacccatcattacccggtgcatcgcacaggcattttgctagtaaggaaaatactaaaatatactgtttatgggcccacatgttagttttctttttctctttcttctctcgtctttttcctctcaccttagt

SEQ ID NO: 45422 - DNA, 1501 bp, Oryza sativa
gagagggaggctagggctttcttactgagtcagctgtaatgacgagggagggaggcacgaagagcagcttctcccccttgcggatgttcttcagcgcgacgaggccgcgctcaccgacgtccacccgctgtatccccaacctctgctcggggagccccgaatcggtgagccacctctccagcgacacggcgctctccagggactcgatctcgcagccccacgggactcccgcggcggcggcctcccgctgcgccggcgccgacgccgacgccgacgcagccgaggcgcggacgggggatcggatgaggactcctgagggtaaggctagatgctgccggagacggcgaggcgagcgcggcggccggaactgcgtgtggagcgcgagcgccgcggcggtggccatggcggaaccgcgaaatggcggtgcggttgtgtgcgggcgcggggggcttatccgctttgccagtcgcgggcttggcttttttatgcgacacttttgtgggctggctgcaattattgggcctttttgtttattaggccgtgaggtagtactacacggaatgaaataagttcaatattactcccatagctagtggtggaatctgattcgtatcccaaaccataatatcgatatatcgacccccaactattaaaaccggtgcacatttgacttcctcgatgattttggaggatggtttcgctgatgtggcgactacgtggtggtgttgacttagtcttcgtcctacgtgatgccaccgctatgttgaccaagtctcggccagcttcacatctcccccgtctctccctactacaagctctcccggcgacggtagccggcggcggtgccatgtaggataaagaccaggtcaaacaccgtctcgtagttaccacgttagtgaaactgccatccaaaatcgttgagggagtcaaattacactgattttaatagttgagggtcgagatatccagtattgttcttcaaggatacgaattagatttggccaatagttaagggagtcaaagtgaacttattcgtccacggaatcttactgacaggtgtggcccactggactgacagtgtgacacgcgctcctagttgacatcaatcgccctcctcttgtgggccccgctctcgccaaaaagaaagcaacagaattcaaacgcaaaacgtcactgacaagtgggaccctatacgtgggatcactctttcccctctcgcaagaacatctcgagcaataaaaaccccgagagaaaaaaaaaagaatgctcgccattttccccaagctcccgaagcgatttccatttcaactgctcttcctcccttcgcagcacgcacgtcgccgtagccacatggccgacccttccagatcctcccccaccgcggccgccgccggcgacgccctcctggcggcggcggcggcgcccggtgacgcgccggacgcgaccgccctcgccgtggcggccgatgcggacgcggagttcgggttccagcgcgcggagc

SEQ ID NO: 45423 - DNA, 1484 bp, Oryza sativa
  unsure (1)..(1484): unsure at all n locations
taattataagtagctgataattccacattcaaggtctctcaggttgttatgatgctcaaatgtactctctctggtttttaatgtttgacgctattgacttttaaacacatgtttgatattttttcttgttcaaaagaaatatagaattatcatttattttgttgttatttgttacctcataactatggcttttttgtatatatgtatagtttttaaaataagacaagtggtaaaggtatgtttaaatgccaacaatgtcagccattaaaaactgaagggagaaacgtcctggggttttccggctagcttcacaaggtggtgggttagacgacctgngttcgaagcctcacccctcctaattatttgatattaggtccttccctaatacttgtgtttttcattaaaaaactgaatgagtaacanttttcagcttgggtggagacagaggattagcacaccacatcatgtcaactatcaagaagtcctatttatcatgtaccatactattggttcctgaaaacagttggcccatcttcacttttcagtcatggctggcacaatcactccatttctgcaataaaatgcagcttggagatcacttctaactaacttgctcttgatcgttgcagcgcaacatcagctctgtcacacgttgtgctggggcaattcaagaccatagtcataatgctctcaggttacctgatcttcagctcggatcctggaatcaccagcatctgcggagccatcgtcgctctcggtggcatgtccgtctacacctatctgggtctgaaagagtcgacgacaaccgggaagaaaccgcctttagcacagaagcccaaagctgctggggatggtgagaagcctggtttggagcatgaggattctgtatgagctgacgaggattattcatcctggttggtcgattgtactataagcatacttaggtgattctccaagagttgtacgccattgctgagtccattgtacatagaaacacttcatgattttacccttttacagttcttaaaaagttcaaaaacattgcctcacaattctcttcgtttcttttttcttgctgataagttccacagttgatgtcacgtaagatgaagaacatgtcagcatgtcacataggataggaaccacgtaggaggaaaccacgctctaaaccattcgggaaggtaaattggtccggttttaataattgacggagcatctatacccggttttgtagttcatgaacatgaattggactcggcctgcagattgagggagaatatatgaaccttttgccatattgtttttctaagttgaaacgggggacgcgtgcgaaactggcccattatttctttggatcaatatactcaagttttgggccggcctggcccatctagcaagcgaggtagttatagctctctcgccgagggcccgaggcccagcattaaaacgagcggctctttcccctctccgccctctctctctct

SEQ ID NO: 45424 - DNA, 1331 bp, Oryza sativa
gggcttttagaaatccagtggatatggatgtggatgcggatagtatgatgcggatgcggatatggtatctctaaaatccggcagatgtggattatccgacattttggtcggattatccgataggtcgtttgccaaataatccgaaattatcaacatatgcaaccactctatctattgtataaacataagttggtacatccaatgggctaattcatcaattaacatagtttttttagtctaaggcttttatcgtctcatatcacactcgcgtagctactccctccaggttgataatacttgtcgttttggacaaggacacggtctccaaaaagcaactttgacaattattttccattataatatgtatgaaagtgttaacaaatatatgattttattaaagtactttttaagactaatctatacaagtagtcaccatatttgaaagacaaatattttgaaaatgattcataatcaaagattataaagtttgacctcacccttatctaaaactacaagtattatcagcccggagggagtatattttatattatggacatcatgtatgttgtttagcacttaatcatataattattacgatgggtcatttattgattatagtattattgttccttgcattgctaactcgatgttgcattgattgcatatacacgtaacatcagataaatttaatccatttcccaaattggatcttggcctcaactgggggaccgcaccaaagatgtcatgtgtgttgaacaccatgcaccacaagaaaaatgctttgtagaaacatttttcgagtactatagacacacttttcaaattcctttacaatactgtggaggcattttaaaagtgcccaataagtgccttatggtgaattgtctctacaaacgaagatgcattttataaaatgtctataacatggtagaggcattttctagagacattaaattgtatcacaaccatatgaaaccaatgtaaaaatgagaataaaatagtttcccttgtttttgccaatccttgaactcatgacctgttaaacaaatcattcttatcttcaaggcattaaccaactcaaccccatgtcattcattgtatgtttgtgccttaacttacttatatatttagtcatttagtatatatttttattctaagaagtatctctacatagtttaaagtgtctcaagcaaatgtctttacatgttaagcacattttaaagtgccgaaagaatgcgtctacaagataaaatctaataaaatgtgctaaaaatatttctaaagtgtctctagagtaaaagttttctagacaatttttaaagtgtctctac

SEQ ID NO: 45425 - DNA, 1501 bp, Oryza sativa
tgcatgaaaaaatagcgatttttgcagacattttagggcagatgagcggctcaaccacacgcaaaaataggaaccgaccgtttggaaaaatggttttttaagtagtgtgaggagttaacgtgcagctcttttgctctacaagggcttcgaggagtctaaaatttgaaattaataaaaattgaattgtttcgtgtttggagactcaattatagagttggcattatttaataaaaaaattgttaataatacgtagttgtacgcggttttggggtcccaattacatcatttttcttgttttaataattttataaaattgaaaattgtaattattttgttctacttcagtatagactatcagttacagatttttttttatgttttaatagttcatagttaatatatgccaacttgtcataattaagcccatagcttataatagatgagctctaaattacccaacattcagaacagttgggtttttaatatgcagaacgatgttaaatgcaaatctacagccataacaatacaattcatccaagatcttcccgtctaattatgtgtgagctactacgaagtgcctaactagtatagttataaacttgtgtgaagttagaagcataaccgtatatataatccctctattttcctttacatggcatacgttagtttaattttgaaataatggagtattacttatcataagagggaacaatctttttaggagcacacacaggttggggggggggagggggggattagaatgaaaagagctcaaaaaatattttattatgcagaaaaatataataaaagcatcccaaaacaataattaagatagatacatgctcccaccggtcacaaatattaatttaacatttgtaataagatttttttcaaattttgaccgtcaccaataagtactgttgtaatctcataaacttattagatcttataatatttatctaatataaaattatgatttaagccatgcattggaccttgaaaaaaaaaatctaacttcatatattatctgctagaggaagtacttggttcagagagatacagtgtaacttattgttgaggatgcaaccagcacaaatttatagatttaaacaacatcctccttccagtaggtaaagtatagtagttcctaattaatgaatacctgaagagatgttattagtaagcaaaccagaaactacatcttgaaataagccatgcatcagacctacaacttggatggaaaatgtcagaagactcaggatcgcaagataaatatatatataattatatagctatatatattcaacttaattccttccgcaaacctataaaaacactccagcatggaaaaaattgcagatttaactgtgaacatcatgcacaatacatagtactacttctaaagcagctagtctgtgtgactcgtgaaccccagaaaagatgaagcatatatatatatatatatatatatatatatatatatatatatatatatatagga

SEQ ID NO: 45426 - DNA, 1156 bp, Oryza sativa
cttgcaatgcatattttgttttagaataatctatttccacttgtacttggactttatttgagtgtaggaattgagcaaataaaataaagagaaaatgagaaaacctcactcctaagcaagcctatggataagatgggcccactttgtcgtgtgtaaccgtcccggaaaccgtcataactgtcacaaccgccatagggacccacctgtcaaccacatagggaagtttggaggcctgctgcgaaccctggtgacgctggctctggctggccttacacctggacgctcttgatcgctccccaatgatggttgcaggcatattggtcatttcgcataggctacaaccgtcataacaaccctataaaaggaggagctcattcactctctcaacacactcaagcaagctcaaatatctcttctacactttagtttagtattctagtgctaagtggagtagaatagaatagcatctcggagttctcggagtcttcggaggaatttcggtaaggttgtaatagcattcttcctttcttttgtaagacttttggaattaatgaaatattcttcttcatatgctctcgatactttagtttatctaagtattgtctttactttatgtctgtatcggtacagtcgtatagttagcctaccagagaggtgcagttgtgtgggtttaatgtctgattattcagttgctctatgtcatcttgagggatatagtgtagtatttataatgtacacatggtgtctagattattaggtatcattatctgtgtttatatgctacgagtcagtcgaggtgggccgctgatggtgacagctcagtacgatcctaaaaaactttcctggggagggtattcctccgtatttagcccccggatggacggccatgacaggttgtcgtaagaaactcggcaatccggggtggtctctcgaagcaccaggagtgcactattaggggtattggctatatggttgtatactaacagatgtagactaaaattgagtgtatattagaattataggaaatgattgtttttctatttcttcttatgcttagtttagaaatgattaaatgagatatatgagtgctttgcttcgtgtcactctacccaaataaatatcttaacccctacttagactttgattatgtaagtgg

SEQ ID NO: 45427 - DNA, 304 bp, Oryza sativa
gcccaagcccgccgccgccactcccgagggcggagacgggtagatctgctgccgccgagccgccgccgcctcccctcccgctggatctggcggaggggagggcgccaccgttgccaccgtcgggccgccaccgcctcctctccctcagtcgggcctccagatctggtggacggaaggcgctcccaccatccgccgcttcctcctaccctcccgccatctacagccgttgcacctccacgccgtccgccgccaccatgcctcccttcccgcgcctcccctctcgcccttgccggatctggcggga

SEQ ID NO: 45428 - DNA, 217 bp, Oryza sativa
atgtggatgcggatagtatgatgcggatgcggatatggtatctctaaaatccggcagatgtggattatccgacattttggtcggattatccgataggtcgtttgccaaataatccgaaattatcaacatatgcaaccactctatctattgtatataacataagttggtacatccaatgggctaattcatcaattaacatagtttttttagtctaagg

SEQ ID NO: 45429 - DNA, 1501 bp, Oryza sativa
cacaagatgcagtttgttatgtaaaactaactgaaaatagtacatggttaagtttctcataatcttgtttgcgaggactgcagtattaaaatagtatctgtaaactctagcattggccaaaaactcagtcagatgaggcaatagtattgcattgatcaactatggtacgaaaaaccaactacatttcagattcattagttttaagtagggacttgactcttcactatgagaactttctactcaagaaacatatcccccttggcaattcagatcaccaaatgcaatacccagcatctgctaaaatcattcttaaagttaagagtttggagaattaactcagtatattagagatgttactaagtagaactcaaaagtttggagacttaagtcagcacatagagagatgttacaaaatcagtagaaggaactcaaattaatgaacagatcctcacttcagtctatgttatcctactaatcaaatcagcggactcttaaaatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaatgatcatcatggttaatgcatgtttagggatatttccacaggtatttcaaatggttttcctgctgagcaggctacagagaccatattgtttaatttgcacattgcagcactcaactggcttggtgttggtaagtttatttggtaggcaaaagaattggaccggggtgctccagcctaacacagtgcagcctagagatattaagaccagctcatagaaaagcattaaccgttgatgtgcatggagtatttttcctgtatggtttagaaaatgatcagatggagtgctcgtttttttggtcaaaatggtaattacatataattaatgaataaaaagaaataataggaaggattaaccttttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaaggtaaaactaaatatttaccatttaaacttaaaaagctacttgcacagaggctgtaaaactacaattctcttttattgtaccat

SEQ ID NO: 45430 - DNA, 350 bp, Oryza sativa
attcctgcagccccatagctccaatatgatggcaatgctatggatttaaactaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagc

SEQ ID NO: 45431 - DNA, 161 bp, Oryza sativa
ctgcagcccaatgctctatgcatatttcaaacatttgatgtgacgaaaaagttggacaaatgcaggcctgtctagtagatagcctcaagtacaacttaaccaataagagcatgtgggaaagcacaatccatatatatatatatatatatatatatatatgg

SEQ ID NO: 45432 - DNA, 382 bp, Oryza sativa
ggggagattttaagggagaagttgctaaaattggaggggggagggaagctggctgctggcgttttttggttttgtgagggttgcaagtggtttttgcaggtgaaaggcagtgaggggctgtggtggtgggggttaaggccaagggcagtacatggctgtctcttttgtctgggttgttctccctttttgctctccaaagggctatatatggactggaggcatctgatgctaggagttcttgtacttttggtgctatgcttgcatctggtgtatgtgggggactactgggagatatatatggtagagtagaccgagaaaagaggggctgaaatatggacaaaatgctgtggtgtgtggtgtggggatggagagcctaggagaa

SEQ ID NO: 45433 - DNA, 238 bp, Oryza sativa
tttttctttctcaaaccagcgagacatcccactggattcatctcaaggcaatgcacctgcaatccatcaattagctattgcatactgcctgcatgcacattgtgcgcaggaagccaatcttggtgcggaggtaattacaacagatcctagatgttttagcaagtatataaacaaaataaatacttctgccttttgctttttctgatcatgcttgttacatcgttgtcatctgaatagg

SEQ ID NO: 45434 - DNA, 379 bp, Oryza sativa
tttgttattcgaaattgatgcaggctgatatgcaacagtatggacttgaggagttcaacaacatgaaaagaatgagggttcgtatatatgatgcatttcacttttcctattttgatctgtgatacaatatttttgttcagttactatctaaggtttctaacttccagtgcatcaaatcctgtgttccctcacttcctctttcttctagaggccctgttaatttttttttgtatttctataagtaatatttgtttttgtatttcttttttgtacttcaaacaatccttgaggaaatgtctgaaggatgtccattctcattgaacattgattaaatgatccctcaatccctgatgaaatatttacattacaattttgcagg

SEQ ID NO: 45435 - DNA, 1501 bp, Oryza sativa
cgatcgatctctctcggcctctctccttcgccgccactgcctagggcaaatccccgcgccgacgccgccgtatctcgccgtcgtctcgagctcgtcgtcctcgccgccgcctccgcctcctctgctgccgccgcatctctggggtgagagccgccgcatctcccttcatgcatctcgatctctccgatcttgatctctctccgtcgccttcgacgccgccgccttcgacgccgcgcaacgccgccgccgcatgccaacgccacgccgccgccgccttcgccgccgccgtcgccacgccgccgcgccaaccgcctccccgatgccgccacaccgccattaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatacatatatatatatatacatgtatatatatacatgtatatatatatacatgtatatatatatacatgtatatatatatacatgtatatatatatacatgtatatatatatacatgtatatatatatatatatatgtatatatatatatatatatatatatatatatatatatgttactttgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 45436 - DNA, 1501 bp, Oryza sativa
tgatttttagcataaaacaggccattgtttggtgaagacaaacgctcatgtgctgacctcctcggtcctccccaaccttgatggaattgcattggaggcatatgattaaacattggtggcggtgccccccatggcatgaagtaaagaaaaggataacctgacggcggcattggacaaggcatggcttgaggatgatgagggaaaggtgactccactcgtcttggtgaatgaccaaatcactccctaggaggtgatcttagtcttttgcccttattgtgatttttctcaccaccttgcttctcatacttgtacaaaagcatattaaaagtcaccttagtcttctttggggctttggaacttgaagcttcactcctattctccttccaaacaccaacctccggattttttggcaccatcatttttaggcctaggttctccaatgaccacttccttccctttagtagattcggcttgctccgaccaaatcaacaccttattttcattgaaatcaattgcattcaccgggaaaggatcacgatcaagattcatcttggaaccatcggtaaatttcaatcgtccttcatctatcgccgattgaacatgtcgtcgaaacacattgcaatcattagtactatgagaatgagaatcatgccatttacaataagctcgacgttttaattcttcttgagatggtatgatatggcctttaggtaatctaatttgcttttcttgcaaaagataatcaaaaattttatcacacttggccacgtcaaaactatacttatatgtatctgaatagaatttgctggtaaataagtaaaccatgtaaaagcagtaccggacaaatataaagaaaacaagcgcaatttatatgtatctgaactactagcctcaccacattgagctacaaattgacctacatgctgccatatggtcatactatcctcaccactaaacttggtaaattcgggaactccataaccacgaggatatgggatattgtcaaaataatcaggatacgacttttggtaaaccctagcacgatgttgatgcgaaaaacacgaggcctggaagatctgcttaacttcagtgcaagtccaaaaatcttgactttaggtttgtgagcgtgccagttgatttgatcctgcaatcaacaagaaacaaagacaaagaattcgtggttaaatcccataaatgatagtcgatcgggcaatcgccgatgacatatcatttatctttgagccgatgtcatatttgagtcgatcggcaatcatgaacaagcaagaaaagaacttaatctattcgatcggctgtaggtattaacggtatataatcccttcatcgatatatacttaaatcaagtgattggcatagatcggtcgtcatgccgagacagtataaaccagttagatcgaaatatatattaacaaaaggaccataagcattcataacatagccaatcagatagatctagcatatattggctagtactccgatacta

SEQ ID NO: 45437 - DNA, 485 bp, Oryza sativa
ggccgatcgatctctctcggcctctctccttcgccgccactgcctagggcaaatccccgcgccgacgccgccgtatctcgccgtcgtctcgagctcgtcgtcctcgccgccgcctccgcctcctctgctgccgccgcatctctggggtgagagccgccgcatctcccttcatgcatctcgatctctccgatcttgatctctctccgtcgccttcgacgccgccgccttcgacgccgcgcaacgccgccgccgcatgccaacgccacgccgccgccgccttcgccgccgccgtcgccacgccgccgcgccaaccgcctccccgatgccgccacaccgccattaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgagga

SEQ ID NO: 45438 - DNA, 1501 bp, Oryza sativa
ccaatcggctagaaacaaaatataataagcactgattcgaaggttaaagcatacatcagctggaggtccgatgtcatgaaatccacaagattagattaaacagtgaaacctttgtcgtcatttcctaaatccaacttatatgtatatgcaatccttatgagccgatgcaacgtccagataactcaccggctgaaaccccgatgaaacccttattggcagtcaaaaagcaggctagagattatggttctaagcacgacttagtagatcaaacttaactgatgcagcactaagtataaaaagaaacataatatctagacaatcaagtcgttgactgagttttcagggtggtagatgtctaagctaatctaatctaacaacgcgatttagccgataccggcagaaaccctaaaacgagaagcagccgatagagctaaattgatatgctaagactagattaacatagacatatgataaataggtagggaaatatatcatccaaaccagagcaatccaagaggtcgaatgtactgatgcagccttgaacgacgccgatgtagatgagacaattgcctgggccgacggaacattggacttaccccttcgctggagatcaaacaccgatgcagccccgcgtcaggtgccaactcccgctggacgataaaataaagtagaaaaggtaaaaggtggcgatgcgccgaattgtattgatcgtagcgatagattacatagaccccgggtgtacatatttatacccatgggttgatacaagtccttgtcggacaagaaagaaactaacctaaagataaaaggaaaatataaagtccttatcggacactacacacactttcctaaagataaaaggaaactaacaaactattcctaattaatagataaactgccatgccgcatcgtctttaaactcggtcacttagggataagcttcctttagtagattgatttccttaactgaatatagtaggaatctgactattggcgacttgataactcccatcggctgattccgagatgctgcagctgataatgattctaagccgatgacgtctttgccgattaccaaatttcactgttaacacatctttgccgattaccaaatttcactgttaacaactagatctgccctttatattaagatcttgttgcatctaggtatattaagcttcctgtttgatatattttgcctgctttaatatcttaatatagagtagtatcggagtactagccaatatatgctagatctatctgattggctatgttatgaatgcttatggtccttttgttaatatatatttcgatctaactggtttatactgtctcggcatgacgaccgatctatgccaatcacttgatttaagtatatatcgatgaagggattatataccgttaatacctacagccgatcgaatagattaagttcttttcttgcttgttcatgattgccgatcgactcaaatatgacatcggctcaaagataaatgatatg

SEQ ID NO: 45439 - DNA, 1501 bp, Oryza sativa
agaacaagaaattagtcaagtaatgaatcggctaacaattattcaagttaacaatggtgaggtttacctgaggtatgacatcagggaatagatctgtcatatacatcgaagccgattgatgaaacaagtgcagcttccattcaccccaccatctgtcgaagtttttgcttctaaatcctgcaaactcaatattatcaatgctgcccagagggggtcctggtaggttaagtagccgatccatcattagagtggatgtgatttctcctcagcattgaatcttgtcggcaaagaataagccgattgggagttggcctaatccaagttgtccagccgagctcattgggtgataaactcataagagacttggatgtttctcccttggtgaatgccgacaggaaggatgcatgggctgattgcagctgtgagaacttctctggattttggaatttttcatgattaatgtcttcaaatctaaagtctgatggaagttcaagatatgctgagtcttcataaggaaaccaaacctgtgcatctttcttaaaaccttcatagaagctgcagaaccagtccttgagcagctcagccgatagcttcgctccagcatcagttggtgtggatgcatattctccgtatgatgtgcatctgcgatgagtgcgttcttctccatcgtctcctacaatcggctctggcaatgggaactcagcttctgtcacagacgaccgattgacaactttcctaaccatcaggtgtaaccaggtttgcagcagccaccatggtccacctgcatcaactactgagccaacggctatcttggccgatgcgttgttcaatgtttggtataagtagccgaggaggatcttgcctaagggaaattctttctttgattctaaggcttcggctacaaattgccagttggttgtaggaccacaactggatccacaaaagaggaatttttcgagccacattagcaagaaggctacatgctctcgaggagtaacagatccttgacccatatatgccgccacatagccagaccagccacctatgcttttggttctgaaatcaaactgatttttggtgttcatgctcatgggattagccgatgaggttacatctaaaccggtgatcatggtaatgtcgatcaaagttggagtcatcggcccttggttgaacaagaaggtgttaatgatgttggaccaaaaataagaggcggctgccattaagggctcgtcattagctgagttggctatggttaggtcaagtgcttggccgattccaatctcatcccagtgagctttcttactagctgatacgcgttggtaccatgtgatccaacttttctcaggggtggttctctcaagagatggccaagacttgaaagtatttttctagtggctcaggttagggttggctagcctaaaggggatcctgttggtttcaacaatgataatcagtggggtcaagattgcctattagacccagaaaatagtggttttcatgc

SEQ ID NO: 45440 - DNA, 392 bp, Oryza sativa
tttcataggctatcaaatccaccataaaacatgagccaaaaccttcaagagatgttgaaaaacttgcaaagaaacccggtacaagtgttgtgacatgtaaaacaactcggagttgaaatttggcttaggtttttcaaccaacacaaagatgaattattttgagcactagtattcaaccaattatatgtatgtggtatcccccttaatagtacggcatcctaaactcaaatgtaaaaaggaaagttataccaataggaataccttcacaccaatttctttcttcacttggaggattaccggcgtcaaggtcatttgatcatcgggaaaatatcatcttgttgatctttgacatttcatcttccatttctcaaatgattgataaggataatcca

SEQ ID NO: 45441 - DNA, 391 bp, Oryza sativa
gctgtaagacttgatctaaactgtagctcaaaccttgctttacaactttgccattggtcactagctctaactctgcctggaactaattttaatctgaacccaaagttggaattccacctctgttccagacttagccaaaacctagatctcctctccttctctctcactagtcgctgccatgtgggccagggctgcatggtgggaccacattgtcagactcatattgctctccacacgggccactgccagaacacgcgcgccacgcgcgggagcacgcgtcgagcgcgggagagggcgagctcctcctctccatttccgccggtgaccgtacttaagccgaccgtccgaccatctttctctccctcttgcccttgtctcgtttcgcggaaga

SEQ ID NO: 45442 - DNA, 502 bp, Oryza sativa
atagcaaataattagcataatacacatcataatttgtaaattatataggaaaaatcatattaacttcaaatcatatgagatcaatctttttggacttataagatcatcctcagtatcactggaaatctacgtggcacaatctgtacaccaaacacctttaaaattttgtatagtaaataattagcatagtatgcactataacttgtaaaatgaataagaaattcatcccagctctaaaaataatgaatccaattatgtcgaacatacagactacaagaatctatttaatctatgacgaaaaaaattcatcatggatcactgaaaattcgtcacaggaatttgtccgtgacgattatacttatcgtcatctattgagcgtcacggattaaatctgccaacgttttctccgatatcatcacggatcagcacaatctatgacttttttaaccatcataaaactcttatgggctcgtgtagtccagcccaggcccaacctttgtga

SEQ ID NO: 45443 - DNA, 1501 bp, Oryza sativa
ctctctcactagtcgctgccatgtgggccagggctgcatggtgggaccacattgtcagactcatattgctctccacacgggccactgccagaacacgcgcgccacgcgcgggagcacgcgtcgagcgcgggagagggcgagctcctcctctccatttccgccggtgaccgtacttaagccgaccgtccgaccatctttctctccctcttgcccttgtctcgtttcgcggaagaactgaggtaccccgcctcggattcaccgggaacggaggcgtcatctccggcgccggcgagagaagtcctcgactccgtcgcaatccggtgagccccattttcgttcaatgcgcgttctgtaatcccctctcaatgccgtctctaataccgccaagaacacctcatttggtgcagccaatttccgggaacgcgaccgcgtcaactcggaacaccgacgcgctctggacgccgctgcttcgcctttgctcgtcgcccggcttccacagttcgtgacaagctgagcctcttcaccacgagcttcatcaacccctgtagatcaagaatcccgaaggagtcgacacgaggtggaccacggtgggagatcgttttcttcttccccaactccggccaccgacgccattcctttccttctccttctctggtgagcttcggcgcaatatttttcgcctagagctaccttgtgctgatctaaaccgaagcatgcatcctctctatgcagtagaagcctgggggtacaccgtcgacgatgaccgtagcagccgcgccgtcgctgaaccagtacaccgtcgccaagactttgccgagccgcgtccgctgcttggtgagcctcctagtagtccctagagtccttaccatacgcatgcacgattagatcgagactaaaaacccacatgcatgtgcaagccgagcttagccactgcttctaacaccctaacagccgctatagagcaccaaagcttgcaagaaagacaccaataggttcgcacagttgttctctataccttttgttttgggagcttgagctgaatcgccgccaatcgccgccggtgatgctgtgaagctctcggctgtgctgctgctctgctctatccagagcaagggcatggcttttgaaatttaaagactcccaggaatgtattagcaactcgagcagtcacttacatatggggtcgtgcactaatctgtaaataacataaaacacaagtcccattttgaataaaatcctggaacacgtgctaggggttgtgggatctattttctgaaaacccaggggcttttgcgaaaaacgttagtcactgactggtagacccgagagaggaaaatgatttaagaaaattggagaaaatgcaaaactaatttcctatcaactgaaaaatgacagaactttagaaatttgtagaaaattcatcctgactctaaaaattgcaaaataaattttgttggaatcatattttcatgctctgcatcataaaaatgtttaatttaac

SEQ ID NO: 45444 - DNA, 281 bp, Oryza sativa
agcgagcaggctgtctatatatgggcaattagttgcattaatatagtagtttataattgcaagcatggcactacatcacaacaccaaaaagacatgccgtgatgctagaacagccattgaataaattagaaagaaaggttgtggttaattagttaacgaccaatcgagcctactagtataaattgtacctcgttgttatgaagtaattcatcctgtagtaacgaaacaagcagagagagagagagagagagagagggagagagataaataatatacagaaa

SEQ ID NO: 45445 - DNA, 1501 bp, Oryza sativa
tggcatagtaggggttcatttgcaaaagcagcatttagcaaacatttgagaattataaaacaggagagtaattaatcatcaattgtaatcaacactaaacagcacacccatgctgctcaggccaaccatcctgaacaaccatacccggctggacagatctatctccaaaccaggaatataccattccaaaccaggagctaatcaaattattaccagttatagcatcttctaatatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacattacctctcgtacaacacaatccaccacagtgcaccactcccggatcataatcacccccttataaacaaggtatggactccccagcgaacccccgtgggcttatctccgccacttctcagtctggtgctccgcaatgaaccatgctatacaaaaggtaaagccgttgcccacgctggcttgtggttggcacggtaaatgattcacaaccgaaactcgtgaaccggtccttaattgtcatgagcacgaccatcaaaaccatgtgctcacaacccaccattatcaggttttagttggcacattaattaattaaccaatcacgattgaccatcgtgagctatcagtaagccatcatgaaataatagtgagtcataagttatcccaatagtgtgctaatgtttctaagcatggctaagcaatcacatgtaatatctagctgaaccaatatataaagctcaactagatcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttaggatctatgtgacttgccttgctggccttggaactcttcaaattcttctcctgcgaaaacggactctccggaaacgtcggaatctaaacagaaaggagcaaaacaccaaaacagcacataaacaagcatgaacagtacatgtggatatttttaacatgtaggtctcaattttagaaaaatttagagacttgaaccaactaaatccgagctaagatgaattagttatgaattttcaaagattaaatcggtttaaaacacttatatagattttaattgaattatgacgcaataatgaattatttttgaaaaggaaaagggaattattgcatcaacggctagggttcacggtgaaccgggtgcacggcggcggctcacggaaacgaacggccgagatcgattcatccaaaacggatagccaagatccatcggtccacgactgggccacgggaaacgacgacga

SEQ ID NO: 45446 - DNA, 1501 bp, Oryza sativa
atcacatgcgagacacacacaaccaaacttaaacaaacaaactaacacaacgatctaagacaacggcttgacaaggcactctaggtcttccgggcattggagttaattgaaggctcgttcggctcgtctccatcatcttgagtagctccccactcgacctttgaatgggtgcgcttcgattcttctccttcatcatcacttacattgacgaccggaggatccgctagggctggggtaacttctttctccaccacacggacctttggcgctaattggtagcgagggacaaatagagctctcttccttgcggtaagacgaatcctggccttctgcggtggtgcttctcccttcaacgcggctagttccttctccaaacgatccaccttgtcctctagcttgcaaatcttaccacgattccggtcttcacgatcttgagctgctagcacaatctccgcgcgggtttcatccatagcccacagcatctcaaccaaatgccttgtagtagcatcattctcaatcccctcagtctcaaggtagctgccacggtcacttccctgaggttggcgaggatggtagcgatactcagtgtcggccaactgatcactgtagcgatcgcggagctctcctatggcgatccttgccacctcctgacatgcatggatgtagtttcctcctccatcttcgaacatcactgatgggatatcttcactattactgttcaaggtgactttgactcggcacttctcttcgtgacgatcatgaggaatctgggcatacaaaggggcagtcccaaatcttatgacaaaggacatcgtacgcaactcctggacaaatccctcaacaccaaacaagtactcaggcttgaagcgcggcatctaaagacaagtgaaaggagggagttaagacatttatccaattaatagcgcaagtttttggattaatttgaataaagttagaaaatcaaagtaaaaggtaagtaaataaagtaaaccaagcttgcaagataagttgaaacagttggaaacaagatcacaaattttgcacttttgaacaacaggtttcaaaagaaataaaataaaagaaagttataaaatcaacaggctaaatttattttattgcagcaagattaaataaaacaatattgtaaaacatttactgataaaatgagccattagtacagtaatagatgtacagtactaataacactggaataaatttttgaatgagaaccattaaaagagattatgaagtccatgtgccattagtttggtttaattaaaagagaaagggaggagaacagttctacttttccaatatttttagagggctcctgtaggtaaccatttggcataacctagggtcaacctggctctgataccaacttgtcatgcccggaatttctatccaaaattccaaacgcttacatgtgtgtgaaccctcgtccaggaatcagccgaggcacacaataacaaattgataatagagtacaattattactcta

SEQ ID NO: 45447 - DNA, 1501 bp, Oryza sativa; identical to SEQ ID NO: 31296

SEQ ID NO: 45448 - DNA, 1501 bp, Oryza sativa
attagaacctacagtctatacattaataggattttccccattgtgtgctagttgaactaagcatggctaagcaatccctagtccaatatctagtcatgttatatcccaagctaacaaaggagcatggtaccaaaatagcatggctgtaacagtaggtaaacatctcatagtattactgtaaaacaatgcagtatttgatggaaaacattagaacatttgcaatataggatcaacatgttcaagtgacaagcatgacttgccttgctctgctgctggaggaacctcggcgactatctcaaagtacaccggagcgtcaggagagccggaatctaagcgacatacaaggcaaacaatacaaacaggctataagactactgaaacaaagaacaaaaccatttttaatggattctacacatttttcttgatttactgagacttgaatggacttaaacggagctcggatgaattagttatgattttaagaagattctctgtgtttttactagaaaagaaaagtccttaatgaattattgcgcaataaagcatcccagggctgacgtcatcacgggaagcgggcggcgccgacatgcgggccccatgggtcagcggctcgggagagagaggaaggggcgccggcacgtgggccccactggcagagacacaaggcgggagggggtgcggctaacaagcaggccccacgggcgcggctccaagggggggcgagacgccggcctggcccggcatcaagccggccggcctgccatggcaagggcggcggcgcgcgcgtcgctggcgacggcaaccggcggcggaagacggcggcgcgaaggcggcggcgcatggccgaagcggcggctcgacccggctcggctaggagggagagggaggggaaaagaggaggagggatgcctcaccgtgagttggccggtgcggggaaggacgacggcgaacggcgatggcgacgaccggggaacgacggtgaacggcgatgacctccgagacaccctaagagagggaaatagagagattagagggagagagggagtccacggcgagcggaaaccgtggccgatggcggcggttatggagagactcactggcgcacgaccgaagcggcctccgatggcggaactcggcggaggaggggtggacgaggtggagctcggcctcgcgaacccgacggcggcgacggcgcggtgcggtggcgaccctaacggcggctagaggcggccggagcaacgaaaaaggcgacggcgggtgggagcgcggtgtgggagcgatggggagcacgggagaggccggtggaaaaaaggaaaatgtggaggaggacgcggggacgaattatataggggcggagaggtcgggaacagccgggagtggctcgatttcgcaggagttagtgggggaagttggaggtggggagagagagagagagtggcgggattcgaagtcgaatcccgcccatttttggggcgcgcgagggcgggagacgcagggagag

SEQ ID NO: 45449 - DNA, 270 bp, Oryza sativa
tttgtcttgggaacaaacaggccgaatacgcctcgctgctacctctaacctcctacccccttcagttcctaatttgttgacgttttagacaggattacacataccaatgagtgattaattagtgttcctacttcctgttttacccctaacaaatacggtttcgaggtacaccaaaccacaacctgctcttggtttgagtggccatcgcatgcaaaactaaagctactagtcctaagttcgattcttggtgtccacttatttttgcactca

SEQ ID NO: 45450 - DNA, 813 bp, Oryza sativa
agtggatcccccgtggctccaggtgagctagagctatgtctgcctctgaaagcttcaagctgaggaatgctgtaattttttgtagcttagtagaaagaaaataatagtcagtacgatgctgtatttccatgttgttatacttgtgctcctggctgtaaaatatatgtgggctttgaagcctctatgaaatgatctggagttaatgtgtccaaatctgaatgcatgggctactcacacgactcgatagtcgataatgaatatttaacgtttagaacaagatttggtcctacttttaaagctctatcaatcaataactctcaaatgcctggtttgtaaaacaaaggggaattgtgagatatttgccttgaaaagttactatcataaaatcatgagcttattagatttcataagcttatttaaatataaaattgattgctcgagttataaaattcgactaaattttatactaaacatcaaatattatgacaggagtattatgttcttgtttatggatattttgtatgtctcatcctcacaaataagtacagtatgtgatcttcagtcaaacacagtaaaacagtttaagcagtcctaacttgactctagttcaaaagcccattaggcattagccattaggccatgtaatctcctgcatctttggcccaatattctggtccactctaggatcccggaacaccgttcgatccattttgagcggtcaagattgaggcggggagcgttagatgggtaactttgcaaatgagacccgcaaaatatacaattttccaaacatgcttgtgcttttcttgcaaa

SEQ ID NO: 45451 - DNA, 1501 bp, Oryza sativa; identical to SEQ ID NO: 31354

SEQ ID NO: 45452 - DNA, 430 bp, Oryza sativa
ggactatgcacatgattacaaaatgatccaattattcaatgaaatttacggctcgccgattcgttaaaaaaaattgatccaatgttttttgttttatatttctttatgggctagtccttatagaaaccccttggggatagcctcttgcaacgttagattgaagccagtaataacttcacttgactccacaaatcatgcaaatgtcactactatactatgacaccacaagctcctcaaatgcatgcatgcatgatgccacatacccccagttggcaccactacaataaatattgctatacatgctaacatctgtcactcatggatactaattaactccagcctaatttgagtatgccaaataaggaacagaactaatgctggagataacaaaaaacggaagcattgattcttgatgatatactcttgtagt

SEQ ID NO: 45453 - DNA, 1501 bp, Oryza sativa; identical to SEQ ID NO: 31403

SEQ ID NO: 45454 - DNA, 168 bp, Oryza sativa
agacaatcctctgtttttcttcctttgtaattccactgtcatatgttactgcatcccatagcaaatatgttactagattgcaatcatgtcaacaaatgcaggcaatctgacagttacatagaaatttctacttgtggttaatttacagttttctcatttggctacagc

SEQ ID NO: 45455 - DNA, 1501 bp, Oryza sativa
gctgaaaatatgatcctattgcttcacgctcatgagaaataaagggaccaatttgttgatatgcactgcaaaagtcgatggtcgatgctattcctgacttggtgtagagaatcacggacctctatagtaaactaagtttttgttctaatcattgatcttagtgattctatacggtcaaataattcagtttatactaaccaagcctcattgaaatgcccaaagaattttgtcgccttcttactgacaactggaaggacttaattctgtcatcttgcggtaatattcaaattaaaatgatgaactaaacaaggaattataagaaatcatacatacatattaggagacagaaactttggcatgggaacactatgttcttaagaagtggtccagccttcagaagagctctgatatttcgagttttcaggtaatgcttctttcccactacacctgaacatcaacggtgtgttgtagctgcttcaatcttcagacttttgtatgaagtttcatggtaaacatgtatctagctttcgttccagctgtgcacctctaaagctgtactctgcaaaacatgcatctactcattatattactttgcattgattttcatcaagtgcatgtgctactttaaaatattttctgttaagtcaactgatacgtaaatatccgtgtgaaactataatactctagagtctagtgggaaatattttgtagttaatgtataggtatcagttccaaggggctattactaagttgtatgtattgtgatactctagtagcacctctaggtcctgggcccaactctctatagaagcgaatttcaggtctagttaaaaaaaatcacttgctagccctcgtaaaaaaatgtgttaagaatcgacctattaagggtgggccctcgtataggggacaagggctttaaagcaggattaaggaccgatccatacgacgtgagtccgcgtgttaggggccaggtttcgtggcttttcttagtcggtttggttgaggcttcttcttcttaatgtggggtggtcatgcctccactggtcgagtttttttaataccaagttatatatatgcttattagtaaccaaatctgtgggatgtttgactgtattacagtgaaatactggagaaatctgggagttagtattaatgaggacttgttgctgtggttttctgactatgagctaccacaagaaatgataaatagatatctattattgaatctggagatataatgtgatactaaagcataaatagtactgctgcactgcaccatgcaaggacaagtggtccagtataagaaaacaagattatggccaacagctgcatgaacctccatgtgcagcttcaaaataaccggctgcctttgaatattctactgcttcccctcaacagagtcaacattagccatattgttttggttgcaagttgcagcttgcaacactcatttctcctgagaaacccaaccttcttgcaggtagaggaacaaggagggaga

SEQ ID NO: 45456 - DNA, 1501 bp, Oryza sativa
ctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcga

SEQ ID NO: 45457 - DNA, 636 bp, Oryza sativa
ggatcccccgtattttttaccagatcatgatattattcatattgatctttgattttgttgtttcacccttttttagcagcttgcagtattggttacagtgagataatatttgttcagcctgttctagtagatcttaactcatgcttgatcctttagcaaagtggtataaatttttagtttcatttcaaaatcaatctgttctaaagaaaatgcagctattaaaatgcatacggagtacacacagactagccgtttacagtacgctatattgtagtgtagactgtagagtataatcgttctgaagagccatttaatgtcatcggccgccctaatttaataaggttccgtaaatgcgtgctccatgagaggcttgtgaggtgggcaactccagtatcacaaagaaattgtgggcactgccgggaccagtagtggatgactagggtagtgagtgattttactcagtcagtagtgcagtcctgtactcctgtagttgttgtactcttgactctcccaaaccatcaaattgatgtctagtgtcatgcatacttgtaacttgtaagtgcacttccctgacagttccattctttggaagattctgtggtgtggcaattcggatattgctgaagatgaaggcgc

SEQ ID NO: 45458 - DNA, 1501 bp, Oryza sativa; identical to SEQ ID NO: 31355

SEQ ID NO: 45459 - DNA, 386 bp, Oryza sativa
ttttatagggttcttgatgtaccctgatgttaactggaacttattttaagataacttggtgtaaagtgaaaatatatgctaaatttggtgaaagaaaaagaaacatactactacccggtgtaaagtgcaatatacagtgaatttttactgttttcttttggagctaaactttatgaattttactaagcaataagcacccaacagaaataaggcaaattttgctacaggacacttcttatgtgtggttttagccctaggacactgcccaaactcactttttggggaaaacactccataaacgtgataatttaccagtggacaccgcgccgattaaaataataatttccagttagggaggagagagaaatcgcgtgaaatgtcaaaaa

SEQ ID NO: 45460 - DNA, 1076 bp, Oryza sativa
caaaagtgtatatgtatctatgatgttggtatttatttgccatttatttgtaggtaaatatggtcaaatggacatcgactggcatatttaccttcgttccataataattttacttttaggattcaaatctatcttaaaataattgttaaataaaatattaattgtctcataattacttctcatttaaaattatttttattttattcttaactacccttccacttttacttatacgtcatttaatgaggggtattatagtttttatctcaaaccttaatatatgctaaataacatagacttgtaattattttacaacggaggtagctagtatccaaaactacagcggaaattatgtgccgtaagcacgtcagttatctgtggttcctgctgtaagtggcattgtactgtaggatagggtgtagtactcgtgagctttttgtcaatgtgtaggccgtttatccgagtattctctctgtcttaaaatataagggattttagatggatgtgatattttctaatcctatgaatttggatatactctatatccagattcattgtactaggaaatgtctcatccgtctaaaatcccttatattttaggatgaagggagtactatccggtgtatcaaccaagtgagaaaaagatatttttatgaaaatatgtatgtcaacaaagtgaagaaaatatatttaaaagtaaaatttgtttgttttccttagtaatcattgggcttaccatgggaaaagggtaatccctcaccaaagaccctggtgttacctaattatggactttacatatgttgtgacagttttcaaaatgtatatttagtcactaaattttattataagaaatttaaaaatctcatgaagttatgattctaatgccataagtttttcttacaatttaacttcaaacttgttcaagatgacatgttattttttatcattttctggaacaagattgtcgatgtccccaatgtagccggatccggtttgcaacagagagatactttgtttgtgccgatggaaattactccattggcttacttgacgtcttgacgtgttgaccaacgaca

SEQ ID NO: 45461 - DNA, 1501 bp, Oryza sativa
ctatcgctactaccagatctccaggatggtggtgtgtactgttcttagtttatatatgaaattctgaatcacagatccacactcagatgagtatacactatttcttattcttcttccttttaatctctgtacgtacacgtagataaaaattaatcctagagttcagaatgaaaaatactgtgatttggatgaaaaaaatgtcatcaacagatggtagattaattgtcctttgcatgcgtgaatgttgttccaggatagtggtttgtgatggatttctttagttccttgaaatttgaatgaataagcccctaatctttttgttgcttgcaggtggtgtccggccgcgccggccgtctgcagaacatgtcgactcaacgccacaatccaacggcaccagcggagagaatatacacgcaaggggaaggatccttgtttgacaaactgtgatttggatgtacattattacttttcaatctgcgattcagcatgttcaatttgtgttcttgatcatgttttctcgtctgtgaggctagttcttttggaactacatatatctttgagaatatactaaaacttttggatcataatacgtgcatgcagcacgaacactgagttctgcgacagggtaaaagcaagtaataaaaatagcatatatactgctactatcttaaaaaatagcatatactgctactgctaaaaatggtatatactgcaattatcttaacaaaagtataaacctgcaccttaaaaaggtatatgttactaccaccttaaaaagaagtatatatgtatattgctaccacctaggaaacagtatatatactagtcttaactgaagcacagtacttaaactactttggtgaagcacagtactaagtaaaaaaaagaagtatatactattaaaaaaaataagtatatactgtcataaaaaacacgtatgtgggatatttatctgtatatatttctctacatcaaaatgaagtatatggcagctgcctataaactgctgcctactacaaataaaaaaaaacagtatataccgttgcttactaaaaacaaaaacagtatatactttcatgcagaaatggcagcatatacatagctaggaaatatactgcacgaaaaaagagtataaactgttacctactactaataataaaaaacagtttactaaaaacagtatataccctatatgggctcttctggccccagcttcctccaggagacttccatgtgggcccctaaatcagtgacatacattctaggcccatttgtgattgttaaattggacttttgggccttctcatgcaattgcagatcaccagcagactttcgactgattgattgatatatttccacatccttctcttcatttatgagtgcttctcctgcatacatgttagtagcatagcatatagtggaagtaattattttatttgggaattatgcattgcaaccataggtagtcttcatatattggataatattgacggtcgaaact

SEQ ID NO: 45462 - DNA, 926 bp, Oryza sativa
gtcggagtcgtccgtcaagcctgagtggaacagctagccctagaaggaattggagcaggcaagtgacgtaataatataaatgattgttatatttgtaatgcaattaattaagattattagagacctgtaattagacttatcatataagattgcgtagtgttctaatattatttgagttttaatataagattattttattgcaaattagacttagtatgacattattgactacggaattggtgcgactcctagcaattgactattgtagtcttaattagacttagcatatacacacgaaacacttagcatacatgactattttagtcttagcatgcaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttataattagacttagtatgtaattattgactacggaattggtccgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattggacttagcacgtaaggttgtgtagggttctaatgtacgacatttacacttagcatacaagacttagattgttaaaacataaatgtctcgtgacttagcagatgtttcttgtatcaacaga

SEQ ID NO: 45463 - DNA, 1318 bp, Oryza sativa
cacagtactcagcaagtcacaccgggagatgcatgattaatgcaagggaaacaaggggtaataatataggggattaggttttgcagtaaacagcatttaaaagacacttagttgcccatagctattttataaagacgatcctagagctacacagtattattaatcaaggccgtggacccacacgaacctgccttaacccaaggcctacgatgattcagaccaaactggcaacccgacctaggtcccagctcgtcccaagccaacccaggccaacctttccaccttttagttgttaagcaatttttaagaattaaaccactaacttgggtacattgctaggcttgcccatatccgagggcacggctattcgaatagatttactctgatcagaggtgtacatctttacccacaagacacatctttactccgcattccatggccttggaacccgtcgtaaacatgtgacataacccttcacccatcctagccgtaaacaaaagtaccgacccaaccctgcctacggccgatatcccgggacaggcaggccaggattgagcccctagcaacaggatctagaccgggtgcgccacacccataggggtgagaccacccgtgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtctttttgttcaggactagactgagcaccgagttaagccttacccattagacatgtggttatagtgctttgcaacagaggcccgaagaccggtccttatagtggccgaggtgctactagcaaaaccctgcacctcgagcccaacctaaaaccattttggggttttgaatagaggggggaggtgtgtgttcaattccatcacaagccaaccattccacagtgtccaaatgatatgagaattcccaaagtctaaagttataaaaccacctaatgttgcctaattagtcagcgaagcatctacctagattcatactagtggaactgttaatagagtacccactagttggggttttgtttatcctagggtgaacaaggtaataataaacaatagcaatgataaggctataacaaggattaataggaagtgctaaataaaacagtgattacgcgggaatttaaataaagcggtaatgcaataatttaaatcaaaataattttgtaaagtgggattcaatatgctcaagggtgatgtgacttgccttgctcaga

SEQ ID NO: 45464 - DNA, 358 bp, Oryza sativa
ctgcccttggccttaacccccaccaccacagcccctcactgcctttcacctgcaaaaaccacttgcaaccctcacaaaaccaaaaaacgccagcagccagcttccctcccccctccaattttagcaacttctcccttaaaatctccccccccccccccccttgcattgcacctctccttctctacccacaccacccccgccgtctccgccgccgccaccaccaccgattctttctccggtgccacctatggaagagatgatcaagccggcaccggcaccggcgtcgtcggaggaggagaaggaggtggtggctactgctgctactggagaaaggaggcatgaggaggcgacggccggg

SEQ ID NO: 45465 - DNA, 433 bp, Oryza sativa
agagaacagtagcaatttttccattttattttgtcaatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 45466 - DNA, 1501 bp, Oryza sativa
aagaggggagggaggctgacatatggatccgattttattttggagaggattaatagagagtttgttggagtgagtatctaatttgactgtctaaatcagaaggagagttggccatatgtatgtttggagagttcgatttggagagactatcggaaagactcttagccagaactaggcactgcccctgtgaccttggacacattgattttacaagttaagaaacataatttaaacttgatgtcaagatgatgcatcatgataacccggtccacaggggtacacagggtgaccactcctcttcccctctctgcatatgcgtcagccgccaggcgacggcggacggccaccgacagccgccgcatgcagctagggtcgtgcccgtgcgtgccggctttggcggtggcgtgtggcgatcaccggcgtcctcggaacgagcaagccaacgacgcgaggatgggacgggaccaggggaggagggcagtgccgcggcctgcagcggttgcgtgcaatttgcaaagcagtctggagcttggttgcgctggagattggagcagccgggtgggaaggagacgatcgagggtggatcatcggatcctgtttccgacaccaccacagtaaaggaaggctcgttcccaaatcccatttttatctgttggtgtgtaaaatgagaaatcaatgtacttcagttggttaatttttttttactgtaaactgtggactttatcactgcagagaccaaaatgaaggaagtatgtggatttgaaatcacactcttcttgttgtaagaacaccgaaattaataagcatcatgttctggatccatcagaaatgcctctcaagtcccatgaatcttttcgtatgctatatatttgtcaacatagattatagtttgtcaattgttgtttcattcatggattgaattttttttctaaatatgaaccttacatttagcttttagatacttcctctatccaaaagtctaatacctatttcattctttggttttccaaaagtctaaggcctatttgtaatctctatatgctaaattaaattgttgaccggaaccaagacgtccttttagtacttactccctccgtcccaaaaaaagacaaaccccggtttccgtgcccaatttttgaccgtccgtcttatttgataaaattatgaaaaaaattaaaaacacaagtcacgcacaaagtattaatcatgttttatcatctaacaacaataaaaatacaaattataaaaaaaattcatataagacgaacagtcaaagttggacacgcaaacctagggtttgtcttttttttgggacggagggagtattgtcacatgcatgtgtgtagttcattagttttgtcactgggtggatgagttaattacttcttggtcatggtgataaaagaaatatgtttttagatttttggatgaagggagtatctcttaatttctgagatatacatgcatttaaggtgctcgataaacacgtagctaaattatt

SEQ ID NO: 45467 - DNA, 1501 bp, Oryza sativa
tactacccaaataagtcagatattgagcatgatggatcctttagagaaggtgtgattacatgtgtttcaaagatggttaaggatgaggcaacccaagacattataattacagaactcaacatgtatcaagaacaacaagggacatttggaaaggaaattgccatgaggcagaggagaaacaagaattttaatccaagtgaagaactgaacctaatatgattgccggaaatcatcttttttttttgtcttcgttgtttaactttaacttgttgtgcagcaaagtggtggttgaaccatggcacaatcattcccaatttgaggatattggtgtcaaggattttgaatttgacatgtagctcctcaggttgtgagaggaattggtttgtatttgaacaggtaaaagcttagaactcaccatgacatgacatttagatttgttgatagtttagctgtttatatgtttgagaaataatttcagattggtatgattgcttgagaattgagttacctgctacttgttgccccaaaacattgacattgctagtctagtaatttaaattatctatctataatttgtattcataggtccatacaaagaggcgcaacaagctacttcatgataggatgagagatcttgtctttgtgaaatttaactccaaactataagaaacaagagaggcagcaaagacagggatcctttagagaaggaagtaaatgatgttgtggctgataatgagaatgagttcattactggtattgtacctctttctaatgagcttgctgaacatgatccacaagatggagcatcacagggagaaacatcacaggctcaaggaaaaaggaagaggcatgtgcgccctaaaaagaagaaaatcaggagtgtgcactctttgatgaatgatgttacaatgcagcccggaccttcatcatctgactcagaagatggtgatggcaatggcgctggagatgtttcagagggatcctctgattctgataagtctcatggtgtctttgaatctgattagtggaatgcaatattctaatctacgaacttgttgttcttattttgttaattaatggtcatgttcctgacttcttgtgatgaactgtttcttatttgtgtcaagaactcaagtggcatgtttatttgtttactataaactgttaaatttataactatgaagtatgaactcaagtgcccggtatctgtatgttctagtatgaactatgaaagtatgattgtatgagttaggaactatgaactctatgtatgaagtatgaatttgtgatgaactttgaattggtgatgaactctatgtgcaatgaaataagtgatatgtcaacttttagctcaaattctatcaaatttttgatttttttctcatattttacaaaactgctaaatgctttaactgtagctatagccggctaaagctgcccttagctgtttcaaggctcaaccgctaagagccttagcccgctatttaaaaccttgctcaag

SEQ ID NO: 45468 - DNA, 1501 bp, Oryza sativa
ccacaatatatgtagtgtctactatattgaaattctactgttataaatcctttctatcaattaaatgtttgcattttattgcatccatggagacagccagtgatatttttaccctaatttcactaattatttgctagttcacgagattaacatatcatagatttaaaaatcactaaaaaactcaaagtagtcttgtcttcacctgagaaattatgtaagggtcactaagtgcccagggcgtgcaaactgttatagcttgcttgaactacttttggatttagtacaatttgctacctatacctcgaacctttctcctagagaatttgtccaataatctcataaaacaatgaaaaacatttacaatttgagcataatttatttggttagattccttacgaatggaacgacttatatatgtgtccgtgtttacgggtaattatttctttatgcatgtggcataacgttttctctgaaattgtcatggcggtattgttttgccacgctaaaaaagattcaggtcttaaaatcaaagttttaaaaatgtttaattttaaaattaaaaagttcaaaaggttaaaaaaaacatggaatggatgagtaccagtgttgtttcgccatgctagcaatttttttttctacgcggtctaattggtgtgacaacgtttgtcttaccacgtcatcttgtctggcgtggcatgacaaaattgtcgtgcccgttgtgggtgacgtgacagtactattttgccacaccacgagggttgacgtgctaaaatgtttagattttgaaaataagttttagaattgtttgattttaaaataaaaaaaatcaaaagtttcaaaaaataataaaaaaattatcgtttcatactataagtcgctttgatatttttcttaatatttaagtttgacaaagtttataaaaaaacataacaacatttgtgacataaaataaacatattataaaaatatattaaatgttaattttaatgaatataatttgatgtttattttattaattgtttctataaatttaatcaaacttaagaaatttttactagtataaagtcaaaataacttgcaatatgaaacggaggagtatatttcaatgctcattttcctacttacctatgttatgtttttattttatttgtacccatgttatgttttcattcccaacatgtaatcagccaaaccgtcgactaatcatcatcacaataataataagaaaacaatgtaagaatgcaatttcatcaaactgaaagtttattaccaaaacctttattaaaccgaatctctctttctctctcgttatctttttctttcttggagcgaaattcatcgctccccaagagttgcggcgtgttccagtagcagcagtctccaactcctcttctcttcccttcccctcatctcgcgctctcgcctccgcgcggagctcgattcctaaaccctacctcgccgcgccgccgcgcgccggggagatcgccctcgccctccgcca

SEQ ID NO: 45469 - DNA, 618 bp, Oryza sativa
ttatgatcgtcagctaaaaccacctgtaaaacaggcgaggtaattactttacactgattttaatacttaatgaagatgaagatgaagatgatatatacaattttacaattaaagggtaaaatcatattcgggtaatggttgtgggagttaaaatgcaccttttccatcggcgctcataaaatatcctgagtgctgctatacatacgaacttctgtctacgatgtttgtacgatgaaacacccttctctctctctgcatcagaacgagacaagaagactgacatgctccataagtccacgttagccgtccgtttgatcgtaggaagatcgtactcaaacgtatagcaatttccataaaatatcttgtctagcccaaattgtctttgacgtactaccagtcttacctctgctccggataaccagccaaaagctcttcaaacgcagtggcaaaagactaaaaacacttggacaatccaacaatgcatccggtagtactactagaatgggaatgtcgcgtcatttaattggttttcaacatcaccgcaaatcagaaatcaggagacaacaaaataaagggagcgctaatagcagaaaacaaaccccaactttacaacactta

SEQ ID NO: 45470 - DNA, 309 bp, Oryza sativa
actaggctacttgctctgtccttgtgatttttcctcagtgaatgcacatagaaagccccactttgtattttctgcacaccatgcagcattatatggtctagcactggtaaaccataacgagtgcaaatccccttactgcatttgttacacagtagttttgagttttgacttgtactactattgtttttaatcaattccgatgaccaatgaaatgctttggttcatttctctacatctttatgaccactgaattgctgttgtttcctgaattttagctctttactgatcttgtgattgcacttttgcagc

SEQ ID NO: 45471 - DNA, 1501 bp, Oryza sativa
ccacctgcatgaaaaaatagcgatttttgcagacattttagggcagatgagcggctcaaccacacgcaaaaataggaaccgaccgtttggaaaaatggttttttaagtagtgtgaggagttaacgtgcagctcttttgctctacaagggcttcgaggagtctaaaatttgaaattaataaaaattgaattgtttcgtgtttggagactcaattatagagttggcattatttaataaaaaaattgttaataatacgtagttgtacgcggttttggggtcccaattacatcatttttcttgttttaataattttataaaattgaaaattgtaattattttgttctacttcagtatagactatcagttacagatttttttttatgttttaatagttcatagttaatatatgccaacttgtcataattaagcccatagcttataatagatgagctctaaattacccaacattcagaacagttgggtttttaatatgcagaacgatgttaaatgcaaatctacagccataacaatacaattcatccaagatcttcccgtctaattatgtgtgagctactacgaagtgcctaactagtatagttataaacttgtgtgaagttagaagcataaccgtatatataatccctctattttcctttacatggcatacgttagtttaattttgaaataatggagtattacttatcataagagggaacaatctttttaggagcacacacaggttggggggggggagggggggattagaatgaaaagagctcaaaaaatattttattatgcagaaaaatataataaaagcatcccaaaacacataattaagatagatacatgctcccaccggtcacaaatattaatttaacatttgtaataagatttttttcaaattttgaccgtcaccaataagtactgttgtaatctcataaacttattagatcttataatatttatctaatataaaattatgatttaagccatgcattggaccttgaaaaaaaaaatctaacttcatatattatctgctagaggaagtacttggttcagagagatcagtgtaacttattgttgaggatgcaaccagcacaaatttatagatttaaacaaatcctccttccagtaggtaaagtatagtagttcctaattaatgaatacctgaagagatgttattagtaagcaaaccagaaactacatcttgaaataagccatgcatcagacctacaacttggatggaaaatgtcagaagactcaggatcgcaagataaatatatatataattatatagctatatatattcaacttaattccttccgcaaacctataaaaacactccagcatggaaaaaattgcagatttaactgtgaacatcatgcacaatacatagtactacttctaaagcagctagtctgtgtgactcgtgaaccccagaaaagatgaagcatatatatatatatatatatatatatatatatatatatatatatatagga

SEQ ID NO: 45472 - DNA, 1501 bp, Oryza sativa
gatgggggccggaatatagtacgccgcttcgccggaaatcaccggatgtcaagatcaccttggtgtttacttttattgggatgcatgctactttgcttggtcttgcgaggccttaatcgccaagatgaatgcaggccggatctgatcgcaccatatggtcacaactaggagtgaaaactgtacgaaaactttctagattccgaacctatttttgaaaacggaatctatcagtcagaatttttcggaaacggaaatgaattcagcaatattttctcggtaacggactaaaaaatgagatgggcagtttccatcggaactccagaattggtcagaaacttttcggaaattttctcggaattactggaatttttgtaactgaaataccctggattcttttttcttaagcattgaatattgaataccatggtgtttggctgttatttttttaaaaaatatttgttatgcaaatctaaaattacataagaatatttttttcctgcatttaggatttatcaacagcattactcttttaaagatagataatttattccatagattgtgttttgtgatgtaccgttgatacttaacaattggacttatatgattgtgttttatgatgaattgttgaccgttgagacttgacaattggatttatcagtttgaggggttttttccgataaattttcgttaccgtattcgcgccggttcgttttcggtttcgataatattcaattccgttttcgtatccggggtttctgattccgattccgaaaaaaaatatgaaaacgaaaccgataaaagatggtttccgtccatttccgtaccattttcacccctagtcacaactactgtagaagcatggttgctctttattttttcatcaaaaaggaattcaattcaataagatatatgtaaaaatgcgtaaatcagatgtatccaattcaactattatagaccccttccaacccaacccctcctccttgcagcccaacccaattgacccacaccacccatacagctgcttcttgctagaacttttttatatttatatttatttttaaaagatttacaaaaataaattaccgtttcaaatatttgcaaaaatatcctcctcccgccctctaatagagagcgatttatgtgatgtagcagcacggggttcaaaaatatttgcatttaaatccttctcaccctctaaatgtaaaattttctgcaacacatagcatgaagtatttgtatgattgtaaaattctcgtatgatgtcggatgaagttaaagtttacatgaaaattatatagctcgacaagatctacaactttgtagttgattaatttttcattaaaataacttatgggtccaaatattccttataatgtcttagatttatttttacaaattctcatatctacattttaaacaacctccgatggagacaagctctatagcaaagatgtagagctcgacgagatctataattttgtacttagccattcattcattt

SEQ ID NO: 45473 - DNA, 1501 bp, Oryza sativa
ggggctattgtagcattgtcagatccagaagcagagtacaatgagatgctgcttaaagcaaaagctccaacaaaggtggttgaagagtgcagtcaacaaatatacaacccagatcgttcggattcaatgcagacaaccgtaagttagaatggagggtgaaaacgagtcttcttatgaaaacacaaccagcattacaaggtttggtatacaatgaccatcagtttggatctgaaaaattcgatctccgctgttggtgcacatattaatggctaaactacaaggaagtcgcagcacacctattctataattgggaattctaaaagcaacaaaaggacattttgctgaaagaaaggtgcctatgccaaggtggtgaaaagcacattggagcaaaattcatggtgtactacaatgtagagttagactagattacagctgacatgccttctccacaaaacaacagtgcacatgattttattgattgattgattcccctattgtggtgattgcactgtgtaataataataaactgataaaagaaagaaacccatactgaaatgcatttcatagcagattcatatatatatatattggcatgtatttgcaagattgcacatgtctcacctgagttcaaatatctgaaatttaccatgtactgtttctcaattcatgctagtattgatcctactggtgattgccccatcttgaaatttgagatttgagggcgagatggctgtttgctaatggcagcacttggttgagcatggctggcatgagcactgaacaccagatgtaagcaagggttgtactgcaaccagatcagatttgtgagctgaagaaatcgtctaagattgcatcttttcaactgattccaattccaaattacaatgggcggccggcctggcacgccattattccaatagtgtttatgaatcaattgcgcacgtcgcattatcggattgtgtcgtgccatcatcccagaatgtttctcatacgcaaatacacccctgtgagtttcacaacttttcgtagcctttttatctctgctcatgaatatttgactttaggacaagatttgatcaaatttttaaatgttgataataatgactcatatgtttacttttaaaaaaaacaaaaaaacgtgtggaatttctttgaaaaatgtaaaatttgctagattttacaaatttattttagtataacatcaacggcaaaatcttcaaaagtttcaatctttacttaaacgtcgattatttttggactgatagaacacttgcaattttggatggcttatggttctaagtttgggaataatgaaaaggtgagggagtttagtgtgattttgggaggatgagaaatatatatatggaggcgaaaatttaaaaaatggagccactcgcgagccacgactcgacctcgccgcggcggcgacgacgacgacgaccagcacgcactcgcaccggcggatcgccggcggcggcggaggaggagacgatgggcacga

SEQ ID NO: 45474 - DNA, 603 bp, Oryza sativa
agcctcctcccttcctgcccgttgtacgtgctgcatagagtccaagcagtcttcttcaagcccagatccacggcaccagtacaccccttgctcctctcctcgttgctgttcgtgtggacagaagagttaatataaactagatgatgccctatgctttgttgcgggatatattttagataatagagaaatgatgaaaatatttggattgaaatattatgaaaattgtttgaaaatgatgatttagcatgtatatgtttagttttaaaatgaaataaattgtagatataattactatatgcttgcatgttgagctttaggtgtttagtggacattagctttatagaaagaaaagtgatgagatattataaatgaagatttaatcgtaatcatgcctagaatttttagaagtgtataaataaacaaaccatgcacaaattttattatccaagcattgcatttcaagtttgaaaataagttggaaatatgtttaaattcattatttttaaaaaagatttactgctgttacatcattgcttgttgaagcagttggtggtttgtccctgccgctctcgtcttctcacatgatcttctcttctgtctagt

SEQ ID NO: 45475 - DNA, 516 bp, Oryza sativa
tccactagcgtgagtgttcaccatctgttgcagattagaaaggatagaagaagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccatcagtagacctcattggcgtcttcaggtttcaaccactagtttcagaactacttcaagttgaacgagagaggagagtagacaatgaaacaatttgcaaagaattctagataaggaagaaaggagaaattttcacaaattatgttttcggaaaattagtcctt

SEQ ID NO: 45476 - DNA, 1370 bp, Oryza sativa
tccactagcgtgagtgttcaccatctgttgcagattagaaaggatagaagaagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccatcagtagacctcattggcgtcttcaggtttcaaccactagtttcagaactacttcaagttgaacgagagaggagagtagacaatgaaacaatttgcaaagaattctagataaggaagaaaggagaaattttcacaaattatgttttcggaaaattagtccttaaggtttgaccatttggcttatcctacagtcgagatggctctgataccaacttgtcacgcccggaaattcactagtaatttccgaactaatttgtgcatagaaccctcgtccaggaatcagccgaggtacacaaactgacaatttaatatactgaatcatcaataatagcgttacatacttacaaaagaaaagaaaactgcagcggaattacggtctagcgaagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaaggggaaaatcgtaacaataccctttgcacaacacaactcaaaacagtgcaccgttcctggatcataatcacccccttataaacaaggca

SEQ ID NO: 45477 - DNA, 1501 bp, Oryza sativa
cggagatcgagtttgaaaacagggtaggaatcggctgaagtccagatcggctacgacaagatcggctgagtctgagtcgagctaaataagccgatatagccgattccgacaatacgacttgtgcgcgacatcgggttcaagttaatgtacttcaagatgattgccacacatggatagagtcctggaaaggcaattgtatctattaattagaatattttatgtgaattccttatagataagtgtgggcaaaagtctgccgcaaagacttgtggtatcttagagtttgttagagataatggttgtgtccggtatgggcatatcttgtaatcctcgggtataaatagaccccgagccctatgtaattttgaacacacacattcaacataatttcggcgcatcgccaccctttttgctttagttttgtttcgacgagttcttgctttcgggttgagctgcatcgatttcgatcttcaacaagaggtaaaattcgtcgtgatggattgcgttcttaggattagtgcttccatcttcatgacactctaatcttgtttatttaattcatcaaattatcatatatcttacataatctctagcaatatcgccatctagactactatccgccaatatctgtatgcagaagacagccgattaggttagatcttgacgttgatctagattatataagatatctatcattctatgaaatttctagtggcttgattgtctagatattgttcttctttttatacttaatgttgcatcagttgagtttgatctgttaagtcgtgcttagaatatcgatctctagcctgccttctagttgccgattagaatagtatcggagtttcagccgatcgtatctgatttaacttcatttgttctatatgccttattgatatgttaaatctgccctttatgttaagatattgccgtatctaagtatgttaggcttttgctcaatatattatacttgctttaatatcttgatatagagtagtatcggagtattagccgatacatgctagatctatctgatcggctatgctataaacatatatagtcttgttattgacatatatttcgatctaagtgatttatactgtctcggcatgatgaccgatctatcccaatcacttgatttaagtagacatcgatataaggagtatatattgttaatatctacagccgatcgagtagatttagtccttttttacttattcatgactgccgatcgacgcacagatgacatcggctcaaagataaatgatatgtcatcggcatctagccgatcggctatcgtttataaatttaactacggtttctttgtttctatttcttgttgattacaggatcaaatcaactggcacactaatacatccgaaggcgaattttggacctgcactggagttaagcagatctcccaagccacgtgttttctgtcaacacgcttttggcacacccggtgggacctgattagaagtcagacgtcagtccctcctca

SEQ ID NO: 45478 - DNA, 1501 bp, Oryza sativa
tagccgcgccgttgttcagcggcggcgcacaaggacgaagcctccgcgaagcagtctaagcacgacacggaagcggcgtcgtggggcctgacgctgtttcgccatggccgaagcatggaacagcggcggcgcgacgaggccgagtccacgcggagcattgtcggcgcctcaaggcccaccacgcgaggccgaagcgcggcgcggcgctagctcccggcgccgttgggtggagccggcaaggagccacggcctatcgcgcatcagcggggtcacaaggtcgaagccggagctcgatgtggaggcatgccccgcgccggaggccagccgaagttgaacgcacgggttgatgtgcatgagcgtacgtagttttttttttttttgagtggctccgaattcagcctaccacgggctccgaacgcagagcctaccgtagagaggctcggaatttggagcaacttgcggagccttagccgaggcttagaattgcaaacctacacagcttaagactgcaatatatatatatatatatatatatatatatatatatatatatatctcaattgctaacctatcttttttaaagtcgcggagaactactccgtccggccggaaccaggacggtctcgacgctgacttcgccacggagggtacttcactgggtctcttggacgcggaggtctcacattacttggccaagaaaattgcttcgcagaccggagaccgtatgaatctcatcatgacatttttcctttttgttttgaagagtcgcagagaactactccgtccggccggagccaggatggtctcaacactaactccgccatggagattgcttcaccggtctcttggacgcggaggtctcgcatgacttggccaaggaaattgcttcgcgggcaaaggctgcgtgaatctcatcatgaccttttttccttttgctttgaagagttgcggagaactactccgtccggccagagcctagacggtctcgacgctaactctgccacggagattgcttcactggtctcttggacgcggaggtctcgcatgacttagccaaggaaattgcttcgcggggcaaaggctgcgtgaatctcatcataacctttttttctttttgttttgaagagtcgtggagaactactccgtccggctggagccaagatggtctcaacgctgactccggcacggagattgcttcacaggtctcttggacgcggaggtctcacatgacttggccaaggaaattggttcgcggaccagaggccacgtgaatctcatcatgacctttttttccttttgttttcaagagtcatggtgaactactccatccggccggagctaggacggtctcaacactgactccgccgcggagattgcttcatcagtctcttggacgtggaggtctcacatgtgatttgaaatgtaattgcatgatattgtacctactattgcccgaggcagggcaacagcggtggtgcgagccgatcttgagcgcgtaggt

SEQ ID NO: 45479 - DNA, 1501 bp, Oryza sativa
tagcggagttggaataacacgatcgattaatgataagaaatgccgtcattgcatatatatatatatatatatcagctgtgccagcttgcatgtgttatccgactgaaaaacttcctaaactatttcaatccgggtggtcaaaaactgtcaacacaaactcaagtaacaggtcgagattatgaggtatgcagtgcagcgtcagagatgggccggtgcccgtgccgaagatacgtaggtagtagtaacgtacaaggaacagtccaaaaaaaaaatgtacgcggagaacggcgtaccaaactgcctagccagtagccactcgatggtgccaactggtcgatctcatttcagatgagagttgagagaggtccaggctattgaggatgctatacacacaatccaaacagcttgcattgcttgaatccgatcgagccgtgccagagccgccgcgaggaccaccccccaccccagaatccgtcgcgattccccggccgtatacgaaatccaatcattcgggggagaaggcgaccgatgatcaaccagacaaaattccagcgccggatggacgaagggcgtgcaaaacgccggggccgcgcgcgccgcgcgttgttggatggatggacgccacacagtgaaacacagcgcagggatgcacggccgcgcgtacggccgggggtgacgcaaggggaaagggccaaaaaaaaaaaactgtggctcgatcgattgatcttgatcacatcgtgcattcgtgcgtgcgctggatcagtgaatgcggcgtactacgttggggtggtacaggagaccaatgacacgtactgtacgagtacgtcctggccagcgattattgattgcaatcgatgcgatggaggtcatgttcatgtccaactcagacatgcgcatgcaggcagtcaggcagaggcgtagtaggagcagatatcattgcgctgacgcagactcggattcaatggcctgcatgcctgcccgcccggaatcatatggacgcctggatggacgtttacacgtcgtccgtcccggccctctgctgatttggacctcaggccacccatactcctatcctctgcagctgcagggcaccattcatcactcatttccgttctagaatttttgttttagggtgtgtttagtttctgaaaaaagtttaaagtttaaagaaaattaaaagtttatgtgtgtaggaaagtttttaatgtgatatgatgtgatggaaagttgggaataggggggaaactaagggcctgttcactttgatgccgttttcaaccttaccaaattttagtaaagttgtcaaaaaagtggctacatttagtttgctactaaattttggtaactatataaaaaatcctgtcagttgccaaaattttgataactatgccaaaatttggtaaggtttttttgacaacaaagtgaacagggccaaacacggccttactttttcatactttttgaaagctttagtttataaatagatcactgtaaaaaaatt

SEQ ID NO: 45480 - DNA, 162 bp, Oryza sativa
atattgctttgttttcccagttcatgtgcctagttaatttacttttctgttatgcgcttatcttgttgctaactggaactagcagatatctccatcacgcatgttctcctctgtcctactttctgttcttttggctaacatattatcttattaccacagtca

SEQ ID NO: 45481 - DNA, 1501 bp, Oryza sativa
gatggtactaagcctgatcataacggttgacgaaatttagtagtacaaaaggctgtaacaagcaaaaaaaaaagcaaaagtactcctaatggactagcataatcaattcgtgtagccgatgctaactgcagaaaataccaggaaaaacaccactaagtgaacactactaataactgtataggtagggcaattctgagccgcggcgacccatacagctcacaagcctaacggagcgagaaatggtaacgaaacttacgaatcctggcgacggtagggtcctcatcctggatctcgtcggcggcgcgaagcacctcgtcgatgtggacgttgtttccgagagacgacggcacattcccggcgatgccggtgacgggcaccccgaaggcgcctgccaaccgctctccccgcagcgccgcccgcaccaggcgctcccagttcgccgccgccctcgccatcacgaggccctcagatctaaccacacgctcgctcgcacactcagaggccactcgtcatagcccctgctcaccaagctgcttgcgatcgacctccgcgtcgaagcggatgggagatcggagattcggagctagggttttccgctctcggcgcgcagggaagggaggtggccgtgtttcaggggctcaaacgaagaggaggaagaaagcgtggggaactggggatatgccgagactacttttttttctcctttttttttgagagtgcccttttcgcgtttggcgagaccgcgagacggtttgaaaccttttgatgcgactgcgatctggaacggggggcgtgtcagcatgtgatgccgcatcgcgcgtcgcacagggcagcccgctcccactgtcaactgtccccacacgagaatgggtctagggcgcaagagttttgcggaatttttatatggttaattaatgtaatgtaatcttcacaggttctttataaacagtatactagtagaattatcgttgattacctagacgcgtgacgattagagcagtacaataagctgacacagcaggctgcaaaaatttccacgtcatgctattcttacatggagaagagaaaaacgaaggagagagaataaagcgagcgacatatctgcagcccggcgatagcacaagttcccatgcggaaagctcgcgtgcagtcgatctcacggattaaaaacacatattgtgggcctcatcaccaccccttttgatcccatgcgccagattcatgccatggcgcggcactggtacttattttcaggcgacaacacaactacctacatagacagagttcactcttgatcatacgcaagtatgtgcatgcttaattaattcccggattatgaaactgtaattagcatagtatagccattctattgtataggttggctctattattaactgtaaaatgacatggatgtaattagagccaactactggctatactattgaccttgctcttagagcaggtacaatagcagactattagccagctataagcatatttt

SEQ ID NO: 45482 - DNA, 1501 bp, Oryza sativa
agatagtttctgcaagtcccacacccctactcaactcagtcactttgctagctagtactattgctctgtagtactccgtattgtactactgccaactgtgacgcgaaaatgtgatcagttatgagagcagtgacatcaaatgtatatttcttctgatgaatcgccataatgctggcgaaggcgactctgtctgtctgtcttctccccttgcatatcgttccgctatgcagtgggcctcttgcactataagcatcaatcgacggagctgatcatgattcatgagtagtagctgatgctggacgacaatggcgttgtttggacagatagtagcttaaagttcgtagtaggagtattaattgctttttttgtctgaatcatagcgattcattcctcaaaaaactgaaagttaacacagcttttcaggtggcgaaagcaactacagaaccgcatggataaacgcaacgctcgtcgtcagcagcatcccctttattcttcatcatgactgacacgatacaacttacaaacagtaaatcgtaatttacctctggtaccaggagaagtgctccaagctgtttttttttcccgaaaatgaactccaagttacttttagtgtaacaaccgaacatgttacctcttgaggcacggtaaatttctgtgcaattatattgcacggcttgatcgattcggggcatgcatatgaagatatgcacatccaaagcagaggcacgcatgcatagaaaaagaagtcgcaaccaaacaagcagatgcatggctagccagctgcattggcgtttggcagtgtaggcagccttccattcccgtctttgatgaccgagcaacccccgctgaattggaatggtttttcgtagacagacgttatttgtcgtatgggcgtctccatctgacggctgttccaggacaggatgggcatgcaagatcgatgctcgtgaaagcgacaagcagctctcgccgcgcaagagatgaagacgggagaaatggaaatgctggatttttttaaaatatattttgctctctttaaaaaattattttacaaatgtattcataaaaaacttattttaggaatagatatttttcttgccgccagtgatcctggcaccgagatctaacgtctgagcatcaacgatattagtgacgacactctcatccccataagccgagatacagaagggttagctcctaagaaattagcgcttaggacctatttgtaattttttttaaaaaaaagactacaatctaattttttattacaaacatgtcatcgacgttaaagttttgtaagattttttttacattttaatccttttttaaataataataataaatctttaacgtcgatccccttcacatcaacagtttggctattagggggatgactagacgagggtgtcgtcgcttagacattgaagcttgacactgagaaaaatggtccatttataacataatttttttacagtgatctatttataaactaaagctttca

SEQ ID NO: 45483 - DNA, 1183 bp, Oryza sativa
ttgcatgtaactgattataactttctgttgatgcaaaatacaacataacagaaatatgaagtcgaacggaagtaacgcagatacagccagcattccagaacacaatttctcttaagaagatttcacaggttcacaagcctctggttcatatgcatagaacaacaaaactactgcaagaactccatgacaaatttgtgggatacaagcgaagtgatatctaatcgaagagggagaatccgaggtcgtcctcgctttcctccttctcttcttccttcttctcctcggccttgggggcctcggcagcagctccaccggaggcggcaccagcagcagcacctccaccaatcgcggcaccaccaccaacggcaccaatgatcacctgtatgagaattgtggtcagcactacataaaatggtatgacttatgaatgccgagtatagctttggttgatacactagtcatcaacaatacacagataatggcatgctatgctaccaacaagctagaattgacttcacatatacattggttactttgtgacaaaaattaccgataaacagcaaaagaactgataagaatctgatataagatcacagagccacatacagtcatgctaagaattatacagaaatctacagatgccaatttcaattatctggctagacaatttagtcgcttcagcttattcatattagtcaaacaattttctctcttactaaggtgagctttgtgtcaaagcccacagatattttctgggatctaaccaagaaccatatccacctgtataaacagcaaaacagctagacgcagctataaggcacaatcttgcccaaataaaaatacacacgaacaaatgatgctgatggcaatgttgaccacatgatcagaaggtgaacctctggattaaactagcattgtaattacactacaaagcaacaaagactaaaaaaatatgtgtatcatcactctgttgactgcaaactgcaacgagatgcatttgaacggctacataacaaggacagaatatcaccaaacatatattgaacatgaaacatcaacctacctaccaatcaatgcaaaatatcgcatatctggaacaaatgtgctattcagatccagctagcacatgaatcgcaagagatatttcttctatagcatatataacgagcaagaagccaagaac

SEQ ID NO: 45484 - DNA, 1501 bp, Oryza sativa
gggctcctcatttcattccttctgtgaacgctgtgcccttcgtttgggcatttttgtcattcagctggatatttcaaatcttgtgtgtttgatatgtattcaggaacgctaaatagatcaccgtcttggtctctatttgttcagagtaaatatcttccaatgctgcctttcagtttccattgaacctattcagatccaaatagcccttcgttgctgttacacacacctttctggtgttccactgggactggggtcaactgggggacacgcatcattggtgctcagcaagatcctttctcgtcttgttgcatgcgttcgacatcatcagaccagagtgccacaacgactgatcatgaacatgcactgacaaaggattccactaccaaacggaaaagaaaaataaagagcttccaaaagccgaaacgtgcggagcaaaatctgtagcagatgcgaaggattccacgagaatgagaataacaaattttgcactggttggcccctctattccatgcttgatgtgtgagtgatgtggccataaattagacggcagctaatgagattattatgcggtcacgccacgccacgccatgccatactcgaatcgaaccacaacttgaggtttccagctgcataccataccatgcctgatggcagcatgggaaggagtcgtcgtcgccgcctagtgatggaagtcgtttcacgtcggttaaagtggtgcactctgaaagggcaggagtagcgagtcggctactggggtgggtgagtggagtgagccagcagcagccgcgggggcaccgaaaggggcttgtcatggacagggaaacgccacttggaccgtcattgggtccactgctgcactgcgcaattgtaggcgcctagccggccaccatttcaggctctcagctcgtcacaagttctcaacgaaccctatgaaaacttcgtttcgaggctgcacgtttgcaatgtgagtaaataaaatcatttattgaagattacaattgtatttgcaaattcagttagctagagggtaaatctttttcagttacagtatctttcctaggaaattcataccgaattttgaatcatcatgttctgaatttgtactatcatacactacaaaattgattcagccactaattgtttaggctatccaagatttctgctaattatttcacagaaaatgcttgccatctctgcacggcaatagagggcgggtatctcgtccatccctcttggtcccgcactctctcgcgtggagcttatcttccaacggatacttgaacaaagctaatcgccttgtcagacacccgcatccccaccatccaaccccaactcattcccgctatataaaccctccacccagcgcagcggcaacaaggcaacaactcgcactcgtcaaagcagagcgaactctagtgaacaagcaagaggccgagacgccaacgcaagcttagcacagtcatggcgagcagcaggcggcagcagcacaagggttcgtggt

SEQ ID NO: 45485 - DNA, 1501 bp, Oryza sativa
ctctcctgagaaaatgtgatgccttttcatgcagatccagttctgtttttatctgaaaccatcatgggttatattcatgcgcgccggaggaaagcacaactccaagcaaagttgcttgtactacgtactgtatttgatacctctcccttcttgttggtgatctcgttcctctctacgagcacataggagtagtagaagatagtgacagacaacccagctggttctttcctcccagatgctaaaatgttcgattagtacaaggcgatcgaaaggcacttttctctctagacgaaattagcggtccatgaaggtagcacatgcctcggtttttcgtttttaagtacaccatgtttaatgtttgctccctattagcagctttccaatctcaatgcagcaacagcatgagcaaggcttgtagtaacaaactttgaggtttacaaaccaggaagttaattagatcctacccaccaaagtgtggctagttaatatgctactactaccactacgaaactaaatctgaaacagtacatctttttctttagacctgaacaggcatttgttggtgccatggtgtacctagcaactgttcggtgtgtaggagtatttgttgttaaccgagaaacgagaacagcttcagaaaatgcagcaacacgcatgagacagtacaagtccacaaggtcggaacagtacagaattgctcatctcgctagctcagctcagctctcatgcgtgtacggtgtcgcagcgaatgaaagttacaggctggaaaaattgatgttgccgtctgaaagtgaatgtgggggtaggaacgccataaaaacgaccgagagttatgatccctgtgcgcgtatgacagaacgcgtcttcagtaatggcgaaacccgggctagctatgctattgctatgcatctctgtctctcgttattactcctgtgacgttttctggttggcatacggtccatacggatcgagcaaagcagcggctccataattttacagcagctgcagctggccatcatcagttcacggccttcaaactcgatcgagcaacccaaaggaaaaatctcaagcaaaaaaaggcggtggttttagtgctccatctccgatctccaaacgcgttggaattctcagtgcacatcttaaagcgtactccctccctccgtcaaaaaaaaaaagacaaatcgggaaaaaaagacaaaaagaaaaaaaatttatgtgtccaattttgactgtcggtcttatataaaaattttttataattcgtattttcattgttgttagatgataaaacatgattaatatttttgtatgtgacttgtctttttaatttttttcataattttttcaaataaaacggacagtcaaacgttgggcacggaaaccagggtttgtctttttttttagacggagggagtaggagtactagtccaattgattttatgatctgtaccagtactagattcaattaaacggaatgattgaaatgccggatcgatcgagt

SEQ ID NO: 45486 - DNA, 1501 bp, Oryza sativa
aaactttacacccctggatctaaacacccccttaatcaaaaacaacaagtgttgggacttcagttcttttctgagaagatacctggctcgaaggctcatcggttcgctcattggcaccggccgtatacacggttgtccctgcccgtttgagaaatcgccgtacggtggctgaggcgcttcacgacagagggtggattaggaacatcaccgccgctcttggcgtccaagctatcctggagtatttcaaactctaggacatcctcagatcagttcaactctcggatgagcctgactctctgacttggaggtgggagtcctcaagggagtattcttctcggtcagcataccgtgctttgttctcgggtagaatccgttttcaatacaagcctaattggaaatccttggcgcctcctcgttgtcgctacttactttggttggtcgctctcaacagatgctggacggcagaccgtctccagagccatggcttgtcgcaccctgtgcgttgcgttctttgtgatcaaagtgacgagactatcgatcaccttttggttgcatgtccagagtcttggcagctgtggtggattgctctcagagcaattgggctttcgaaatgcttgccgatcaatgaccttcctttcatcattggctctgtgatagcaaaaagaagatgaccaaggcgcatcgtcggggatttgacaccatcgcaaccctggtagcatggacgatctggaaagagagaaacaatagagttttcaatcaggtcagcataacttgggtggagatcgctcgggccatgatagacgaagctgatctttggaggctggctagggctgccatacacaccttagtagtccatgtagatagagagaggtcgcttggagattaggctctaatgctcttgcacctctcctgtatcctccccgtcttgtttttcttttgttatgtccacttgtacataaactttatttcttcttaatataaagatgcgctccttgcgaattcccaaaaaaaacaacaagaagcaagtcatctttctttttttttttttttgacgctgagcaggtaatcattagaacagttagaacttttaaaaagacaaataatgctgctgaaaatattccacgaagaataatctcatccggccaggttccaagcagccagaacttacttatgcagaagctagtcatccatgggtagtatcagtgtttacacttctgagaatccgtatagtaattcttctcagagtgtgggtgtttctcgagctatgcatctgataaggaagcattgcatctatcaccaggaaaaccaaataattgagctacagattagttataccggtcttactgtccaataattgatttttttaatggaatcatagtctcacagataccaccaaagccaatactcctccattgcctgcatataaataacacaaaagcagaccggtcttggcaaaggacactcactttgctttctcatactcgttggctcgttgctcctt

SEQ ID NO: 45487 - DNA, 412 bp, Oryza sativa
ttggctcaatcggctaaccccatccgactcgaactctgccgatcttagccgtagtcgattcggattccaaccgatccttactctgtttccgggacgatttctcgatttcttcttcatctccgatccctgaattaccaaatttggtcgttaacacatgccccccaagtccagaatattggataatgtttcagatttgccatatgtcgattccgagagaaatccgctcttgccgttttttgactgttattccagcgctttaaatactaaccattacccccgagaaatctcacaccatcttcttccgttttcaccgccgaagtaaactctgtcttctctttcctcggcgatttctctgacgcacaaggcgatcctcagacgacttcgtctccggctagatcgtcgcccgcggcga

SEQ ID NO: 45488 - DNA, 1501 bp, Oryza sativa
cggactagcgggcctatggctccatcttcacaggcgctcaactggggtataagccaggacttcacctaagacatcttctccaaagcttctcttactgaagaggggaaagattgagcaagaatgagtacaaccacagtactcagcaagccacaccggcagatgcatgattaatgcaagggggtacaaggggtaataatataggggttaagttttgcagaaagcagcatttaaaagtcacttagttgcccaaagccattttataaagacgatcctagagctacacagtattattaatcaaggccgtgaaccctcacgaacctaccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcacggctattcgaatagattatactctgatcagaggtgtacatctttacccacaagacacatcttcctcacgtgtaaccacgtgccacataccaccacggtatacggacggaagacgtgacatagttcccaacccatcctagccattaacaagagtaccgacccaaccccacctacggccggaacctccgggacaggtaggcaggattgagccccctagcagcaggacaccagccctgtgccatgacatctcgactaccggaccgcagctcgtgtagccttcatttgtcccagagatgtccatcgacccccgacttcgtccatctccatccgtgtacttttgtttataaccagactgagccacaaactaagccttacccactagacatgtggaagtacggtagtgctttgcaacagaggcccgagcttaatccttatattggccggagtgctacttcccacaactggcatgcacccaaaccccaccgaaaaacaggttttaggggctttgaaagaggaagagaggtgtatgtccaattccaccataatccaacaattccatagtgtccaggtgatatgaatattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataatgtcttaacaaaggtaaataggcatggctaaataaaatagtgataacgcgggaatttaaataaagcggtaatgcagtaatttaaagcaacataattttataaactgggattcaatatgttcaaggatgacgtgacttgccttgctcagagagaacggccttccgaaccttcggcgacgaccgcgaaccacgcttctggaacctccggaacgacgaaagctacgcgaagcacacaagcaaagctacaagcctataaagaagcaataacaa

SEQ ID NO: 45489 - DNA, 1453 bp, Oryza sativa
gtcctcgtccccgtgcagccactgccggctgtcctcgtcgcctcctcgccggtcccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccacgtggtttccacgtgtgcaacccgtgtggtgtctagtggagtccgtttgtcggccactcgcctcggttgacacacgggatccgcttccgtcgacccggggaccgtctctgtgtactcggtctaccgcggttctttaggttgacatctggggtccgcatgtcaacggcgcagccctcctgtcttttccaggctagcgcttatacatgttttatagttgcaaagcttaattataataatccgcaaatctccatataacagcattaaacttcggatgatcatatcttggtcatacgagctccgaatcgacccgttcaagtctcttaatgtttgttataacctaaagaaccctgtgctttgtttttatgtattgttattgcttctttataggcttgtagctttgcttgtgtgcttcgcgtagctttcgtcgttccggaggttccagaagcgtggttcgcggtcgtcgccgaaggttcggaaggccgttctctctgagcaaggcaagtcacgtcatccttgaacatattgaatcccagtttataaaattatgttgctttaaattactgcattaccgctttatttaaattcccgcgttatcactattttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaatattcatatcacctggacactatggaattgttggattatggtggaattggacatacacctctcttcctctttcaaagcccctaaaacctgtttttcggtggggtttgggtgcatgccagttgtgggaagtagcactccggccaatataaggattaa

SEQ ID NO: 45490 - DNA, 296 bp, Oryza sativa
atggccaagttatggccatttgaagtttatatgctctttgaatgaaaatttgcgaatttcttcatttggattttattttaaaaagggtttattgcgtcagccgagggagaggggcgcgcggaccgggtccacgggagtggggcccacacgcagcctcacggtccacggtggaccgggtgcacccgggctcacaccggccggcgccgtgggccccacacgtcagccgcacccgagggcgcgggcggctgacggccgggccccacgcggcagccactcggcatgctcgagggctgcca

SEQ ID NO: 45491 - DNA, 994 bp, Oryza sativa
cagacaagaacaacaacaggctcaacagaggtatgatgcagcgtttcaaatcgaccctggacaggttgggaataaaagagctgcccctctcaggaaagaaattgacttggtcgcaggagtgttctaacccaacgcaaacgaaaattgatcgagccttctgttgcctggaatcggatatcctttttgactctgcccaaatgtctgctctctccacctcttgctcagatcatgccccccttttcataaccggctgtgtagaaagagagcaaaacaattccttcaggtttgagtcgtattggctcaaattcccggatttccttcaaataactgaagattcatggaataggcctatacagacctccaatccttttgtaagacttcatctaaaactaaaaagacttgctagagatttgagaagatggaaagctacaaaaattggagacataagattgcagttgatcattgccaacgaggtagtttatcagcttgatgtagcccaagaggaaagaactttgtcagatgcagaacagtcccttcggaaatctcttaaatccagaattctgggacttgcagccattgagagaactcgtctgagacagagagctagaatcacttggttaaagcttggtgatgtcaattcaaaattcttccagattaaagcaaatgggcgaaaaagaaagaatcacattcttctccttcacacccctagtagtgtcgcagttacaaaaagccaaaaagaagaaaaactcaacagatacttcactcaaaagctaggttcctttgttattagggagaaaagtctgaactggtcatctctggacctgccgacagtagatctctccgaccttgatgaagaattctttgaagaagaacttaaggaggctatctcagacttaccctcagaaaaggcccctggaccagaaggttatattggggcttttttcaagcaggcctggagcattatcaaaacggatctcatgcaagctgtttcttt

SEQ ID NO: 45492 - DNA, 433 bp, Oryza sativa
catataagcagcagcatcgacaacaccagggggcatcgaaagatcatttggacttggcagagcagaacctcccggcggcggaggcgacttgggtggccggtgggcaccctcgtcgatctctctcccctacctctcctccgatctccagccttccctctcccctcggttctagaagtttccagcacttgtattccatagcttcttcttctcttgtccccaaaacagttgttgcttctatggtggatgcttgttgttgagttggaagtagtgggttcctaacaatgtataacagagaatgtttctttagaacactcacttctatatatgtatagatcttttaaaatttccaattatgatatttccaaagagaatgaccatatatgcaatgtaatagaaaaaaaaaatgtttctgcagcctaccaagtaatgcaaa

SEQ ID NO: 45493 - DNA, 1501 bp, Oryza sativa
accaccacctcctcgccaatcaggggcgcgccggaggcagcagaatcaaatcaaaattcagggctacgagatgcggcgcgcaaggcgtgatgcgtgcgagaggattgcgaaggtttcgacgcaatcaacagaaattttatcgaaaagcgagtggattctggattggggattggggatttcgggaaatcggcgtcgatttcgtcagcgtgggagccttgcgggaaaggggaaaggagcctttgccgtgcggtgaggaggagatcggccaagttttttccggtttttttctcatccgtgttcagggcttcaggccaatatgctactcgaggcgtcgtcacggcccatgtaaacatatgggccgaaattttagttttttaatttacagcctatacacacgtgaattggagtagaacgtgaggagatgagcttatacatgaacaccacaaaaaccacctgattttagtttgaaacctcaaagatagattgaattcttatgctcaaacgttcgtgtgtgttatgatttttgagagtggaatttctgaatcgagtgcctatatatctgataaagttggaagagtgaactcagggtgtgattagttcacactaaaattgaaagtttggttgaaattggaatgatgtaatagaaaagttagaagtgtgtgtagaaaagttttgatgtgatgaaaaagttagaagttcaaataaaaagtttgtaactaaaatcggtcctcaattttgaactgaagagctcgaagctagtagtaagccttttaattttagggtcactattgttggcggctgagttttggcagctggtggcctggtgtatgttccgcaggctccacgaacaccatcatgctcccgtcctattcccaggctttttctctctgtggtggctggagtagtactatccatcaaatcatcgtgcagatgcagccagcagtggagaatatttaaactggcataaccacaatcaccaacgaccaaacctagctgctgctagctatagctacgagcacaagaagataccctggctggcatcccattcgttgctatactcacacggaggaacatcatcacatgaattgtccatggaaacccgattctcagaattatccatatttatgaatttaactacggctgtgtttagatccaaagtttggatccaaacttcagtcattttccatcacatcaatctgtcatacagacacaacttttcagtcacatatctccaatttcaaactttggttgtgtttagttcagcgcaaagtttgtattttggttgaaattagagatgatgtgactgaaaagttgtgtatgtatgacaggttgatgtgatagaaaaggactgaagtttagatccaaactttggaactaaacacagcctactaaccagtatttatccatatttatgaatttaactagtagtatttaatagagacatcaatacgatgttggtatattagaaacaaaaaaatactacttttaaaaaacgatattc

SEQ ID NO: 45494 - DNA, 1501 bp, Oryza sativa
catcaatttcagaccctttttgcaccggctactcacaatgttacgtgtcttctcaattcactctactccacttcaaatttgcctacctaacactacgagtctccgaacaatacttggttcaacctaacagtaacagactacatcacaaacaatcaggagaaatgctaattcaacctcttaacttgcagacaaagataggctgaaattctagtcacaccaaaccacagatgtggctctcacaggtcactagaacatcatctaaaacttcttgattacaccacaaatccacaatccttatcaattaagatattcaagagcacaaaaaggaaattaaaaaaggcatggtgaagtttcttgcttaccaactgaattcttcaccaaggttccagtgttgatggggacctcagcaaccaccttagcaacggctggaggccggcttacatgttcaggaaatgccagcgccgatttcttcggcgcagccccagctgcactccccacacggccaccgcggttcgccgtggggctagaaatccacttctctgcatcatcccacttcgacggcgtcggcctagagaacggtggcagcaaggcggtcaccgccgccggcctcttcaccgtcggcgggcccgacgagctgctctcggagtcgaagctgtcgtcgtcctgagctcggtttcttgatctgtggccactgttgctcgacatttcggtggaggtggagcactccatgctccctgttgacgcaattagcgatttggtgaatccgtaaatgagaatgattgagctgtgcaacaccatttctggggtagtggacttactctggtcgtccagctcgccggaatcgttggcctcaggcgatgtgtcctccccgttgtgctgatttttctctagtccgagaagcattgctcgtagcttagctggggagaatccacccgactggagcaggaagaggaaagaaggaaagattttagtggaagctgaaagaaattggggaaagctgtggtgaatcaaatcagtaaatgaggcaaaattaactgcgaaaattgccaaattccgacggaatcacagcagaatggacaaaaggatccaaactttttagtgaagtgtgcactcagataacccaacctatctcaatcccctccttaccaaagccaacatttgaaagctatggcacagaaagcatcacagaaattgagacaaaactggcagagcagtgacccggtagagcagcaaacaggataaaagcccgcaaacttttcagcaaaatgcgcgccgaattagccacacaggcgatcgttccaggcctgaacattgttggccagtggccaccaccacaaaagtacagtgccgaccaaaatgtcaaggcgaatttgagaggagaatggaagagacgaaaaggagcactgcaggggaatctatcaacggcaatatcccgaccaatcgatgagaaaacatcgagttcagcaatggcaggcgtgcctgctttccaagaatattagca

SEQ ID NO: 45495 - DNA, 238 bp, Oryza sativa
  unsure (1)..(238): unsure at all n locations
cccttctctcaaaaacataagtccttaggggagagaattatacttttgtgagagaggttaaagtttagtccntagttcctacaccccctaaagtttggccttctcttccaaacacccccttaatcatgcaagcccggcgagtgctacgtctgcctaacctaaagttttaaagggctagacaattagtagtagcttctcctaacctcgcagcaggacaattgacagtacattgctacca

SEQ ID NO: 45496 - DNA, 1501 bp, Oryza sativa
ccacgctttgcagtgacagtgtctctgagtgtttagtaggcgttgcaatcgagcgtgagtttcgaaagggaaaaaaaatgacaccttgcatgcgtgattctgaatttccgaccattgttctgttgttggacaattggtattgtaatttgtaaagaaacatgaagaaacgggaacgctgaaatgtgaacttcaccaaaagacactcgctgccattcgtgtccgttctgatgcaaaaaggctagacacgagcatcattcgccagctcatttccctgcatcttgagaatactcgtctctctttttctagcataattagtacttacctgtaacaagattccaaggattaatccacggatgatgtggcagaacaggtgtactggatcaatcctacgccctttcctcacaaaccgggggccccctttcacccccatttcaagcaataaaatgagggggaaaggcaagggttctacactacactgccactgcaacaccctcttctcctcttcctcccccaaaaaaaagcctataaaaaagtataaaaccattgcaccatcgagcaaggcagtagcagtgatcgaggagaataaaagcagaagtagtagcagaagcaagaaaacactttgagcatttttgttttgttctccttgcagttacagctgaagcagcaagcagaagattaaccctcttggctaagattcaggttaacctgcagcgagaggttagctcagctcagcttagcttagcttaagctttgctcgagcttgccgtgcactccactgtctcttttccggtggtataatttggtgcggcggtgagctgccggccatgtcgaccgtctcctccgcgctgtcgtcgttcctctactgctgcttctcccccaccggcggccaccggcacggccaccgcgccggcgcgtactactacagcagccacccgacgagcaccaacacctactactacgagggtggcctcgccggacgcaggatgggcaggagcaggccactgtcactgcaggtatttgttcttcttcagcttgctcgttcgttcttgctttgcttgctctgttcctcgcttcctctgtttagctatgctacgcatgcagaagacggacatattctttgttcagatgaatacgtatttgcaagctagcttgtttatgcgatattgcgattgcgactagtcgtgttcagattattctcctcagatttttgtccgccacttctgatgctgtctcctagcttaacgctaattaatttcctagcatatgctcgtagcgataatctgtgctgctgtgcacgttgctgtctagaacagcccgcgaaaccaagctcatgcatgcgtgcgaaaaagagagcgataaaaggttgaaggaaaaaaaaagggcaacttacataggacaagggaaacttttccctcggcttgccgcatgcgccggtgttggagacagtaaaaatgtactcgtaccagtagcaaaatactacagtaggtgtatgtatcattca

SEQ ID NO: 45497 - DNA, 1501 bp, Oryza sativa
cggtgtattttttgtaaaaagtttctatacaaaagttgcttaaaaaaatcaaattaatccctttttgaaaaaaaatagctaatacttaattaattacgtgttaatggactgctccgttttccgtgcgcagaagttgggttcccatctcccccatccgaactcagcctaagggaagccttaattaatcagcttaatgagccccactaccactaaccacactataatacggtacaaatagatcatatatacactagcatagcacgaaatcgcaaagtccactaacatcccactcccccttccaagcttcttgtctcctctcctctccccaactcccacgccatctcgccaccaccaaccgattcaggccgcgcacgccattaatggagtacgagcgcatccacggccccccgctccaacgtcaggtggcctcctccccgcgattcccgtgtgaatttgctctttcttcccggatttttcgactttcttcttcttcttggtttgctcttcttctttcttggcggtctgcacccattcggagtccgagctcatctccgagtccatggcgcctctcgccttcgatggctggaactgaaatactaggcattagcgccacttatcttgcttcgatttggtaaattttgctcgattccttcatcgtggagttgtgctgttcttcgtactggaggtgtgtcctttttaatgattgctaatattcttggaaagcaggcacgcctgccattgctgaactcgatgttttctcatcgattggtcgggatattgccgttgatagattcccctgcagtgctccttttcgtctcttccattctcctctcaaattcgccttgacattttggtcggcactgtacttttgtggtggtggccactggccaacaatgttcaggcctggaacgatcgcctgtgtggctaattcggcgcgcattttgctgaaaagtttgcgggcttttatcctgtttgctgctctaccgggtcactgctctgccagttttgtctcaatttctgtgatgctttctgtgccatagctttcaaatgttggctttggtaaggaggggattgagataggttgggttatctgagtgcacacttcactaaaaagtttggatccttttgtccattctgctgtgattccgtcggaatttggcaattttcgcagttaattttgcctcatttactgatttgattcaccacagctttccccaatttctttcagcttccactaaaatctttccttctttcctcttcctgctccagtcgggtggattctccccagctaagctacgagcaatgcttctcggactagagaaaaatcagcacaacggggaggacacatcgcctgaggccaacgattccggcgagctggacgaccagagtaagtccactaccccagaaatggtgttgcacagctcaatcattctcatttacggattcaccaaatcgctaattgcgtcaacagggagcatggagtgctccacctccaccgaaa

SEQ ID NO: 45498 - DNA, 1501 bp, Oryza sativa; identical to SEQ ID NO: 29431

SEQ ID NO: 45499 - DNA, 402 bp, Oryza sativa
ttatgttgctttaaattattgcattatcgctttatttaaattcccgcgttatcactgttttatctagccatgcctatttacctttgttatgaccttattattgttattgttattatttccttgttcaccctagaataaacaaaaccccactagtggacactctactcatggtaccactagtatgattttaggtagatgcttcgctatttaattagttaacattaggtggttttacaactctagactttgggatattcatatcacctggacactttggaattgttggattattgtgaaattggattcacaccgccccctctattcaaaatccccaaaatggttttaggctgggctcggggtgcatggttttgatagtagcacctcggccatataaggaccggt

SEQ ID NO: 45500 - DNA, 1501 bp, Oryza sativa
taccgaggtgcgagcttcccttttgtctgaaacctgtgcacacctcgcaatggcgtgacccgaaggtatacaaaatcacccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgttaactgttattgtaggagaactcggcataggggagactcttatcccaggtcttcccaaaatctaggacacatgcgcggagcatatcttctaggatctgatttagacgctcggtctgtccatctgtctgcgggtgataggcggtgctgaaatttaatcgggtacccagctcttcttggagcttcttccaaaagtgagaggtgaattggcttcccctatcagatacgattttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatcttcgtactgccagggtggatggaataaggactttcatgagcttcctgaagtatcagctgtttaagttctctgttatctggaacgcatacccgctttccgtttcatagggttccgtgttcatcctctgtgaaaccagcggctttaccctgtttcatattcttgaggagtccatgcatgtccggatcattcttctgagcctcgcggatttgatcgagcaaggtaggcttggcttctaacgcagctaagaatccacgaccaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcataatccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaagtcatgggtagggtagttgccttcatgaggccatagctgacgtgaggcataggctaccacgtgac

SEQ ID NO: 45501 - DNA, 1501 bp, Oryza sativa
gcgagtccgaggatttttcgcttgagggcggctctcagccacatttcctgaggtgatagatctctgtgctcttgagcaacatcgagcctttggatgacgtcgagcgccatgtggaactgcagcttggcctccgtgcagatgccttttgcccaatctctaagaccgaccgcagtgcgctggagcttttggttgagccggtgcataggctcggtgtgcgacgatgactggctctagagagccttgactttgtccttgaaccccggtatccttgtccagaaattttcaaacttgaatctcctcggactgcgtgggcaatgcgggttggagaggaccagcgggcaatggtcagaaggtccagtaggtaaggcatgaaggacatggtgggggaaagcaaggtcccattcctcattgcaaaagcatcgatcaagtttgacgagggtggcccttcgacgctcgttgctctaggtaaacttcctattctgcaggggaatctcatggagctcacatctgtcaatgactgatcggaaacgtctcatgcgtgctaggttgatattgctattatttttgtcttgtgctcggtagatcatgttgaagtctccaaggattagccacccttccccggagctgggccttagtcttctgatatgccggaggaaagcgtccttgagatggtgcctagtgggcccgtagacggcagtgagtaggaacgtggttcctgtgactatgggcgtcacttgtgcggagactgagaagcggccgattcgaacctcttggacatccaaaactccactgttccaaaggaggaggattcctcctctcgtgcctcttgccggtttaaaagcgaatttatcgagcttgtagcctcctaggaaacgagcgagtccgtcgtctatgttctggagctttgtctcttggaagcaggctaaggtgcactttgtgtccagcataagctcgtggaccgtgttgcagcgcgcaggtgaatttaatcctcgtacattccaagaaatgacatctagactttgtgccatttatcaacaaaagttctctgggggcatgtacctgccttcattcgatttggtagtgaaggtgccggcacaaaatggtttggtggcccaaggtgaaacggcggcccaacaaatgggcggctctgcccagcttggctagacagcccgataagggatggcggcccaacaaaagggggacgacggcttgggaagcgacggcctttgggcagcccaacgcgcagctgtgcgcgcttagcgtggcccaggattggatgcgtgtgcgcgctgacgcgtgggcccgtgtgcgtgagagctgttggcgctcggccactgacgcgtgggctagggaggctgacagctgctgtcatgggggctctgacgctgacgtgtgggccggggcgcgttccgcgaccccaaggggaggccgagccgttcccgggcgcctgtaaggtgttcggccacggtccacgacgcggcttggtggacgagtctgtccg

SEQ ID NO: 45502 - DNA, 1501 bp, Oryza sativa
ggggatgactagacgagggtgtcgtcgcttagacattgaagcttgacactgagaaaaatggtccatttataacataatttttttacagtgatctatttataaactaaagctttcaaaaagtatgaaaaagtaaggccgtgtttggccctgttcactttgttgtcaaaaaaaccttaccaaattttggcatagttatcaaaattttggcaactgacaggattttttatatagttaccaaaatttagtagcaaactaaatgtagccacttttttgacaactttactaaaatttggtaaggttgaaaacggcatcaaagtgaacaggcccttagtttcccccctattcccaactttccatcacatcatatcacattaaaaactttcctacacacataaacttttaattttctttaaactttaaacttttttcagaaactaaacacaccctaaaacaaaaattctagaacggaaatgagtgatgaatggtgccctgcagctgcagaggataggagtatgggtggcctgaggtccaaatcagcagagggccgggacggacgacgtgtaaacgtccatccaggcgtccatatgattccgggcgggcaggcatgcaggccattgaatccgagtctgcgtcagcgcaatgatatctgctcctactacgcctctgcctgactgcctgcatgcgcatgtctgagttggacatgaacatgacctccatcgcatcgattgcaatcaataatcgctggccaggacgtactcgtacagtacgtgtcattggtctcctgtaccaccccaacgtagtacgccgcattcactgatccagcgcacgcacgaatgcacgatgtgatcaagatcaatcgatcgagccacagttttttttttttggcccttccccttgcgtcacccccggccgtacgcgcggccgtgcatccctgcgctgtgtttcactgtgtggcgtccatccatccaacaacgcgcggcgcgcgcggccccggcgttttgcacgcccttcgtccatccggcgctggaattttgtctggttgatcatcggtcgccttctcccccgaatgattggatttcgtatacggccggggaatcgcgacggattctggggtggggggtggtcctcgcggcggctctggcacggctcgatcggattcaagcaatgcaagctgtttggattgtgtgtatagcatcctcaatagcctggacctctctcaactctcatctgaaatgagatcgaccagttggcaccatcgagtggctactggctaggcagtttggtacgccgttctccgcgtacattttttttttggactgttccttgtacgttactactacctacgtatcttcggcacgggcaccggcccatctctgacgctgcactgcatacctcataatctcgacctgttacttgagtttgtgttgacagtttttgaccacccggattgaaatagtttaggaagtttttcagtcggataacacatgcaagctggcacagc

SEQ ID NO: 45503 - DNA, 1501 bp, Oryza sativa
tttattttatttttatttcaaattttgattaatctcgtattgggttcttatatggaaacttatttcaatattgcttatttttaattctgaatttcagttatttttaaattgtatatctacttgaactctcctttccttttctaattttatattttattttatttttatttcgaattttgattaatctcgtattgggttcttatatggaaacttcttcaatattgcttatttttaatttcgaatttcagctatttttaaattgtattgctacttggactctcctttccttttctaattttggattttattttttttatttcgaattttgattaatctcgtgttgggttcttatatggaaacttctttcaatattgcttatttttaattccgaatttcagccatttttagattgtattcctacttggactctcctttccttttctaatcttggattttattttatttttattttgaattttgattaatctcgtattgggttattatatggaaacttcttcaatattgcttatttttaatttcgaatttcagctatttttagattgtattgctacttgaactctcctttccttttataattttggattttatttttttatttcgaattttgattaatcttgtattgggtttttatatggaaacttctttcaatattgcttatttttaatttcgaatttcagctatttttagattgtattcctacttggattctcctttccttttctaattttggattttattttatttttatttcgaattttgattaatctcatattgggttcgtatatggaaacttcttttaatattgcttatttttaattccgaatttcacctatttttagattgtattcctatttggactctccttttctttttctctttttctccgattaatgtgggaatttctagcctccacaacaaacgtggtgcctccttgtcgagctgtcttaataatataatagatagattttagaatcccaaaactctcttgtcgtcctcaaaccattacctggcatagaattaaatccaatccaataagttgtcaagtaaagcgttcgtgaatgtaaactcataaagtatagtgacggtccttaaaacttaccatgctatgtcattttggccccttcaaaatgcatagcaagcaagttccgggccacttgttaagtatgtcatctatgtccaaaactccgcataccccttcaagtccacatggtgctgacgtgaaactgtcacatacaccttttgagtgtcattaagagagtgaaatgtcaatcaaccatgcaagcacctgaagagttttggatctagatgacatacttttaacgagttttgagaccttgatttgtatttttgaagtgtagggacatatatgacaatgcaattagtttaagaactgccggtgaattttactcattgatactccagctagctaacgaatggataggtagtaaattgaacctcccaggatgaaccacataacatc

SEQ ID NO: 45504 - DNA, 1501 bp, Oryza sativa
actcaagcaagaacaaccaagattgacactacacatcatgcaagcacacaaagatgagaagatgtcagaaagttctctagcaaaaggaggatggggataaaaccaaaagaaaagagcagaaaggagaaacagaaagggatgagaatacctctcaatacttatgtaagtatctgcttggaatcgatctgaaacaacaacaaaggaatcgacaagaagctggggaaaaactccaaagggttagggctcgtccgagatgaacaaaagaacaaagtgcgcagggaaatccaaacaaacagttacactcagaaacaaaggaaaagaagaaaaaaaaagctcgcaaacacccaaacccaagacgtatataaactaaagaaccaaagcaaaaacaagagctttgcttagcttcttctccatacctctcccctcctctgtgcctgtcgtctctagagctgcatgctgctaatactcttccagctgcttgctcttgcctgctagtcctggtctactagggaactcatggcaagggagaagaagctagtggagaggaggaggctaagaaggttgttgtctgatttctttcatctccttgtcatacttttctctctcccccttttgcttccttctttccacactctactatatgctctctcctctctgctactatatatttttaaacagcctttttaccttaggtttattcaggggacaagtcgatttaatttatttaccccttttccgatgcctacgcatacgtatctatcagggttcacatgtacagaaatgtacagtctgatgtacagagtgagacaagtgagggtcgtagtagaattatagaaaagaggagtgtataactccggtagagttgatgggggagaaatgctcacgcaggcgagagcggccggtgtcgtcaagcggctgtggattgggtccacagactgcgggggcttaccgcatccatctctccctcgccgatcagcggcgcatgtgtatatgtgctgtgtgcactgtgagcacacgagataccattcacataagccgacttacttttggattgggacaagaaaattttcgctattgtgacctacagtgctacagcctgcaagcataagtacgagggcatttctaattaagctactcagggaggcaggagcagtgactgatacagaaataaatagcagtgggatctgaataaactagatagagttatagccctccttctaactatatatggtaaaaaaatttagtggtatcttcgtgggggctctcataatcttcatgcaagtagtgagggctcgagaccccgctgcccctatgctggatccgcccctggctaggaggtggcgagaaggcattatgtttctcatgtttttttaattagctgttgatgagaaaatataagcagattgatgatggctgttcgatcccaatcaaacggcttacttactatgcttcgtttttttcttaaggaaaacattgtaggagaaatccatacggtaaataa

SEQ ID NO: 45505 - DNA, 1501 bp, Oryza sativa
gcacggcttgagagctcaaaaggggtcgttttgcgaaatgattgcaacatgcatgctgatgctgtatacacgtactgtccttttctcatgttttcgtggctgttgagaggcagtacaagttgagaaacattctctactttgctcttgggtgtgactaggaagcccactgacgaaagggagcactaccgggtcaatttttcatatatggaaccagctaaacagtcactgcaaatgatccattgcatctctgaagataccacacgcgaggatttgtgtgtgtatgtacgctgctcacctgtagtacacttccgttttactactaatgtcacggtggtcacaaaaatcatgtgcttttctggaagatttatagctaggtcaaaatataggagctagtacctaacctttttaatccgtgaggtcaaggacctgctatcaggagatagggagattaaattcatcgagggccataggagccaaaacagtattagccatattttagtaaataaggcttggtgcgagtctgtttcggagctctggcctgaaaattcttgtaacttaatttgtctcagatatggtgtgtgaggaagcttctcatgagtaatatattccttatttccccgaaaaaaaaatataggagctaatacataatttgcatgtcgggatggttgcaggaacggaattttacctgtacttgttcgtgcagaaacttgatatacttgatcgtttcaaacagtaccgatgctgtatccgtctggtcatgtggtgcaatgcatagggagctgagttagattatacagaagaattgcagtttcacactatttgcagaagaaaaatcaatgtagtaattgcagacatatgtaacctacataccttcccaaacggcgaaacgatttgctgaagtgctgtgatcttctcccctagctttactttaggcactggttgctgcatttggttccaaattaaaacgatcagttcgttcaaatactgaatatatggtcggacgatttcagagataatatcaaatactccatttgtcttctatgtgttgttaccttaggaggtgatgctttggaagcctcttgcttggacttcttgacagtgctttcctgcctttcctctgacttcctcttcttacgatcagtcgccgccgctccactgccgctgctactactccttgcctgaaacgagataattaattagcacaacgccacaaacatgattcaaaatccacgcgcacatatgcagatacaaaactgcatatattcagttatttagtactacgtactacaagcaggcgttttagtactacgtataggactactttgcacttattcagttattctcactggcctatttatgttgggggtatgaaatggcacgtgaatcttaccgggacagtctcctgttcttgtcgattgctgtcagacgaattggcgcatctcatgtacggttgcaccgacgtcgactcgatggccggcgtgtagccggcgaatgacccaag

SEQ ID NO: 45506 - DNA, 376 bp, Oryza sativa
ctcctcaacaacaattctcatcctcctttatatttcttctcttttctcccatccgagtaaacacaacactttcattttgttgtaggaatataataaccttgcatcaatgtactaatagtctagtatcttcagctactaataagtaaggtcctgttgggtgtttttttttgggggtggggggggtgtttaaaattctgtgagtagctgatttcagtttactttttagactatgtaactatatattcttataatttgagtgagtgagaatacacgctgtttgggagctaaagattctaatatgaaactactaccatggctaaactctcctaactaggcgtaagaaagtatctgtgtatttgttaaaagacatcctcga

SEQ ID NO: 45507 - DNA, 1501 bp, Oryza sativa
ccatctagtgttagagggttgattagccaagagtcaagtgcatttgcttccattgtagagctagtgtggcacttgatcatctccacgtcgggtcattgcttgttactcttggaggttgccgcctcctagacggcttgtggagaagttgcccggtgacctctccgagaagattgtggaggaggcccggtgccggtttgtgagtggtttggagttcaccaccttcggagtgaaggaagaactaccctagtgatcaaggcttgggtagttctctccgtgggccggctcccgccttgcccaccccttgacgaagggggcgtgcggaggcttcgtggttgagcggtggagttgggctcgcctcaacggggagtaggaaaccggcgagtttccgaacctcggtgaaaaatctcttgtctccttgtctcatttgtttgtcgcatttacttttgtgcaatttacttttctagagacaaacttgagatcatatcaccctaggattgctaaacattgacataggagtgtgatttactttcctagagatataattgagcctctatcaccctaggtttgcaaaacataacttagttgcttagttagagttgaccctcaccaagcctagcaacttaggttagttttgattaggtgtcatttagttttaaatcgcctattcaccccccctctagtcgacatctcgatcttacacaccgccgcatcctcccagcgctttgccattgatgcagagccgcggagctcgagggggcggcagactcgtcagcatagcccacctcctccaacacccttgtcggcgccacccgtccccgcacgccgccgcccacacccatccccacgcaccgctgtcttccgcgtgtctctacgcactaccgcccatcgcccgcgcgccggcgtcttccgtgtgtccccgcgcgctgccgcccacgcccgttcccatgcgccgcgagacctcagtagccaaccccgtcgtgttcttgactgcttccctcaccgggaagaatgaatggagggagagagagaggaagagaaagagaaagagaaagataaaggaggggcaatttggtaagccatgtaaaaaagtgggcccctctcgcttagtcagcacaaaaatattaatttaatggatagagtgtcccctggcaaataaccacattttgagagtgtcttccctcaaaagtgacttcatgcagtgtcctacagctaaaaccacgaagtcgcgatgtcctgtagcaaaatttgccttagtgccatggtccaacatgacaacgctaatgacgttggcgctgtcccctctgcccctccgctagaagctaagttaccaatgaacaagaatggtgttgaggattacaatattatgctataaatttgatcaaacttaaaaaaaagttaagagaaaaattaaatgacttatactataaaataagggagtataagctaacagttatataagaaatccaaaataaactcgtacatataatgataccttcagact

SEQ ID NO: 45508 - DNA, 1501 bp, Oryza sativa
ttttttaaaaacgactcttctgtagaaaagttttgcaaaaaatacacacgtttaataattcgggaagcgtatgggtgaaaaagaggtgttttctctatcaatctcgagttgaaacaaattctcctgggactcttactgttgctagactacatttcatgattattaggaaatactaatatgtaaagaaaatactaatattccacagattctactatgaaatattcacttggtcgaatgtggtattggctcacgatcaataatatatgagaaatgcgtactttcattcatcctaccagtatggacatttgtacagtttagttggttcaagttcgaaaccagtggtcttggaccagattttttgttgcatcggattctattggtgcttatgctttcgtctcctataacatggttaacattaggtatgatttaaattaaaagaagagtttatgtgagataaaccttagtaataatattttccttatttcaaactgttaaattaatattccctctaccccaaataagagggcgcccttttttttaaaaaaaaatcaaacttggcaatttttgactaataattatactatcaatatctatgataacactagatttatatattttaaaatactttcatgttatactaatttatagttgatgataacataatacgaaatgaaataaactaatggtcaaattatacaattaaaccataagaccatctataaaattcataggctttacaattaagattccaacgcaaacacaatttggtacttcttcaaccggatttccaatgcaaacacaatttggtatatcttcaaccggatttctggattgttgatcaatgcaaaacttttgatcgagactccaagctttaggatgcgctcgtttcaagttattaggaaccctttctcttaccatgcaaaacgaagcaatggatcagtgcataattaattcaatattagcaaaaaaaacttaaaaataaattaatataaatttttttaaagcaacttatatatagaaaatttttgtaaaaaaaatacactgtttaatagtttgggaagcttgtgtataaaaactgaggaagtaaaagttggacaagtgaagtataaaagcacaccttaagataattttgtattactccattaattaggaaggaaccagaaattttttttcctaaaaataattattcattttgaagccttccttctagtgtcttcccctccccttcccgtcctctcctctcctccatcctcccctccggcctccacccgccgtcgtccgtcgccgttgcgcgcgcgccaccccctccctccttcccgtgcgccgccgcctcgtcgttccatctaagtcgcgagggaacgagctgaaccccatctgcgctggtaagcgcgatggcgaacccgctgcacggctcgggtccgcttcgatccaggtaaaacccgcacccacagccagcgaattttcgttcgatccaatcttgcgccggtggcgtccgaatccc

SEQ ID NO: 45509 - DNA, 1052 bp, Oryza sativa
ccccccccccccccccccccccccgccgccgggtcgccgctggcttgtccatccgattttctgcctctaccaccgtcggcctgggagcggaggggatcgtgtggagtggccaaaatgggcgctgaaccagttggcgatgagacggctggctggggtgtggggatggggatttctggctgttcggctgggcggcaacgcaacgggtgggtgggttccaactatatatagtccgtctgggttacgcttacgcctgctactagattacgtctccgattatgtctctgcgtccatactaaaatcaggccacctaggaaacacatatttaatggaggtatatattaaaaggctatccatctaaggatctactacctcagtttcgaaataaatgcagttgtgggtatccgtatccagcgtttgactgtctgtcttatttaatttttttaaaaaaaattaaaaatagtcacacataaagtattattcatgttttatcatccactccctccattccataatataaggcacaaccattttttttaagatgttccataatataaggtatgcatgcatatagacaattgtcacgtcctgattttcgtttcaggatttataaattatttaataaattattattagaatttatattaaatgttcattaatttacaagtgaagttaaatgtgggaaataaaattttctaaatataaagcatggctggatttaagttttattaaattctccattgttaattatactctctggaattttctcggatttttcggagctcaactcttaattttaatcctacaaagagtagttcagcaattatttaaatattaaattaatcattaaatgatctgattttaattttgttaagtactttgagtgtccaagtattttcaggatttttcctgaaattatttgagcaatggaagtatttttaacaattcaaagatcattttggtgattgatttatttggaaaagtaataaaaatcctcctcctcagcttgggcccttttcggcccattccttcctcttctctctcccttcctcagc

SEQ ID NO: 45510 - DNA, 323 bp, Oryza sativa
gggggatggcgtcgagctttcgtccgcgtgcggctgcgactcagcgtcgtcgttttcatttctatcccctttcctctctcttctctctctagcgccaccaccaccgactccgccgccgctccccggcaccgccacatccctcgccaccgctgccgctaccaactccgcctccaccaccaccctcgccacctccgccgcggcgacggcacccagaactggtcctcaccaacaccatcctccgcggcgacggcggggccaacctccttccggacggcgacgagctctggacggcgggccgcaatgaagccccacaacgcgggagc

SEQ ID NO: 45511 - DNA, 401 bp, Oryza sativa
aatgctaaaaccgtcacctatcttgctttttccatccaaaacgcgcatccatgacacaccatcggctagaaccggtacctttgttgagagataggtgtcggttctaaataaaaatcaacacctataatatatcataggtcctgattttttaaaaaccgataactatatttataatgtaggtgtcagttttatgaaataatggcacttattaagaaaaccacccgactaagccgaatcacagcttgtttccaccaatatctctcccttttgatcaccccttgctctatttctttattacccctctcccttatcctctccgcctcctcccctatccctctctctctccccctctctcagctaactcttgctccctctctctccaccgcattacctggtggtgg

SEQ ID NO: 45512 - DNA, 943 bp, Oryza sativa
tgcataagtgcttggaaaaaaaattgaatgacttgtctcataaaaaactttagaaaatacctcacatgatgatattctaatgaaaaaaatgcatacgagtgaactgtggaaatttgatgtttcaattggcataatactctgttgcacattttatgtttagatctattttttaaatttttttcaatattttagccattgggacttgacgtttcacgtggctgttggtgttgcaatcactattttttaaaagttgcatttctttgaagagttttatcaagaaaattgaaacatttgagccagtgcagaaactatttcctacatgtggtgaaagcacctgattcttaggataaattagccatccaatctttagccatgtgctgaactcttgttgggcctgaatatccattacagaacacactagaaacgggttgtgtcatgtgttaatcgcaataactaaattattaaattttgtcatattttttagcaattattgctgccatgttttaatagattcaggctactaataattatccaacaaaactaatctaaaaaaaggaagaaaatggtaaatgtcgatcagctaaaagtaatgacggctcgctgtgttcaccacctgtagcaatattttaactatactcccttcatctcaaattttaactaccattatggttcatatgtagtacgaatgaagcaatattttgggacggaattaaggagtatacaggtgcagtaccatgaatacacttcctttcttatcatgtgaaacctcgttccacttgttctctcttgataccaaaacaggtcgccctgtaaacatcatgccccaaccatcgacattacctcctacctgtaattaagggcgtcgcataacgatgaacacatacgacaaaattgattgctgcaacaactcatgctctgcaacttgtttcatggcctacctagt

SEQ ID NO: 45513 - DNA, 1501 bp, Oryza sativa
aggtataggttccatagtcttgaccatgaggcttgtggggatgatactggaaagctgatgaatccaattcttcttcaaagtgttgacgcaactctccaatggccaccaaagctgcttcttgacaagcatggcagtacgatcttcctccagcttcgaacttaaaagacggaaggtcttcactatcactagccaacgtcacacgaacacgacatttctcctcgtcggggtcatgggaaatctggcgatactcgggagcaacttcataacctacttcaaaagccatcaacctcagctccctgacgaatcctaacacctcgatcaaatttcttggtgaatggcgaggcatctaaagaaacatagaagagaagaattattgcatatttttctaagttagctgcaccaactagacttaactgattttgaccaaagaggaaggaattaaaagagaagacacatacaaaaaccattttataaatatattttttttagaatttaactttttggacagagacaagtatatttttttttgacaaataactaaaataaaactaaaatacttatgatctattataagcacggtacagtgtcaccataaggaagatgagtagtactagtgctaacatgattaaatcgataccataataaatgtacagtgccgactaatcaatgaaatttggtaaagagaaagaaagaaacattttgagaagagcaaccttttgcttttaaaagaaaagaaattgagtttcaataaattttgtgcataaccttgcatgtgctgccaacttaattaatttgtaagagaatagagaagagcagttctatttttttcaaaaatattttgaaggctacttaaggtttaccatttagcttatcctaaagtcaaggtggctctgataccaacttgtcacgcccagaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactctactccgcaggcaacttaaccaagaacaggcctagtcctccagatcatcaccttcactgaagtactcctcttctgatgaatgaatattgcaagaatgagcatataacatactcaacaagccacacagcaaatatgcaagtgcacaggataacaaaggatggcataatatagctcatttgcagaaaacagcatttaataaatatttaagagaatagtaaaacagttgaataattaatcaatattaaataaacaccatacaacacacccgtgttgcataggcccaaccacatttgaacaaccaaccccaattgaacaaattaaacctccaaaccaggaattagccattccagaccaggaatta

SEQ ID NO: 45514 - DNA, 1501 bp, Oryza sativa
tcgtccggattcatcccgcgaagttcgccggcgtcttcaatggcggccgaaatccccgcggccggtttccttcctcctcggccgccttctctcccttccgacgctataaaatcgttgcccgagctccgctcttccgtttccgccgctcgccgctcgctctcgccgtcgatttcgtgcccgcgccgtgctccgctctctccgccatcgccgccgagctccgttccgccgccgccgccgctccggacttcctccttactcggcgacacctccgtccgcttcgccgagtggtcgccgaccccgtccgccgctccgcttcgcccgtcgaccgccggagcaccgtcgtcatcgtcatcccgagccgcgccgccgtcttcctccgctctgtccgccgtttccaccgccttcgccgtcttggggtgagccgtggaccgctccgttcgtttcccccttccctcctctctctcgggtgccgctccgccgcgccgttggtcgccggcggcgaccatcggggcgcgggcgcgccgctcccgtcggccgtgccggcgaggccgccttcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctcccccggctgacgcaataaataggattttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagcccttttcttttccgttggtcgtgtagacgctgcagcttcggaagatccgcttttcgtggaagtcgaagccggcgtttgggaaagcgagcaaggcaagtcacatcatccttgagcatattgaaatcccagtttacaaaattattttaatttaaattaatgcattatcgctttatttaaattcccgcgttatcactgttttatttagccatgcctatttacctttgttatgaccttacttttattgttattgttattattaccttgttcaccctagaataaacaaaaccccaactagtgggtactctattcctggttccactagtatgaatttaggtagatgcttcgctgattaattaggcaaccttaggtggttttacaactttagactttgggaattctcatatcatttggacactatggaatggttggcttatgttggaattggacacacacctctcttcctctttcaaaacccctaaaacctgtttttggtggggtttgggtgcatgccagttgtgggaagtagcaccccggccactataaggattaa

SEQ ID NO: 45515 - DNA, 271 bp, Oryza sativa
tgaggtgagagaggaaacaagccaggaaagaatagaccagaactagagacaggaccttaaaggaactaactcttcttattgatgtattgtttgttttgcttattctgcaagttgcttaagcaaacaacctagcatggttacatcacaccccactgatgcaaaccacgcgctacacacacaagcaaggaaacacacaactaacgactctaccctagagggcggcttaggttctgcgactggttctccaagatcttcactccttcttcacagc

SEQ ID NO: 45516 - DNA, 1501 bp, Oryza sativa; identical to SEQ ID NO: 22090

SEQ ID NO: 45517 - DNA, 1501 bp, Oryza sativa
gcggagcagccgccggagatgctcgtcgacgtccatcaccaccaggcggccgccaccgcggttcggcgccgacgtcgaagtcgcggcgacggatgaggtcgccaggtgggcgacggacgtcggcggcgaggagtgggggctgaaggtggcgggcgtcgtcggagccggtgggaccggtaagatggcgctcgcctgatgaggacacaactagctcggatataactatgactaccttatgtattaatcaaccaaaggtgcatatgttctacattagatttacatgctatatatttgaacaaacgttgctacacaatgagttttatgtgtttttgtttgcagaggtacttgcttgggcgaaggaaaagagaccgagcgtaaagaattcatggatgatcaaagaagttgattggggaccatatcaagaccttctccaagtcttctttcatttcaccacgtcacttttggtccatagaagacaagagataaagttccacacgttttggattcggattcgggcctcgtgacagcatcaacttcaaacggacctagccgctgatctagaaggaattttggggcccatgagtacttgttagaaagcttatggagtctactttcagatggttttggtcccatgtcaaaattcctaccgagctgccgggaatctacaaaacaagccatatatctcatccagtccgaatctgacttgggttttgggccttgtaattgtgttgtgggcttagcccaagagggtgtgcaccctagggcaaccctaggacgtccctaatcacatttattcagtagccgtcatcgtttagagtcgggttttgcttagattattccgtcaagaacccgactctaaactttgttgaattctaggttgcatcgtcgtgtcgagtactggtttagttttagatttaatttttagttttgagtattgcatctgttcatcacttaggtctagggtacatcactcaagtgtgtgagttgtacgtcagttttgggttcagtttttcatctcgttagttgttgccgggatcttgaaaaattgaatcgtctcgtcgtcgggtttccgtttttgtgatttggagaaatttttatcaaatggttttagagttgccgtactgtgcatgtgtactgtgcgcgtgtggggagtactgtgtgcgcatgaggagagactccgtatcagatctatccgtagctgtccgtatttccctctttatagaattgttaagtagcggatttgagatatttttataaaaacggaacctacatgatatgagcaatccatttttgagatgatccaattttagttttgcactttgcgtttgagtccctgtaatattcatatttacatttgagtccctattcgaggtcagtggtcagtttttattgaaaaaaaaagtaaaaaaaagaataaagaaagaaagaaaaggcagaaaggtgcaaagaaaaaaaagagaaaaaagccacacctaaaaaaagaaaaaagaaggcagaaagg

SEQ ID NO: 45518 - DNA, 1501 bp, Oryza sativa
  unsure (1)..(1501): unsure at all n locations
atattatcacggtcgttaatgagattaactatggcaggatatcaccgtcgttaatgaaaacaacgatggcagaagaacaccgtcgttaataaaattaacgactggaaaaaaatcggtcggacgttaatactattaacgacaaagcctttaacgaccactgacgaccacacttctgtagtcgttaatgacctttaacgaccacatttggacttttaacgaccaaatttctggtcgttaatagtcgtttctccagtagtgatttcagagtgaacaataataagattaaaatagctttcacccgttgcaacgcacaggcatttttctagttagctcaaaaatgacacaatacacaaaaagtgcctacactactccatttataaaagtgcaaatttcttcatattgcaccgataagaaccgacaaaaatagaagcaaatgaaggagttgaacaagcattacaccttttatatggatcatgtcaggtcgaaacccccctaatttttgtaagtttaggagacagaaaatgccacgcagtcggattaaacggcctgcacaggaagatgcattatcccgtgcgggcctcttaattcaaccgcacgggataatcgcattatcctgtgcggttgggttaagacgcccgcacgagataatgcatcttcccgtgcgggcgccggcccggagccggtcctccagtttttctaggcggcgcgacttatggcccacctggaaccaaacggagccggcgtccagtaaaatctttttgtgtagcagtgcaaagttcgtccttcagctatgctatccacaaatgaacgtagtccgcttcgcctttgagctccttgagttcgccaagacgcgtagtagctggattacaaatcccaaaaaaaaaataattaattaagactgagtaataactcgtttctttcaattttttttcagaaaatggattaaaatccggcctctactttcacaacggatgtacacagcacaactcgtttctttgatatataatgtgatcgagattatattatgcaaaagaaagtgtctgggttctgagcaaagtgtcgacacacgcaagaaagaaaaataattagacgttgttgttgttagagccggtagcttgttgtgtggtgctatctcaatcttctggcttcttaatatattcgtcttgtatgttgacaaatattcctaattatttgatgtaccgatgtgtgcgccgtgtgtcttacgatatatgaatataccggttgctgttgttagcgacatagggattttttttacaatagttgagtgctgttgagttgtgacagtaaggtgtgataataagcttttctttttttgggaaggtgttataataagcttaattacggaaacctttgttgaactagctagtatttgctctcaagaaaaaaattnaattnangntttattnnnttaacgaaaaatcagcaaaaatatagatgctcaccctgacctttaatcgtagaaaagttaggaaaacacgta

SEQ ID NO: 45519 - DNA, 219 bp, Oryza sativa
accccctgtgattttggcgccacgtgtgtaggttaggtgagcacagcggggctcacctaaccgcatttattgcggtttagacgagcgcgccacgacgcatttgatgcagcgcagcgcacgcttatccggtccgtgaccggtcgcagtgtgtgaccggtcagatcgcgggttaggtggcaacaggcggcctgtcacacgcctcgccccgtcccatcgaaa

SEQ ID NO: 45520 - DNA, 312 bp, Oryza sativa
ataaaaaattctcagtacaccaagtcaccaaaaatgcttcatacatgtgtctgaaaaccaaggggtggagagagtaccttcatcacatagagaacagacatcttggacagaataaaatctcctggatgaatagtatcttttttttgcgcttttctgaattccattgtttcgcttttttgcataacctttttgatttcctttgccactatctgcttgtatcaatgatttctaataaatcagttggtcaggagctcaaggtgtctatgtaactgttgcgcagataaaaaattccattacgtgactcgggcagta

SEQ ID NO: 45521 - DNA, 365 bp, Oryza sativa
tcctgcagcccttacctcctgaagatcaaatgctgacatgtaatccggacgtcctgactgtaagtgccactatgtttgtttagtatttggttgaatatgaagtttgtgctgctttgtggggtctgatggaaaatccccctttctgcgtcagatggacataactgatgacatggagtttttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaaca

SEQ ID NO: 45522 - DNA, 255 bp, Oryza sativa
agctctacctcacgctcggcgagcttggagagagatggaaaagagaggagagtctctgacatatgctccctccatctctaaatgtttgacgccgttgatttttttaaacatgtttgactgttcgttttattcaaatattttaagcaactattaattcttttcctaccatttgattcattgttaaatatacttttatgtatacatatagttttacatatttcacaaaattttttgaataaggcaaatggtcaaaca

SEQ ID NO: 45523 - DNA, 1057 bp, Oryza sativa
ttttttatcttttgggttgcttcattaatttttcttaagcaccctgtttgatactccctccatctctatttcatgttataaaacgttttgactttggtaactggttcaagtttgactaagtttatagacaaatataataatatttataatactaaatagtgtcataaaaatcaataattgaatatatttttataataagtttttcttgggttgaaaatgttactacttttttctataaacttggtcaaactttaagcagtcaaaaccagggtttacgattccgacgaaatccggtcggatttcgcgaaatttcaacatttcgacgaggctcgaaagtagaaaccgtctgagatttcaaggagtttcatccaaattcaaatttgaattgataaaaaaagaaaaaaagtcaaataaaatcttataaatactatgatattcatagaacatattgggatatagattttcaaaaaaaatgttgtattgtgtatatttactgaaacttacatcaggaaagaaataatttcagtaaattacctctattataaattactgatcgaaatttcgatgatttcgattggaatttcgccaaaaccgatcggttttcgagaacttgtcggcaaactcagggaatttgtatccaaattttggtttatgaaatttgttcggaatttaccggttttccaccgaatttcacgaaattccaaattccgccagtgctcgaaacggaagggcctgtcggaattataaaccctggtcaaaacgtcttataacttgaaacggagggagtagctagcttctgagaatatagagaagctaggtttttctagtttctgactctagtttattttctagatttcataatgtagatgataatgtagactgtttaatgagttagaaattcaataaaaaactgcagcggttagaaacccaagaacaatgcatatcagtctatcatatctcaatagattaaagccttaattaggggatgtactgaaagaaaaatgttgattggggtaatgaattgattaatataagcgaccaaacacacaaacaggca

SEQ ID NO: 45524 - DNA, 760 bp, Oryza sativa
cgcggcgggcgcgaaggtcgccggcgacggcgacgccgctccgtgcggtcgcgcaagagagaaaagaagagaggctagggttcggtcggccggaggctggggtcggggttttgtccccccgatctcggcgcccggccgtcggatctaaaccctagccgatcggacggcgacggcggctgggccgaaagcggcccaagaggggcgcgcgcgcggcggtttcccagcccaggcccacgttgcggcctagggggtaaaaagggggagcgcccgcgcggggccgaccgggaaaagtccatttgaggtccctcgggggccgaaaataaagaaaagagaacagtagcaatttttcctttaaattttgttaattttcatgcaaatttcaatagaatttgaatagatttttgcatgttttacctctgtttaaatttgaaccaacgggagaatttttacagagagtaaattacagagttttgctactgttcatatgaattttatatagtttttccgttgcaaatagataaaattgatgaaaattagtgtttctaaaattaaatttcaaaccaacgggagaatttaattttaggaacattaattatgtgctatgatgttgtaattttctgaccaacgttgataattgcaatgttatagttatggttatatgtgttatgtctatttctgcccaacggtgatgtaggcttaatgcataatattttaatgttaattttgttctcaccgcacatgattatttcaggtggctact

SEQ ID NO: 45525 - DNA, 409 bp, Oryza sativa
ttagatgtatagaaatactatatatatagaaaatatttgaattcaaattcaaatttgaaacgggtatataaacttttgacttataaactttaggtctataaacttaggtgtataaactttagatgtatagaaatactatatatataaaaaatatttgaattcaaattcaaatttgaatcggatatataaacttttgatctctaaactttagatgtgtaaacttgatgtgtataaatttactaaaataagaaagtaatgcggtgccaaaaaagaaaaagggaggagggaggggatcgatcgctacccccgtctccagaggatcgatcgcccattagggtttatcgattacggacggaaccactcccattaacgttatcgttatcttgatctaaccaaacgccaccccagt

SEQ ID NO: 45526 - DNA, 1501 bp, Oryza sativa
gaattagactaatcacgttgtattttttttcctttttcattccgttgcactttcaattagaatttttaaaaaaaactctacctgaaacttaaaactttatatccaaatttaaaagtttcaacatgaatttgaaaactttcaacttaaaatttaaaaacttttaactcaaattaaaaactttcaagacaaacttgaaaactttcaagtcaaaattttaaaactttcagttaaattttaaaaactttcaactctaaatttgcaaactttgaactcaaatttaaaactttcaactcaaaatttgaaaacttttagttaaatttgaaaactttcaagtctaaatttgaaaactttcaacttaaactatgaatacttttaactgatattttaaaattttcaactcaattattatttatttttttattatacaaattccttaataacactattattaacgctaatcacactattaatagattcgtacttgacgtacgggccacgtgccggtgtggggagtgcatgccggttccgctcctcgcgcgtacgcgctgattaggaatccccatgcagtgcatgcctagggttctgctagttaggctgatgtcttctgtatattgtattgggcctatttggccgaatttagtttattcggttaaccaagggtggtggccgaattaacggaataacattcggtcacttagcagctaggaccaaactattaaggacatgtacgatggttgtcaatacattgctaattaagaatacttgttgacatggaagaaagaaaaaaggagagacaaaacatcgttgtcatgcataacaatagcttaacaacgactcttaatcactataatataatatagaaatatggttgtatgagggtaaaagaatggaaagaatattaaaaaaataaatattttttgagttaatgattggaacctttgtcgtctcaactattgtaaagacatggtctctaaataatcttgtattgtttaagagaccatactcatctctaccattgaacatgccctaaccgtgtttcttggttgcggtttatttttctctcgatcctgatctttttaacttgttctaattttgtctaccactcccttagatcgagcatggatggaagctacggggagaaacaagtggcaaagccataaggattatatgcatactataaggataaattgaatattttaggaagtaaaattaataagggattgtctacatatctgttgacagaaaatccacctcctatctttcaaattttggaccattggatatgcttcaagattcgtgtagaccccttaaccctaactcctctcctcctcccccgtccagatcacactgccaccactcctcctgtccctcgcgcgatccccctccgccaccaccccatcgtgccgccactcgcctcgtcggttggccggaaagagtcaacggcaccggcgagccccctccccatcctctctccccctcccccgtctctttctcctcaagg

SEQ ID NO: 45527 - DNA, 167 bp, Oryza sativa
atttgccttttcctaatttacaatcaccttatctagaagccacctcagcatcatataccttttaaatttatggattaatacaaaccaactaactagcaaaaataggccaaatttctagttagggtgtaacaagtacctcctgcatcctctaaagtggaagcaccaga

SEQ ID NO: 45528 - DNA, 310 bp, Oryza sativa
agtacgtgtgtgcagagtgcagtgcagatatactaaccaattactaaaaaagtaacaatcaatgattgccttctcctgttctccaacactaaaaagaaaatgatatcctaaaaccaaaaccggaaattagtgaccatcctgtcccacagaataactccgaaatcctatctgatactactgacgtcactgattgcggtagtgaatcactccacgtgacggcgccacgtagccggaggtgaggtgaggtcacagcgcgacctccgccgcattgccacggtggaggaattcagcaagacacgtgtgtgcagta

SEQ ID NO: 45529 - DNA, 298 bp, Oryza sativa
ccctcggggagacagagggaggggtggccacgtcaccctcgggcccgacccccccgagggggtcaggccatgtgggtgaccgcggctacccaagcctctagtcacgataccctcggccccatgtcaccgacagtagcccccggcgttacgccagggcgattgcccccttcgagggaagcgctcgggcgtgacgccactccttaggcccggtgacaggtggggccggtccctacaggcgggcagaaacccagcggtcgcaaatcgcgcgcatcggcaagggaaaaccgactgacaataa

SEQ ID NO: 45530 - DNA, 1501 bp, Oryza sativa
gttgcttaatgaccacgagcgaaaatctatttttgctagctgctcgtgccctaaatccctgtgataaattttttaaagcacttgttttttaatccgtaagtaaaaataaaaggatggcgccatgagcccatgaaaaatcgtttagtagtatgaatttgaaggcaagtagcatcgtcgttgcatcaagaacagtcagatgattcagttttttgctccgaatttcctgtgaaccgccactgcgctttcttaatctttgattattttggttttctcctagttaggaactaatttgggatgattgattttttgtttcaaacaaattttcggccagttgattggttttacaaatttttttgggtgattactgtattcgtgattgaataatctgttctccacttgcattatgcagagtacacaaactgattcagatttcagcaatgtgtcatccattatgtagaggaacacgttagctaggaccaagatgtactgatttcagcaatgcatcatccactatgcggcggcgaggcgggagcggaggtcgctggacctcctcgtggtggtcgagctcgtagatgttggggccgtcacccatctcctccccgcctgttgccggccaccacccggtccattctacgagctggagacctggacagagatggggaagagaggggagagggtgagagaggaggaagaaaacattgtatcacccgcatgtggggctcgtaagatattttattattggtttttgtttctggtgccacgtctgcggccaaaaaaaatgcctactacttgggactatatttatactgtttttgaaagatgagggacgcattatatttggtattatggtttaaaaacatagtttaaactcgatgataggatgaggggttaaaatgaacattttccttcaccgtttatatgctaattggactcggtttaagagttgaacgttgtagaatggacctttccctttccaaatctcagttctcatgccttgtttagttccaaactttttcttcaaatttccaactttttcatcacatcaaaacttttgtagacacatgaactttcaatttttctatcacatcgttctaatttcaaccaaacttctaattttggtgtgaactaaacacaccctcagtttagaagttagaacattgtgatttcaaacccctagaggcccaatcccctaaccattttgagagccattcaacctctaaccattttaagataacaaacggagattgcacaaagccaaaatgcaccacgtgcattgcagcattcctgtaagatgatgatgatgacgacagtgacgcattggaagatacattcgcctgtcctgacatcacggatgacgcaatccacccgcggacttcccactccagaacaaccatctcgatccagcacccgtctataactaaaaatccaatccgcccaacacgtgatcgctcgatcggcagaggcgcgacgacgatggccgccgccgccgccggaggaggag

SEQ ID NO: 45531 - DNA, 1501 bp, Oryza sativa
ggagaaggtgttgaggtaggagagcgagtgcctcgaggtagaagccgtggattttgtcgacgagcacgctttggagagacttggtgcatcgttcgagtgttctctcgtccttgacggtgacacctaatgaggcaagtggggagaaggcggcgagctcgggtggcaaccgtggagggacgagaaccaatatctgtcgttgagtacaaatttggtcattgctttcttttctaggagcaagtggcggagatgctcgacggctgagcaggtgagacgatccgccgtcctagagaggagatgggaggcgatcttgtacgccttggagaagagcgagagcatctccgaggccactctgctcgggtcgcggtgacccgcggcccccgcggcgcaccggagggcagtcctggcggtgcatgagccgatgtcgaacgcgcacgacatgcaacgttctgcctcgacgaggtggacagcggcgaggaggtccccctcagcggcgcacaggaagtttagcgcctctagtgtgggtaggtagcggaagcaggaggtcatgaaccccacgagggccttgagtgacccccgcgccttagtcttcaagcctcgccgcatctcaatctcatccacatctgcaccggaatcctcaccggtggtgaggtgcctgatggcgttggtgatgatgttggagacgggatccagggggccgaagcagaagccgccgtcaaggacggcgggcagcagctccggcttctcgtccacgggggaggcgctcaattgcagcgctgtagaacccaacgatgcgtcgtctcagcaccgatttgtcgcttccgcctccaccgccggcagagctcacatcgggcaccggccgatggggcgaactcgtttgctagccattggacggcggcgtctacaatggcggagtcaggatctcagtacgcttagggctcaaatcgaagtaatatccatgataattcatatgctgaagtacaaagtacagaaaaaataaaagagcaaaatcaaaactaattcaattaagagatatatatatatatatatatcaatggaaaaactcgtgtctatcacttcttaccatcttcgcaataaggctaccaaggtcagagcagcttgagaaatccaaatcagatctcccgtcacagataaatgtgtcagttggtctctaatgactgtacaatcatatttagaaaagtgacataaatcttagcaagttcaataagcttatcttcatcataattggcgaaagaattccctagatcaaggcaaacaatgcatctcaatagctgagtaaacctttcagcacgatggtttaaatcaacaataatttgatcaagtaccacattaaatatttcattgctgaaatgatcaacctgttaacatggacccaacaacaaatactcccttgtagcagcatccctaatgtttacatccaattgttcgattggagtgagaatcccagggtcagcaacaatcacatttggagcaagcacaacat

SEQ ID NO: 45532 - DNA, 1109 bp, Oryza sativa
ttggatttttagataatgaaatgaggattggatttttagataatgaaatgaggattggatgcctaacaaacactatgagactgcaagtttcttggagacaacttttactgctagcaattgtcaaaatgacattgacctatcttttggctgttttaggtcagtttggagatttataacctgaagtcatctgtattgtaggtgattgtaaatattgtagaagcccatgtagaggcacaaactactttatttttggcttttggaaatctaatttgaccttatggagaaagttaggccatccttagcttataatattgctattgtagtccaatgcatgttcaaaagtagcatcagtatactaaacagaacagatacttattctactgctttgtatttttcaggtaagatccaccttggactagtccatgctatatggctacaacaacgcaggcattgcagtagttctctgatagggaaaccaacttattagttctattctgttaatgttcttcagagttcaaataccttaatgaagagctttcttataaagagggagaatttttactattcattttgttattattcatgtcaactatggaggtgatgaggaaaatataccctggccaggatataggatgaacctgtcccacttttttatctttagtgtacctctccaaccactaccaaggctaacatggtggcctagtatatatcagaccaggaaatgggggaggagtgttctaaggaaatacacctagtacaggtaccaacaaaaatgtgttagtgggcccatatgtcagtgaaaggtgggttctatactttaaagggtgctaaacactagagggaagaacaaacttagtgtttgtactgtggcacttctttgcattggtacattgagtacaacattgtgcatgccatgtaagcccttttcaatgatcaaagcacacctcaagttcatttcattggaaaatgatcattaaatcttcagcatttaatttgtcaatatttttatcatgcatatctgtctttcatagttattgatgcatgtgtaactgattatgataacttgcaatctgtttagtttaaaaacttacaatttcttatgcacaaga

SEQ ID NO: 45533 - DNA, 506 bp, Oryza sativa
ctaggcgatttattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggattctacacgctggcacgcaaaatgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaacgaattatgacgcaaatattatttatttttccaaaggaaaagagggttgctgacatcatcaaaggggagg

SEQ ID NO: 45534 - DNA, 619 bp, Oryza sativa
caaaccgcttgtctctccagaagaaagcacgtcaaccacaccctgcaatcattaaataacactatgatcaaataaccagtatgttgaatcatagatgggagacaatgtcaatagttgtggaaatatgttataccatttacctggtatagctcagcccgaatctttttttggttctcaggttttgagtaccaatcgagcctcatagactcgattttgatgtacatggcaacaacccattgttggaaaagtcgtcctccaaacaaaatgatgtttagaagtccccttctaaactgcagcctgaagcaatagtactccctcgctgtgacaaacttgtcctttttccctttgccagatttactactatcgtcattatcatcttcattgtctagataattgtcaacaacctcgttctctgcgtccaaacttacatattaatatacataaacaatgcataaggacataaagtttagaaattattcgataaaagccacgagtgtacgtacccggaagatcatcaaaagtgctttcttcgttggtacgtacatcacctaaagttgatgtctcacaatgttcatccatttccacatcacacggaatctggttgggatcgttgtatggc

SEQ ID NO: 45535 - DNA, 621 bp, Oryza sativa
atgcacgttggtaatctgacgcgtggtggacaagaatgaccggtctgacactggtcgcgtcagcaacgagcaccacgatcccacgttgcgcccgtctccgccgggagtggaggtaggtgtgggctgtcccatcgaagtgtgattcgacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgtgcggtctcccggtgaggagccccgcgctccgtcatctggcgcgccaggtagggggctcagcgtgtgtcttctgagctcttgcgctctttcgtgtgcaccaagcctttcctgttcagcctca

SEQ ID NO: 45536 - DNA, 1501 bp, Oryza sativa; identical to SEQ ID NO: 28683

SEQ ID NO: 45537 - DNA, 1501 bp, Oryza sativa
ccctactcctgtgtttttgtggatttgtgtatgaatgagctacaaagtgtgagccaaactctcccttgttctaggctctcaatctcgccagaatcaaccctctactctgtgggcaaggtcctccttttatacttcaaggggataccacacgcacccttccctttccaaactggactttccttctctttacgaacggagattgatatggttgccgtccgaatcacacttcgatgggacagcccacacctacctccactcccggcggagacgggcgcaacgtgggatcgtggctgctcgttgctgacgcgaccagtgtcagaccggtcattcttgtccaccacgcgtcagattaacaacgtgcatgtttgcccttcttcgtgtaacaccttgcctgtaatggttaggatgaagcctggtattcatctaaccagggctaacgtgccatctctaagaggtaacacgctagctccggctggagacgtgtgcctagaggcactcgtcttgacgggacggggcgaggcgtgcgtcaaaccgccagtcgccacctaaccgttgatctgaccggtctgtgactggtcacagaccggataaaagagcgcgctgtattgcgctgcatgcagcgtgacacgcttgaccagaccgcaataaatgctgttaggtgagcacagctgtgctcacttatcccatatatgtggcgcagacttccttaaggggtcggggtgcctcggccctcggggtcggggcaagcgcaacccgaccccccctcggggggaatcaggaggagggcggacacctcaccctcgggcccgacgtccccgaaggtgccaggccacgtgggcgattgtgtctgcctcaagcctctggccatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacatcacttgagcagcgcgcgaatctgggtgagcagatttgtctcgctcggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacaggaaacgagggagcgggatagcgagatacgagggagcgaggtagtgggcgcgagaaacgaggagccaggcccagcgatggcaagggtataaaagcatcgagaaaaggatttgctcccttcctttcgccattgttcctcttgcctttgccgcctgagctctaactctttctctgctacgccctactttcgccacacgcgctcgttcccaatcatctcttcctccaccgcca

SEQ ID NO: 45538 - DNA, 1501 bp, Oryza sativa
taaacaagcataactcactcatcttaactcggaattgaatgaaacttgaacctaaattcatctaaaatcaagatctatctggtgataacattttctcaatatgctttgtactgtttgaattttggtgaatttatttgaattctaattgagttcaaatccgatctttcgcacgtaaatttagattccgagggaattgttgagtcgattgaggagcagggatagcaagactgcgatcaaggcaagtcatcactaatctttgagcatgttgaacctattgcgaaaattatgttgatttaataaaattacatgctatacatatgtgaatatgaatgccctacttgttaaatatgccatgccttgatattgattatctgtatgaccattgtaaaccctgctaacgtgtgtacttagtcgatattgaacaaatgcttagtcatgctaattagaatcatgcattctcatatttatcaagtgctatatgcttgggcaactaccttaaggaaggtagttgagatgcggcatgtggaggcatgggcaccacattgccatgacaaggataacatgaattgtgaaaagagaaacaaaactaaacactgttttcgaccggggcggctggggtacttgggtggtgtccagaaaaggctagtgccgtccctggtcagttaaggaccgagccgtaaagttaagcatgaaacgaccctcgtacaaccgtacttctcgtatgggtatagacctagcggagtacgtagccgagcgaaggcagtatccctgcatagtggttattcttggtgtgtgggagtcagggcctacgatgggacagccattggtggggccgcgaggggcgagtgcctatagtggtgccgccatcggtaggactgccatgtgtaaatttaatttaactaaaacttaatgcatgtgtgagtcttcccttcccgggagcgccagaactcctctcactgctagaaactcatgacacctagagtgcatgaggatgcaagttcatggagtgcatgaggatgcaagttcatggagcgggtactgccaacgtgaggttattgaaaggttttgccttggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcaggacatgtattacacttggctagactctaaattcttaaattgaatgagatgggatatgcatgatgattttatactggtggatcatcttctcgagagacgagaaggagtaaaccccagaaaaccattacagccagtaacgggaagccatctttgggaagacaatggatggtgaaaagaaccgttgctgtgtaataaatactggaattaaaactggactagtctatgctagataataagcttgtgaaaagaattgtgaaactagctttatgcaaataaaccaacggccatactttgaat

SEQ ID NO: 45539 - DNA, 233 bp, Oryza sativa
tagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgaaccacccgaaacgcaacccctctctggagatcaccagatctactcgtccccaatgg

SEQ ID NO: 45540 - DNA, 1501 bp, Oryza sativa
taacgtactaacatcctcctgtgatttgttcaactgatgattcatttgttgaacacttgactctgtgattcgttgcctcattactttgatacttagatacagttgcatacttggatttgaacgctggtttgataatctgaatttttattgcaaactttttgggtttggtgtattggctcgcgagctgaacgagctagctcaagctagccgagctgatccagtcttctagctcgttagaataacgagctggcttggcttgttatcctagcaagccagaccgagccgagccggctcatatccacccctatgtgggcttggtcgagatcggctcgttttagcccctgacgatagtaaaacaagggatcggtcggcggctcgcgaagcgaaagaaggaggaggcagttttcaattttcacacgactgcagcgccccaccctttcctactctttttatttccccacttgtcttcccccgtgcggcgccacacctcttctcatcttctcctcctatcaactccctctctctccaccgctccgcttgcctcggatcgcgctcgcgctcgcgcggagcagcgcccccaacgacgggcatggccggtgacagcggcaacagcgacggcggtagcaaccgggatgaggaggtccagatacagatcgcaggtcaatcaaatctttcccccccttcctctgtcgaaagcctcactgtttagctatgtccgattttcttcgttgagggagtgggggtgaggaggttagagtcgtcttgcgatgggcggcggtaaacgcagatgaaatgaactcgttcgttctctcgggcttatttggtgttcgatggtgtggggaagtaagcccgcgaggtgttcgatgaattgccttctcgtgcgtggcgtgttggatatggccatatgcccatatgggatttgttttttgtttatagaccatattaacttttcagactatcgtgacatcatcgagtggcagagtaggcatgtgagtttaattggcaaacccctgttgttcgcgtacatgagctggataagtggttgatgatagcaccagctatagtaatgcactgcatttaacaaaagtaaaatctttatattagtttttttatattagtgcaggatttccctgagattccaagtaactcgctttcatttgatagtttcaccaatggacaatactgtaaggatggagctatagtcttgtgttgctcgactttctctcaataaatttagagcttttggggtttatatggccaattgttggggggaaaaaaaggagaggagggtttcacttcactatgggaactttggtagtctattttgaataggaaaagaaagtttcagttggccgtgctatgcttaacacatgaagtttgggctaacctgttgatactgcctaccttctgtaacttgcagattcatccaaagctgcaacttcgtcaactcatgaagtacctatacagaactctcctgtcaagagttggcaatggtggctga

SEQ ID NO: 45541 - DNA, 436 bp, Oryza sativa
gatctagtttttgctagattgaggtggttggcgactctaggatcaccgcaaagcattaggtgctgcgatcgtggttgtcaacttgtcacaaaaagttgccaacacgattttttgacacctctttatagatttatcctgaaaaccttccgttttgcccacgagacgggtagttacctagaaatcggctttgctagccggtttagttatcaaaacccatcttggtctagtttttgctagattgaggtggttgatgactctaggatcaccgcaaggcattagcattaggtgctgcgatcgtggttgtcaacttgtcacaaaaagttgccaccacccactagagacaaaagaaacaccaaccaaacaattgagcaagaacaacatcatgcgaggtgatttggagattgacaaaaaaaaattaaggaagagcaaagggaga

SEQ ID NO: 45542 - DNA, 198 bp, Oryza sativa
gtaattatccaactaaaatgcgactgaatggtgggctgtgggtgcatggttttgctagtcgcacccaggcaattaaggaccggttcgcgggatgccttggaagaacttatcgtacttaccacaagccagcgtgggcaacggctgggcttgtagtgtagctttcctctagtcgacgcatccaggcaagggtgggcgtga

SEQ ID NO: 45543 - DNA, 312 bp, Oryza sativa
tatattctgatttttgacacatgaaaatgaaattaattctgcaatgaaagttagcttacaagttgcaatctcactactttgtctcatagcaaggcgactcttatctttgtgggcagattagagcattaaaatatggatctgcaccagtacagataaactttcccagtaatggatccaggtgaaaactgcaaaatattttatagatgtttgatgtgccaattggcaattatgtgttgtcaagtttactaagaagtggcaaatatgtgtttatgtgtacttatggcactgtgtttaaatttacttgtaaccagg

SEQ ID NO: 45544 - DNA, 489 bp, Oryza sativa
caaaaagagttgacatggcttctctcaaaacaagctttggtgcctcaattccaaaatttcaacaaaatattttttgcacaactattgtatttggatcagctgtccagttccatgtatttgtttagaaaacaaaaaagatagtgatcatatgatgctatgaattgaattagtgatttgactgttccttttttattagagggtaagttgacgaagtattcttaaagtggtctgatggatccctgcctattcttgaatgaatatttaattatatgctgtcatttctcatttagttactttcaactaatactacgtgcacattcactttttcttctagtctagtattccacgcggcaaagcaacgtgtactttctagtcaaccaaggcctagtttagctgaggaaaattgttaggtttggttctcacattgaatatacggacacacatttaaagtattaaacgtagttcaataacaaaacaaattatatattt

SEQ ID NO: 45545 - DNA, 1335 bp, Oryza sativa
aaacttttatatatgtgtttttagttacttaaaagccaatgctgaaaaagaaactacgttgaaaatatctcaaaatcaatctcaaaattaagtttgaaaatttaaattttggcttattctttggttgtttaggctatccgatgggagccgtataagaaatctatgtaaaaaaactcgcatgctaacttgatatgattttctagagaaatatatatctaagcgaattctcacagtgaattcactactagaatagtgaatgtcaacgaccaaaaactaacgacggctgcataatcttggtcgttgatactgctttgggccgatttctggtatccgacgacgctagttttttgtggtcgctaatgtgtagtgggctgcggtcgttgttgttatttactcaggttggatgggcaattgcaaatggtcgttattactcagcgacctgtgtcctcagctctccggccactgcagccgccgccgcactcggcttcggccaccgccgccgccgctgccctcggcttcggccaccgccttcgattcgctccacagctgcaagcctgcagctgctgcccatgctccctataactttgctctttgctgctctttgccatacaaaggaggtagcggcacagcgggaggaagaatccccatcattggcataggaacagtctatcagatcccctccaatccgctgctcccttccaaatccgaaatcccctcttttccccaaacatatttcgccccaaatcaatatgaatcaacagtttttgattccaaatccgagatcccctctgctacccccacatatttcgccccaaatcagtataaatcatgaggttgagagatgagagaagtgttgattcaccgccatgtctcgtagccgcagtttatcaccggaggtgacaactaggggctgcatcgaatggcctacatggtctcctcagggctcccaaatgtcaatccttcccaccaatgaacatcttgatgccaagctccaccatgagtacatctctccacctgatctgcccagccactctgttatttgttccagttcacttgggactcatcaatcgacgaaaatagtcacaacaggtattcttcaatctcctaatgtaaacatttgcatatgatttgtgaaacatattgaattatgtgctaggttaaatgttaaatcttgccaggttaaagtgttggttgtattgtccacttcgaaactaataaaagctgcaaagtttgctaggtggatactgattatttctatgctgccctcaacctgaaatgtttgatatggtcctgacaatttattgttgtggtagctatggcactttcattagcatt

SEQ ID NO: 45546 - DNA, 1501 bp, Oryza sativa
atgttaacaccaaatttagtatagtttatggatttgtcgctatcctgcgtatctttgttcttgggttaagaggtttagacaaccaatccaacactgtcgtctagttataaaaatgtactctttagtataaggtcataaccgatccaacaccatcgggtgtatattcggcatagttcatcaaggcattaggtgttagaggatcgaccgttcaaactagttatcatagtagaagaaaacaaccattatatttctttcaaaaaagacaataaaatatatgccgtgaaatatattgtactaaaatagtgtatattgtaaatgaattttaaggtaaaaaagaacagagaaaatgtattgtccgattatgacaaaaatgagtatagttacaaagtttactccttcgtacaaggtcataaccgatctaacgccatcgggtatatcggcatagttcaagaagccattaggtgttagaggattgactgttccaacaagattattacaatagaagaagacaaccattatatatagtgcataaaactttgaataaacacaataaaatatattgtactaaaataatatatattgtaaatgaattttgagttaaaaagaacagagaaaatgtgttgtgagattatgaaaaaaatgagtctaaaaaaattattagtacaatttcacatcagggacattaaagaaaataagttgtggctttttaaaaaaatttcagatgaatggaaaaaattatggcgggtgattacataccttttttattttttttggcgctcaaaggaggagttttaggcatatgtccatgtacatatctcctcctccattcataatagacccaatatcttctcccctctcacatcccctccctcactagattgagagaaccacggatggagcgctaatcattggtgccgatcggctgatcctctacttctccagcgcggcaccgtgccgcgtggcctcatcgcgctactgatccggtggttcccgtccgagtgcttcttcaatcaaaccctagaaagttctactacaggtcactacttctccctttgcattgaaatcatgtcgtttctgatctggtgcctgtcctctatccttaatcaatccatgatgtttggattctatccttaatcaatctgttgcatgtccgcatttgttagacatttctgaattgttgttttttgaatcaaacatattttatagcgctgggctgtcactttttttgtgtatgaattatttcatctatagtcaactaaaaacagaatgcagtgcaattaatcatattgccaaataataatttatatgatatctatctagtcttgacattttacctaacagtgtatcgtaactctcctttgacattaattatatatacagggtcatataaaacttaatatcaactagcaattagaggggatggctccaagcaaggcacggatgggccttgtggacgatcggctaaatcacgagtacttagagggtgtagagaagttcatag

SEQ ID NO: 45547 - DNA, 1501 bp, Oryza sativa
gataaccaaattcgtcaatgtaatcgaatatgaaccaagaagcttgagtaaacctgaataggaaaaaaaaatgttagtcccattcgaaaaaaaaaagtagtgtggtttttcatacatgcaagacaaagtaattgacatttttggtttggataatggctgcgggaaacgggagggtttgctggggttttggacacgggggagaaaacgttttaagaatggagagacgtattctatgagaaaccgccttcttagtcaggaagcggatttacactcagtaaaagcaatataaaaacgacatctcacattctcaccacgtcgtcctgtatccatgtcgatgtttgacctccaagcacagaaatgttggaggaattgtcacccctttccattcaatttatacagtggtttcggtgaactacctggtcggatttattttctaaagaatacccacgtctcaaaataataatccatgtgtatgcaaaacaatctcaggaagttacagcgtaataccattataccactatattatcttgccgcacataaatgcggtaattccgagtcaacagttaactgctggttcagcacaaataaaaaccaaaccaaagaagaacagcgaaaaataatatctgcaattaaatgagtccaaaaaggaaggaaaaaaaattaaatgatcttcccacatcaaaatgcaacgggccgctactatttatgtacattcccgcatttcttccgatgatgccactgcagctagtgttactgatcagcagctctacatgtttttactaattaacaagaaaccgtattgatctttgcagggaggcatcccagtcttctaccagccggagccccgatgagcttgaagagtctccacggatttgccggagttgagtagtagatgtcgacggggccattggtgcagttgatgcttgagtcgacgaccctggtgtgacggcgaccacggtggcggtcaaggtagacgacgatgatgctgatgtcgtcgtggaaacggcgcctcacttctctatcgtcttcagatggaagttgacctccctcttcctcgtggcttccttcaaagcggcctttaccactctgtttgctacatcctacatgaatattcagaggaacttggtgttatctcattgtgtgattcctcgttcattcatggggaataaactcccgatgatggcatgatcgaatgctgtagatgttgtctgaacttaccgttcttggattcttgaagacaatctgcaccgcagcgtcatcgctaagatgctcctagggaccatctgaagcaaatatcaggaacatatcatttggtttcagcttgcgaacttgaattgatggttctgcactaagagctagctgctttagaggaatagggggaccaatgctacgaaacacgggatccatgctatactcttgttccttcaagtaaacatcaccaatggttctcgatacctgacagtagaagagtaaaattttagcccatgtctctagtatttga

SEQ ID NO: 45548 - DNA, 198 bp, Oryza sativa
tcagtttgtcagaatcttgtctaaaattcccagttaagttccaggattatatttaatcagcaaagaatgtgatacaaactaatcagttctacctaatctttttgtatttgagtgttacctaaattcagaagttgttgttagtgctaaagctaaactcatagatcaatttttccccctctatgattgggaaattattct

SEQ ID NO: 45549 - DNA, 272 bp, Oryza sativa
gattccggcctccgtacggtccataacagtttgtccggaatgggattctggcccacccttcgtaaggtctggacgggattacggcctgcgtgcggtccacataagttgctccgttatcaaaactagtaatatgcccgtgctaaacgctacggtgtatgtctttaataatttttagaatttcatgttagaaaaagtttatatgatctatgcatttgaactttaattcaattcatatcctacataaaatatatttcatgtaaagtgcagtacta

SEQ ID NO: 45550 - DNA, 774 bp, Oryza sativa
tgggaagaagagtataaagtaatatagcaatacaatttagaagtaaaattcgaaattaaaaattaatgaatattgaaagatgagtttaagtccacatagaaatataattagaaataataaaaattcagaattaaaaaaatattattggaagaagagcctagagtcaactccctacgtcccaaaataaatcaacttctacaattcaaactttgtccgaaaataaatctacctctaccttcttatctactctcggttcacaaatcaaaaaattttattcctttaataccccttacctacctacccaccaatactaatttactaatattaaggggtagtttggacatttatcctctcctttagtgatgcattgggatgctagaatttgtctctttgtggaaaagagggagtatatagaaatacaatttacagataacaaaaattcagaattaaaacaaagaaatattgaaagacgaatctagagtccatataggaatataatttacaaataactaaaatttaatattaaaaataattaataactaacatgtatgtaaaatacaatataaatattacacattagtagtttcgtaaagttagtacaaaatttaaaattatgttgtcattttaatatatttgaataatacattgagaaaacatgtatgttattctatgagagaaaataccatgcgttagtattaaaataagagggataccaatcacatagtgaaaaaaagtgaatgggatcaactaaaactatttctgtagggtatctaa

SEQ ID NO: 45551 - DNA, 300 bp, Oryza sativa
acccctcggggagacagagggaggggtggccacatcttcctcgggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactctttaggcctggtgacaggtggggccggtctctacaggtgggcaggaacccagcggtcgcaagtcgcgcgcatcggcaagggaaaatcgaccgataataa

SEQ ID NO: 45552 - DNA, 1115 bp, Oryza sativa
tgtggttttggcgccacgtgtgtgggttaggtgagcacagcggggctcacctaaccgcatttaaagcaggttggacgagcgcgccacgccgcatttaatgcagcgcagcgctcgcttacccggtccgtgaccggtcgcagtggtgaccggtcacagaccggtcggatcgcgggttaggtggcaacaggcggcctgtcacacgcctcgccccgtcccgtcggaatgatgagagcctccaggcactcgtccctagccggagccggcgtgctaactcctggagttggcacgtcagtcccggccagattcataccaggcttcattgcaaccattgcaaggaagtcattgtatgaagaagggcagacatgtggcatgctaaactgacgcgtggtggacaaaaatgaccggtctgtgactggtctgacgccggtcacgtcatcggcagacaaccgtgctcccacgttgcatctgcttccggcggagtggaggtagatatgacccatcccgtcggagggtaattcggacagcggcaattgcaaatctccgcccattaatgaaggaatgacaggggtatcccctgtgtcaggcgagtgacggcgctgagcctcactcaaggacaagctgtgatttagcttccaggagaaggcgcgtgccaagttttggtcaagatagggtgggtccccacccaaaagaagagtaggtagaagtggtgcatgtggtatccccttgagatataaaaggaggaccttgcccaccgaagaagggggactggaggacgacatttagaatagctgaactctcttgctctccaactctctgtaactctttcacacacagatccaccagaacacaggagtagggtattacgcttctcagcggcccgaacctgtctacatcgcccgtgtcttgtgcgtttgctctctctcgcgaacattccatagatcgagggtgaagaatctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaa

SEQ ID NO: 45553 - DNA, 501 bp, Oryza sativa
ttgttgggtgaggaggtggtgttctttgatgttcggaagattcttctgacgaaccgcctactggggtttgttcggaatcgaatcttggggtggtgattaggagcaaagagagagatctcgatgctaattcaattgcaattggatgttattgtttgatgcaaacgacgttaaacctggacgatattgtcgcatccagttgaacctgtagtacacttgggctgttcttgattaatccccatctccttcctcctcccaatctcgtctcctcttgtacccaatcatccatccattgccgccgctttcgtggataaagtgggatttttttttcgtggtatcttctgaatttgacgtacccagtttccctttcatattatcttgctattcatgttgcgaaatattgatttctccacaggttagagaaggaagttgtgagctttaacaccatgctgagattactgttctctttgggaatttgcagatagaaaggagaagtgctcaaaa

SEQ ID NO: 45554 - DNA, 262 bp, Oryza sativa
agatatgaccaatccgtcggaggtcattcggacagcgcaaatgcaaatctcggcccattaatgaaggaatgacaggggtatcccctgtgttaggcgagtgacggcgctgagcctcactcaaggacaagctgtgatttagcttccaggagaaggcgcgtgccaagttttggtcaagatagggtgggtccccacccaaaagaagtgtaggtagaagtggtgcatgtggtatccccttgagatataaaaggaggaccttgcccac

SEQ ID NO: 45555 - DNA, 349 bp, Oryza sativa
acgtctgtatgtctagtgcctctgataagtaaaaaaaacacgttttgataagtcaattgacaaaactgtctttgattgcctctgtttgttgaaaaggtggttattttacaaagtactgtataggctattttatagaaaataaattttaaaattttaaaaaaaggaaatttgctaaaaaaggaaaattttgaaattcctaaaaaaatccagaaattgcttctttaccatttaaaaaaaaatcttgtttaatttaatccttttgggagtgtcttttccttaacttgcttgtgcaatcaacttgaatcaatgcattaactctctctctccctcttatcatgtgttctctaga

SEQ ID NO: 45556 - DNA, 1501 bp, Oryza sativa
  unsure (1)..(1501): unsure at all n locations
ngtctaatgatggcgcttatcaaagattccttcacgtcatgtaggtcccgcatatcaatgacatataaaagtatgaaagtttgccttatactagtttaaggtgttgctctcaaatcccatatccaccgctattcctttcggtcaatttgcatatctacctctcctcctgtcctctatattccaccttacatatctattgcgacaccattctccattcgctttttcctagttgtggtggagctccattccacaacctatctactccacgctaaggtttacaaaaatgtgcgatcaccatggttatcgcgtgcagtaagcttctcagtttttaaaatcacggtatgcatcgcggtaaccgcgtggttaccgtgataaccaccaaaccgtggggtgacggtaaccccacccaaaacggtttggtgaactctgctccgcactgcctctattaatcagcttcaatatacacctctaacaactttaccagcctcgatacacactaaagttgtcgtctccacaatagtcgccacaagaagccatttgatctatgagggaagaagacgatattacattagagggtttatatggtgatagcgattgtccatggatcagatgaacttaatcggccacatcgtactcctcggtgattacctttgcactcgaactgattatattatgctggaatgctggagttcacggcttcaatgtattacatatgaccaactttgtggttgctcatttacaatattgatcgtatctgttgtattagcacggatatattactggtgaggaaaagtgatgaactcacaatcagggatatacatagcaaactcaagtataaatatgtttgtcaagctttcaccacaattagtattgtacagttgtttctccaaaaagatcggttattgaactcttttctcaaaacagccaaacttttctaccagaacacacatttgggcatgtttggggagcttctagctgctgcagcttctcccataattaaaagctcccccaaacagtccagcttttggtccaaattttgagaagctgtagttgtagaatccagataatgaactagaagtcagaagttggaaaacctagcttttccagattctcagaagctgctaccaaccagctacttatcagaatcttaagctcccctaaacaggccaaaaacttcgtattcaaaaatttatatattgtccattatatagaatttctagagaattgtttagaatagctccccgtgcgatgaaaattgcaggcattgaggtgaacccagtttctggacaagaaaacattgagaagcagctttcagacaacaccaatactgtttcccagggggtcatgggtgaaagtgcattaatcctcctagtgggttttggtgattaatgacaaatgtggttaagggtctaatgagctcattgagtagctttcaggtgcattagtccaaggtgtgaaagatggatgcttggagacccctcaaaaagtacaaaatcaaagt

SEQ ID NO: 45557 - DNA, 1501 bp, Oryza sativa
  unsure (1)..(1501): unsure at all n locations
catatgtaatacattgaagccgtgaactccagcattccagcataatataatcagttcgagtgcaaaggtaatcaccgaggagtacgatgtggccgattaagttcatctgatccatggacaatcgctatcaccatataaaccctctaatgtaatatcgtcttcttccctcatagatcaaatggcttcttgtggcgactattgtggagacgacaactttagtgtgtatcgaggctggtaaagttgttagaggtgtatattgaagctgattaatagaggcagtgcggagcagagttcaccaaaccgttttgggtggggttaccgtcaccccacggtttggtggttatcacggtaaccacgcggttaccgcgatgcataccgtgattttaaaaactgagaagcttactgcacgcgataaccatggtgatcgcacatttttgtaaaccttagcgtggagtagataggttgtggaatggagctccaccacaactaggaaaaagcgaatggagaatggtgtcgcaatagatatgtaaggtggaatatagaggacaggaggagaggtagatatgcaaattgaccgaaaggaatagcggtggatatgggatttgagagcaacaccttaaactagtataaggcaaactttcatacttttatatgtcattgatatgcgggacctacatgacgtgaaggaatctttgataagcgccatcattagacnttaaacgaaaacctctttaaccttccaanaaatttncccaactagattaacttgacaaggtaataagtgacatgaagtaaactcttggagacgaccttaaactaatcaattggatcctttataaaaataaggaaaaaaaatcaaataccccttataagtcacggtctttctaccctctccctacatcttacttttgtataaaacttcccctacaagttcaatttttcttccagtttctcaacttccattacttttcaatgatcttatcatcattggctcaatccctcgtgacgcgtgggcttctagcaagacgagatgaggttaccccatgtcacctctaaagggcacctatctccttaccaaccatgaatcgcactgcgctgtatatgtttcgaacaccaccattgtgttttgcatcgaggtttgccgccatgctcgcgggaggtaggtggaacccacccttgcaaaagatgacacgaggtaaatctattatttttccatgtcggttgcccactaaggcacgagaaattggaaaaaaacaagtgaaaactagcggcaagtggaaagcaagaagagatggatcaaacttgggggggaggggagtcttttgtccaaaagtgaattttataggggtatttggatttattttttatgagaaaataaaaactaatcgattggggaccacttgccagctccacgtcagcccccatccccgggcccacaacccgacaaagataaaccccatgacggagaggaatcaatcatcaagataacgaagagtcgagg

SEQ ID NO: 45558 - DNA, 449 bp, Oryza sativa
caggtacagtggcggtcagattggcatcgaggcaagtttgtgcataatctaagttagactattgtgaagcatgaaggtaagttttcaggtaagtctgattctgattttattagtgcatatgtgcctactggttctactggtcatgtgactcagtgttggattccaaaatttcttatttcttgtaatgccccgagttttaaattaatatatttcgcggagtattagagcaattgcgcaaaagttcaacttttaaaccattgttcgtataggcgattgggaaccgtggatgcgtagagctcgccgagtagtgcaaaatagactataaatttatagtaatcggagtccgaacgaagtcccgaggattaaatagatgtgagccgttagatcttatttagtctctttatataacccacaaaaaaaacaaacgaaaaaaaaaacaggagaatcgc

SEQ ID NO: 45559 - DNA, 1501 bp, Oryza sativa
  unsure (1)..(1501): unsure at all n locations
tagaaatttcggcaaaatctcccctaaaaatacggacatcacgacaggcagttataagaaaggtcaataccgatataagccacacaatccaaaccatcctagctccacaaatcccacgtgaaaaataaggatcagaaccttaaatgacctttacaagttctatgcaaaacttttgctgagcaaaaaatagtctaaaactaatttcaattgtgtgcaataataatgtgtagtccaagggtgctactcccgccccatgccgatcgatgtcattaggtacctaaaaaccaaattaaacacaagagtgagtaaagaatactcagcaaatacaatcttgaactagtaaaacatacgcatgatttatgcattaagaaaccaatatgaagggttggatttactttatttttaaaccaaagaagtcaaaagatagtagttccctcccgggcaggtctgaatatcctcttagcattaccggtaagccgagcaagcgtgatcagcgcttctcaaggatcatgaataaagacccaaattgcactcccatggctacgcatggttcttgaataatgtaaacagaacatccggaataatgaaacatgaataacgtcatgaatttgaatatgggtcgaaacacgaataagtagcataacgtcagagccatacaatcagtaatatcaagcaattgaataataattatgcaagtaaagccaaacaaaacaactcagtttgtccatcacataagtctgtcttgtacttgccttaactccttcgatactccgactcaactcctccaacgttggaacccttcacacctgtggagcaaaactacgcataaaccactatattcaactaacgatggttacaagggatatttactaaaatcgaaacctagaacatataaaccttttaccgatttgattaaataacctatagctgntccattactggtttatgcgtaactcacaaaccgtctaacggaaactagcaaataatacaacttcagacatctagaaaaaattctctacaactttcatgttgagcacaaaatcagattatgcctctgaaaatcccagattaaggaaaacgaactactgtcctgagttcctgtctctgtcagcagnattggttttgctgtttctcctaaaccggttatcggaatcgagtgaaactagcaccggtggaaagatatcgacaatgactacaaactttatttaggacaactaacccgattcctgatgggttaataccagatttgaaaatacggtttcagcctagcggtcgatataaaataaaattcaaaaaaccgggaacggatcgtctttaatataaattagaaacaactatagactaaaacggattacctagcagtactaatgtataagaaaaacgaagaatttggaaatattcaccaaattccccaaatttcccttcttctatcaaatttccccttctttccttccttcctgttcttctctgccttctctccctccttcctgttcgttgcagg
